US011535835B1

(12) United States Patent
Oakes et al.

(10) Patent No.: US 11,535,835 B1
(45) Date of Patent: *Dec. 27, 2022

(54) COMPOSITIONS AND METHODS FOR THE TARGETING OF RHODOPSIN

(71) Applicant: Scribe Therapeutics Inc., Alameda, CA (US)

(72) Inventors: Benjamin Oakes, El Cerrito, CA (US); Hannah Spinner, Boston, MA (US); Sarah Denny, San Francisco, CA (US); Brett T. Staahl, Tiburon, CA (US); Kian Taylor, Atlanta, GA (US); Katherine Baney, Berkeley, CA (US); Isabel Colin, Oakland, CA (US); Maroof Adil, Davis, CA (US); Cole Urnes, Los Angeles, CA (US); Sean Higgins, Alameda, CA (US)

(73) Assignee: Scribe Therapeutics Inc., Alameda, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/483,681

(22) Filed: Sep. 23, 2021

Related U.S. Application Data

(63) Continuation of application No. PCT/US2020/063477, filed on Dec. 4, 2020.

(60) Provisional application No. 62/945,044, filed on Dec. 6, 2019.

(51) Int. Cl.
| | | |
|---|---|---|
| *C12N 9/22* | (2006.01) | |
| *C12N 15/11* | (2006.01) | |
| *A61K 48/00* | (2006.01) | |
| *A61P 27/02* | (2006.01) | |
| *A61K 38/00* | (2006.01) | |

(52) U.S. Cl.
CPC ............. *C12N 9/22* (2013.01); *A61K 48/005* (2013.01); *A61P 27/02* (2018.01); *C12N 15/11* (2013.01); *A61K 38/00* (2013.01); *C12N 2310/20* (2017.05)

(58) Field of Classification Search
CPC ....... C12N 9/22; C12N 2310/20; A61K 38/00
See application file for complete search history.

(56) References Cited

U.S. PATENT DOCUMENTS

| | | | |
|---|---|---|---|
| 5,173,414 A | 12/1992 | Lebkowski et al. | |
| 5,405,783 A | 4/1995 | Pirrung et al. | |
| 5,412,087 A | 5/1995 | Mcgall et al. | |
| 5,445,934 A | 8/1995 | Fodor et al. | |
| 5,695,937 A | 12/1997 | Kinzler et al. | |
| 2016/0324987 A1 | 11/2016 | Wang et al. | |
| 2017/0233756 A1 | 8/2017 | Begemann et al. | |
| 2017/0369870 A1 | 12/2017 | Gill et al. | |
| 2018/0250370 A1* | 9/2018 | Bartsevich ............. | C12N 15/52 |
| 2018/0258424 A1 | 9/2018 | Greenberg et al. | |
| 2019/0153440 A1 | 5/2019 | Kantardzhieva et al. | |
| 2019/0153441 A1* | 5/2019 | Kantardzhieva ..... | C12N 15/907 |
| 2022/0081681 A1 | 3/2022 | Oakes et al. | |

FOREIGN PATENT DOCUMENTS

| | | | |
|---|---|---|---|
| WO | WO-2010/075303 A1 | 7/2010 | |
| WO | WO-2012/068627 A1 | 5/2012 | |
| WO | WO-2016/191684 A1 | 12/2016 | |
| WO | WO-2017/068077 A1 | 4/2017 | |
| WO | WO-2017/147345 A1 | 8/2017 | |
| WO | WO-2017/176529 A1 | 10/2017 | |
| WO | WO-2018/009562 A1 | 1/2018 | |
| WO | WO-2018/064371 A1 | 4/2018 | |
| WO | WO-2018/195555 A1 | 10/2018 | |
| WO | WO-2019/102381 A1 | 5/2019 | |
| WO | WO-2019/183630 A2 | 9/2019 | |
| WO | WO-2020/023529 A1 | 1/2020 | |
| WO | WO-2020/041456 A1 | 2/2020 | |
| WO | WO-2020/247882 A1 | 12/2020 | |
| WO | WO-2020247882 A1 * | 12/2020 | ............... C12N 9/22 |
| WO | WO-2021/113763 A1 | 6/2021 | |
| WO | WO-2022/120095 A1 | 6/2022 | |

OTHER PUBLICATIONS

Yin et al. Partial DNA-guided Cas9 enables genome editing with reduced off-target activity. Nature Chemical Biology, vol. 14, pp. 311-316, p. 1/1 of Online Methods, and pp. 1/14-14/14 of Supplementary Information, Jan. 29, 2018. (Year: 2018).*

Moon et al. Improving CRISPR genome editing by engineering guide RNAs. Trends in Biotechnology, vol. 37, No. 8, pp. 870-881, Mar. 4, 2019. (Year: 2019).*

Giannelli et al. Human Molecular Genetics, vol. 27, No. 5, pp. 761-779, and pp. 1/13-13/13 of Supplementary Text and Figures, Dec. 21, 2017. (Year: 2017).*

Fowler et al. Measuring the activity of protein variants on a large scale using deep mutational scanning. Nature Protocols, vol. 9, No. 9, pp. 2267-2284, 2014. (Year: 2014).*

Aguilera, T.A. et al. (2009). "Systemic in vivo distribution of activatable cell penetrating peptides is superior to that of cell penetrating peptides," Integr. Biol. (Camb) 1(5-6):31-381.

Altschul, S.F. et al. (1990). "Basic local alignment search tool," J. Mol. Biol. 215:403-410.

Athanasiou, D. et al. (2018). "The molecular and cellular basis of rhodopsin retinitis pigmentosa reveals potential strategies for therapy," Prog. Retin. Eye Res. 62:1-23.

(Continued)

*Primary Examiner* — Jennifer Dunston
(74) *Attorney, Agent, or Firm* — Cooley LLP

(57) ABSTRACT

Provided herein are Class 2 Type V CRISPR:gNA systems comprising Class 2 Type V CRISPR polypeptides (e.g. CasX), guide nucleic acids (gNA), and optionally donor template nucleic acids useful in the modification of a RHO gene. The systems are also useful for introduction into cells, for example eukaryotic cells having mutations in the rhodopsin protein. Also provided are methods of using such systems to modify cells having such mutations and utility in methods of treatment of a subject with a RHO-related disease, such as retinitis pigmentosa.

26 Claims, 41 Drawing Sheets

Specification includes a Sequence Listing.

(56) References Cited

OTHER PUBLICATIONS

Burstein, D. et al. (2 017). "New CRISPR-Cas systems from uncultivated microbes," Nature 542:237-241.
Chadderton, N. et al. (2009), "Improved Retinal Function in a Mouse Model of Dominant Retinitis Pigmentosa Following AAV-delivered Gene Therapy," Mol. Ther. 17:593-599.
Chen, B. et al. (2003). "Influence of histidine on the stability and physical properties of a fully human antibody in aqueous and solid forms," Pharm. Res. 20:1952-1960.
Chinchore, Y. et al. (2009). "Accumulation of Rhodopsin in Late Endosomes Triggers Photoreceptor Cell Degeneration," PLoS Genetics 5:e1000377.
Dejneka, N.S. et al. (2001). "Gene therapy and retinitis pigmentosa: advances and future challenges," Bio Essays 23:662.
Dryja, T.P et al. (2000). "Novel Rhodopsin Mutations Gly114Val and Gln184Pro in Dominant Retinitis 33 Pigmentosa," Invest Opthalmol Vis Sci 41:3124.
Foust, K.D. et al. (2013). "Therapeutic AAV9-mediated suppression of mutant RHO slows disease progression and extends survival in models of inherited ALS," Mol Ther. 21:2148.
GenBank Accession No. NM_000539.2 (2008). *Homo sapiens* rhodopsin (opsin 2, rod pigment) 35 (retinitis pigmentosa 4, autosomal dominant) (RHO), mRNA, 3 total pages.
Ghiriando, R. et al. (1999). "Glycosylation of human IgG-Fc: influences on structure revealed by 36 differential scanning microcalorimetry," Immunol Letters 68:47-52.
Giannelli, S.G. et al. (2018). "Cas9/sgRNA selective targeting of the P23H Rhodopsin mutant allele for treating retinitis pigmentosa by intravitreal AAV9.PHP.B-based delivery," Human Mol. Genetics 27:761-779.
Goto, Y. et al. (1995). "Functional Abnormalities in Transfenic Mice Expressing a Mutant Rhodopsin Gene," Invest Opthalmol Vis Sci 36:62.
Hargrave, P.A. et al. (1992). "Rhodopsin and phototransduction: a model system for G protein-linked receptors," FASEB J. 6:2323.
Hermonat, P.L. et al. (1984), "Use of adeno-associated virus as a mammalian DNA cloning vector: 40 Transduction of neomycin resistance into mammalian tissue culture cells," PNAS 81:6466-6470.
HGNC: 10012 (2021). Gene Symbol Report. HGNC data for RHO, 4 total pages.
International Search Report dated May 7. 2021, for PCT Application No. PCT/US2020/063477, filed on Dec. 4, 2020, 7 pages.
Kotin, R.M. (1994). "Prospects for the use of adeno-associated virus as a vector for human gene 43 therapy," Human Gene Therapy 5:793-801.
Latella, M.C. et al. (2016). "In vivo Editing of the Human Mutant Rhodopsin Gene by Electroporation of Plasmid-based CRISPR/Cas9 in the Mouse Retina," Mol. Ther.—Nucl. Acids 5:0389, 12 total pages.
Li, P. et al. (2018). "Allele-Specific CRISPR-Cas9 Genome Editing of the Single-Base P23H Mutation for Rhodopsin-Associated Dominant Retinitis Pigmentosa," The CRISPR Journal 1:55-64.
Liu, J-J. et al. (2019). "CasX enzymes comprise a distinct family of RNA-guided genome editors," Nature 566:218-223.
Liu, X. et al. (1996). "Structure and function in rhodopsin: Correct folding and misfolding in two point mutants in the intradiscai domain of rhodopsin identified in retinitis pigmentosa," PNAS 93:4554.
Murray, A. et al. (2002). "Epitope Affinity Chromatography and Biophysical Studies of Monoclonal Antibodies and Recombinant Antibody Fragments," J. Chromatogr Sci 40:343-349.

Nathans, J. et al., (1986). "Molecular genetics of inherited variation in human color vision," Science 232:203.
Nathans, J. et al. (1984). "Isolation and nucleotide sequence of the gene encoding 50 human rhodopsin," PNAS 81:4851.
Noguchi, H. et al. (2003). "PDX-1 protein containing its own antennapedia-like protein transduction domain can transduce pancreatic duct and islet cells," Diabetes 52:1732-1737.
Olsson, J.E et al., (1992). "Transgenic Mice with a Rhodopsin Mutation (Pro23His): A Mouse Model of Autosomal Dominant Retinitis Pigmentosa," Neuron 9:815-830.
Phillips, M.J. et al. (2014). "Modeling Human Retinal Development with Patient-Specific induced Pluripotent Stem Cells Reveals Multiple Roles for Visual System Homeobox 2," Stem Cells 32:1480-1492.
Sakami, S. et al. (2011). "Probing mechanisms of photoreceptor degeneration in a new mouse model of the common form of autosomal dominant retinitis pigmentosa due to P23H opsin mutations," J. Biol. Chem. 286:10551-10567.
Samulski, R.J. et al., (1989). "Helper-Free Stocks of Recombinant Adeno-Associated Viruses: Normal Integration Does Not Require Viral Gene Expression," J. Virol. 63:03822-3828.
Smith, T.F. et al. (1981). "Comparison of biosequences," Adv. Apol. Math. 2:482-489.
Trapani, I. et al. (2018). "Seeing the Light after 25 Years of Retinal Gene Therapy," Trends in Mol. Med. 24:669-681.
Tratschin, J-D. et al. (1985). "Adeno-Associated Virus Vector for High-Frequency Integration, 58, Expression, and Rescue of Genes in Mammalian Cells," Mol. Cell. Biol. 5:3251-3260.
Tratschin, J-D. et al. (1984). "A Human Parvovirus, Adeno-Associated Virus, as a Eucaryotic Vector: Transient Expression and Encapsidation of the Procaryotic Gene for Chloramphenicol Acetyltransferase," Mol. Cell. Biol. 4:2072-2081.
Tréhin, R. et al. (2004). "Cellular uptake but iow permeation of human calcitonin-derived cell penetrating peptides and Tat(47-57) through well-differentiated epithelial models," Pharm. Res. 21:1248-1256.
Tucker, B.A. et al. (2011). "Transplantation of Adult Mouse iPS Cell-Derived Photoreceptor Precursors 61 Restores Retinal Structure and Function in Degenerative Mice," PLoS One 6:e18992.
Wender, P.A. et al. (2000). "The design, synthesis, and evaluation of molecules that enable or 82 enhance cellular uptake: peptoid molecular transporters," PNAS 97:13003-13008.
Written Opinion of the International Searching Authority dated May 7, 2021, for PCT Application Number PCT/US2020/063477, filed on Dec. 4, 2020, 12 pages.
Zender, L. et al. (Jun. 2002). "VP22-mediated intercellular transport of p53 in hepatoma cells in vitro and in vivo," Cancer Gene Ther. 9:489-496.
Zhang, J. et al. (Jun. 1997). "PowerBLAST: a new network BLAST application for interactive or automated sequence analysis and annotation," Genome Res. 7:649-656.
Zhong, X. et al. (2014). "Generation of three-dimensional retinal tissue with functional photoreceptors from human IPSCs," Nat. Commun. 5:4047.
Liu, J.J. et al. CasX enzymes comprise a distinct family of RNA-guided genome editors, Nature 568:E8-E10. (Author correction: published online Apr. 3, 2019).
Qi, L.S. et al. (Feb. 2013). "Repurposing CRISPR as an RNA-guided platform for sequencespecific control of gene expression," Cell 152:1173-1183.
Yang, H. et al. (May 2019). "CasX: a new and small CRISPR gene-editing protein, " Cell Res. 29:345-346. Published online Apr. 16, 2019.

* cited by examiner

COMPOSITIONS AND METHODS FOR THE TARGETING OF RHODOPSIN

CROSS REFERENCE TO RELATED APPLICATIONS

This application is a continuation of International Patent Application No. PCT/US2020/063477, filed on Dec. 4, 2020, which claims priority to and the benefit of U.S. Provisional Patent Application No. 62/945,044, filed on Dec. 6, 2019, the contents of each of which are incorporated herein by reference in their entirety.

INCORPORATION BY REFERENCE OF SEQUENCE LISTING

This application contains a Sequence Listing which has been submitted in ASCII format via EFS-WEB and is hereby incorporated by reference in its entirety. Said ASCII copy, created on Jul. 26, 2022 is named SCRB_018_01US_2ndSubSeqList_ST25.txt and is 6.70 MB in size.

BACKGROUND

Retinitis pigmentosa (RP) is a progressive neurodegenerative disorder, which affects 1 in 3,000 individuals (Chinchore, Y. et al. Accumulation of Rhodopsin in Late Endosomes Triggers Photoreceptor Cell Degeneration. PLoS Genetics. 5(2): e1000377 (2009)). The disorder begins with death of rod photoreceptor cells, which are the only cells in the retina to express rhodopsin. The loss of rod photoreceptor cells in the retina eventually leads to loss of cone cells; the mainstay of human vision.

Rhodopsin is the visual pigment of photoreceptors in retinal rods. Rhodopsin is a G-coupled receptor, which comprises almost 50% of the total protein content of rod outer segments and 80% of that of discs (Hargrave P A, et al. Rhodopsin and phototransduction: a model system for G protein-linked receptors. FASEB J. 6(6):2323 (1992)). Rhodopsin, which has 348-amino acids with 7 transmembrane domains, a luminal N-terminus and a cytoplasmic C-terminus, mediates vision in dim light and absorbs maximally at 495 nm. (Nathans, J., et al. Molecular genetics of inherited variation in human color vision. Science 232: 203 (1986)). Over 150 distinct mutations in the light-sensing molecule rhodopsin are known to cause autosomal dominant retinitis pigmentosa (adRP) and most are missense mutations affecting single amino acid residues in the rhodopsin protein (Athanasiou, D., et al. The molecular and cellular basis of rhodopsin retinitis pigmentosa reveals potential strategies for therapy. Prog Retin Eye Res. 62; 1 (2018)). Mutations in rhodopsin are also associated with dominant congenital stationary night blindness (adCSNB) and, less frequently, recessive RP (arRP). Recessive RP is usually associated with loss of rhodopsin function, whereas the dominant conditions are a consequence of gain of function and/or dominant negative activity. Several of these mutations are listed in Table 3. These mutations affect rhodopsin transport to the outer segments of rod photoreceptor cells, rhodopsin folding, and rhodopsin endocytosis. Mutations in the human rhodopsin that affect its folding, trafficking and activity are the most commonly encountered causes of retinal degeneration in patients afflicted with RP. Due to their improper folding, class II mutants are labeled with ubiquitin and are destined for degradation by the ubiquitin proteasome system (UPS). Because of the large protein load, the degradation machinery is overwhelmed, which results in a failure to clear other misfolded proteins and leads to cell toxicity. A single base-substitution mutation in position 23 of the rhodopsin gene (RHO), in which proline is changed to histidine (Pro23His or P23H), accounts for 25% to 40% of all cases of adRP in North America (Dejneka N S, Bennett J. Gene therapy and retinitis pigmentosa: advances and future challenges. BioEssays. 23:662 (2001)).

The advent of CRISPR/Cas systems and the programmable nature of these systems has facilitated their use as a versatile technology for genomic manipulation and engineering. Particular CRISPR proteins are particularly well suited for such manipulation. For example CasX, has a compact size, offering ease of delivery, and the nucleotide sequence encoding the protein is relatively short, an advantage for its incorporation into viral vectors for delivery into a cell.

As the treatment options for RP remain inadequate, there is a critical need for developing safe and permanent treatments for this disorder. Provided herein are compositions and methods for targeting rhodopsin mutations to the address this need.

SUMMARY

The present disclosure provides compositions of modified Class 2, Type V CRISPR proteins and guide nucleic acids used in the editing of rhodopsin (RHO) gene target nucleic acid sequences having one or more mutations. The Class 2, Type V CRISPR proteins and guide nucleic acids can be modified for passive entry into target cells. The Class 2, Type V CRISPR proteins and guide nucleic acids are useful in a variety of methods for target nucleic acid modification, which methods are also provided.

In one aspect, the present disclosure relates to Class 2 Type V CRISPR protein and guide nucleic acid systems (e.g. CasX:gNA system) and methods used to alter a target nucleic acid comprising the RHO gene in cells. In some embodiments of the disclosure, the system has utility in modifying RHO target nucleic acid sequence in a population of cells to correct or compensate for the one or more mutations of the RHO gene in the cells of the population, including, but not limited to the mutations of Table 4A. In other embodiments, the system has utility in modifying RHO target nucleic acid sequence in a subject.

In some embodiments, the Class 2 Type V:gNA system gNA is a gRNA, or a gDNA, or a chimera of RNA and DNA, and may be a single-molecule gNA or a dual-molecule gNA. In other embodiments, the system gNA has a targeting sequence complementary to a target nucleic acid sequence comprising a region within the RHO gene or that comprises a sequence having at least about 50%, at least about 60%, at least about 70%, at least about 80%, at least about 85%, at least about 90%, or at least about 95%, or 100% sequence identity to a sequence selected from the group consisting of SEQ ID NOS:328-346, 367-376, 382-2100 and 2286-27274. In some embodiments the gNA has a targeting sequence consisting of a sequence selected from the group consisting of SEQ ID NOS: 328-346, 367-376, 382-2100 and 2286-27274. In some embodiments, the targeting sequence of the gNA is complementary to a sequence within or proximal to an exon of exons 1 to 5 of the RHO gene. In another embodiment, the targeting sequence of the gNA is complementary to a sequence within or proximal to an intron of the RHO gene. In another embodiment, the targeting sequence of the gNA is complementary to a sequence within or proximal to an intron-exon junction of the RHO gene. In another embodiment, the targeting sequence of the gNA is complementary to a sequence within or proximal to a regulatory element of the RHO gene. In another embodiment, the targeting sequence of the gNA is complementary to a sequence within or proximal to an intergenic region of the RHO gene. The gNA can comprise a targeting sequence comprising 14 to 30 consecutive nucleotides. In other embodiments, the targeting sequence of the gNA consists of 20 nucleotides. In other embodiments, the targeting sequence consists of 19 nucleotides. In other embodiments, the targeting sequence consists of 18 nucleotides. In other embodiments, the targeting sequence consists of 17 nucleotides. In other embodiments, the targeting sequence consists of 16 nucleotides. In other embodiments, the targeting sequence consists of 15 nucleotides. In a particular embodiment, the targeting sequence comprises a sequence of AAGUGGCUGCGUACCACACC (SEQ ID NO: 382).

In some embodiments, the gNA has a scaffold comprising a sequence selected from the group consisting of sequences of SEQ ID NOS; 4-16, or a sequence having at least about 50%, at least about 60%, at least about 70%, at least about 80%, at least about 90%, at least about 95%, at least about 96%, at least about 97%, at least about 98%, or at least about 99% sequence identity thereto. In other embodiments, the CasX:gNA system gNA variant has a scaffold comprising a sequence selected from the group consisting of sequences of SEQ ID NOS: 2201-2285, or a sequence having at least about 50%, at least about 60%, at least about 70%, at least about 80%, at least about 90%, at least about 95%, at least about 96%, at least about 97%, at least about 98%, at least about 99% sequence identity thereto. In some embodiments, the CasX:gNA system gNA variant has a scaffold consisting of a sequence selected from the group consisting of sequences of SEQ ID NOS: 2201-2285.

In some embodiments, the Class 2 Type V CRISPR protein comprises a reference CasX sequence comprising any one of SEQ ID NOS: 1-3 or a CasX variant sequence SEQ ID NOS: 49-160, 237-239, 243-246, 251-263 or 273-281 as set forth in Tables 3, 6, 7, 8, and 10, or a sequence having at least about 50%, at least about 60%, at least about 70%, at least about 80%, or at least about 90%, or at least about 95%, or at least about 96%, or at least about 97%, or at least about 98%, or at least about 99% sequence identity thereto. In these embodiments, a CasX variant exhibits one or more improved characteristics relative to the reference CasX protein. In some embodiments, the CasX protein has binding affinity for a protospacer adjacent motif (PAM) sequence selected from the group consisting of TTC, ATC, GTC, and CTC. In some embodiments, the CasX protein has binding affinity for the PAM sequence that is at least 1.5-fold greater compared to the binding affinity of any one of the CasX proteins of SEQ ID NOS: 1-3 for the PAM sequences selected from the group consisting of TTC, ATC, GTC, and CTC.

In some embodiments of the Class 2 Type V CRISPR: gNA system, the CRISPR molecule and the gNA molecule are associated together in a ribonuclear protein complex (RNP). In a particular embodiment, the RNP comprising a CasX variant and the gNA variant exhibits greater editing efficiency and/or binding of a target sequence in the target DNA when any one of the PAM sequences TTC, ATC, GTC, or CTC is located 1 nucleotide 5' to the non-target strand sequence having identity with the targeting sequence of the gNA in a cellular assay system compared to the editing efficiency and/or binding of an RNP comprising a reference CasX protein and a reference gNA in a comparable assay system.

In some embodiments, the system further comprises a donor template comprising a nucleic acid comprising at least a portion of a wild-type RHO gene sequence, wherein the RHO gene portion is selected from the group consisting of a RHO exon, a RHO intron, a RHO intron-exon junction, a RHO regulatory element, or combinations thereof, wherein the donor template is inserted by homology-directed repair (HDR) or homology-independent targeted integration (HITI) to correct or compensate for the mutation in the RHO gene, such that a functional rhodopsin protein can be expressed. In other embodiments, the donor template comprises a nucleic acid sequence having one or more mutations relative to the wild-type RHO gene sequence such that, upon insertion, the RHO gene is knocked-down or knocked-out. In some cases the donor sequence is a single-stranded DNA template or a single stranded RNA template. In other cases, the donor template is a double-stranded DNA template.

In another aspect, the disclosure relates to nucleic acids encoding the systems of any of the embodiments described herein, as well as vectors comprising the nucleic acids. In some embodiments, the vector is selected from the group consisting of a retroviral vector, a lentiviral vector, an adenoviral vector, an adeno-associated viral (AAV) vector, a herpes simplex virus (HSV) vector, a plasmid, a minicircle, a nanoplasmid, and an RNA vector. In other embodiments, the vector is a virus-like particle (VLP) comprising one or more components of a gag polyprotein and an RNP of a CasX and gNA of any of the embodiments described herein and, optionally, a donor template nucleic acid.

In another aspect, the disclosure provides a method of modifying a RHO target nucleic acid sequence in a population of cells, wherein said method comprises introducing into the cells of the population: a) a composition comprising the Class 2 Type V:gNA system of any of the embodiments disclosed herein; b) the nucleic acid of any of the embodiments disclosed herein; c) the vector of any of the embodiments disclosed herein; d) the VLP of any of the embodiments disclosed herein; or e) a combination of two or more of the foregoing wherein the RHO target nucleic acid sequence of the cells targeted by the first gNA is modified by the Class 2 Type V CRISPR protein (e.g. CasX). In some embodiments of the method, the method comprises introducing into the cells of the population a second gNA or a nucleic acid encoding the second gNA, wherein the second gNA has a targeting sequence complementary to a different or overlapping portion of the RHO target nucleic acid compared to the first gNA, resulting in an additional break in the RHO target nucleic acid of the cells of the population. In some embodiments of the method, the modifying comprises introducing an insertion, deletion, substitution, duplication, or inversion of one or more nucleotides in the target nucleic acid sequence as compared to the genomic sequence, wherein the modifying results in a correction of or compensation for the mutation of the RHO gene in the cells of the population. As used herein, "compensation" means that the sequence of the target nucleic acid is modified such that, while not being identical to a wild-type genomic sequence, a functional rhodopsin protein is nevertheless able to be expressed from the modified gene. In some cases, the method further comprises contacting the target nucleic acid with a donor template nucleic acid of any of the embodiments disclosed herein, wherein insertion of the donor template results in a correction of the RHO gene in the cells of the population such that a functional rhodopsin protein is expressed in the cells of the population. In some cases, the modification results in expression of a functional rhodopsin protein that is increased by at least about 10%, at least about 20%, at least about 30%, at least about 40%, at least about 50%, at least about 60%, at least about 70%, at least about 80%, or at least about 90% in comparison to a cell where the RHO gene has not been modified. The cells of the population to be modified by the methods of the embodiments are eukaryotic. In some embodiments of the method, the eukaryotic cells for modification are selected from the group consisting of rodent cells, mouse cells, rat cells, and non-human primate cells. In other embodiments of the method, the eukaryotic cells for modification are human cells. In some embodiments of the method, the eukaryotic cells for modification are selected from the group consisting of a rod photoreceptor cell, a retinal progenitor cell, a pluripotent stem cell (iPSC), fibroblasts, and Müller glial cells. In some embodiments of the method, the modifying of the RHO gene target nucleic acid sequence of the population of cells occurs in vitro or ex vivo. The present disclosure provided populations of such cells modified by the foregoing methods. In one embodiment, the modified cells of the population can be administered to one or both eyes of the subject having a RHO-related disease, using a therapeutically effective amount of the cells. In other embodiments of the method, the modifying of the RHO gene target nucleic acid sequence of the population of cells occurs in vivo in a subject, wherein the subject is selected from the group consisting of a rodent, a mouse, a rat, a non-human primate, and a human.

In other embodiments, the present disclosure provides methods of treating a RHO-related disease (e.g., retinitis pigmentosa) in a subject in need thereof, comprising modifying a RHO gene having one or more mutations in eye retinal cells of the subject, the modifying comprising contacting said cells with a therapeutically effective dose of: i) a composition comprising a CasX and gNA of any of the embodiments disclosed herein and, optionally, a donor template; ii) a nucleic acid encoding the composition of (i); a vector selected from the group consisting of a retroviral vector, a lentiviral vector, an adenoviral vector, an adeno-associated viral (AAV) vector, a herpes simplex virus (HSV) vector, a plasmid, a minicircle, a nanoplasmid, a DNA vector, and an RNA vector, and comprising a nucleic acid of (ii); iii) a VLP comprising the composition of (i); or iv) combinations of two or more of (i)-(iii), wherein the RHO gene of the cells targeted by the first gNA is modified by the CasX protein (and, optionally, the donor template) such that the mutation of the RHO gene is corrected or compensated for and a functional rhodopsin protein is expressed. In other embodiments of the method of treating a RHO-related disease in a subject, the RHO gene is knocked-down or knocked-out such that the expression of non-functional rhodopsin protein is reduced or eliminated. In some embodiments, the subject is selected from the group consisting of a rodent, a mouse, a rat, a non-human primate, and a human. In some embodiments, the therapeutically effective dose is administered to the subject by a route of administration selected from intraocular, intravitreal, subretinal, or suprachoroidal injection or implantation, or combinations thereof. In some embodiments, the method results in improvement in one or more clinically-relevant endpoints selected from the group consisting of mean change or mean rate of change in: 1) best corrected visual acuity (BCVA); 2) visual field sensitivity (including analysis of hill of vision volumes); 3) retinal sensitivity measured by full-field stimulus testing (FST); 4) multiluminance mobility tests; 5) electrophysiological measures of retinal function; 6) optical coherence tomography (OCT) documenting the rate of photoreceptor loss; and 7) hypo- or hyperfluorescent lesion size on fundus autofluorescence; 8) color vision; 9) contrast sensitivity; 10) gaze tracking; 11) light aversion; 12) macular sensitivity.

In another aspect, the present disclosure provides kits comprising the nucleic acids, vectors, Class 2 Type V CRISPR proteins, gNAs and gene editing pairs described herein.

In another aspect, provided herein are compositions comprising gene editing pairs, or compositions of vectors comprising or encoding gene editing pairs for use as a medicament for the treatment of a subject having a RHO-related disease.

In another aspect, provided herein are Class 2 Type V CRISPR:gNA systems, compositions comprising Class 2 Type V CRISPR:gNA systems, vectors comprising or encoding Class 2 Type V CRISPR:gNA systems, VLP comprising Class 2 Type V CRISPR:gNA systems, or populations of cells edited using the Class 2 Type V CRISPR:gNA systems for use as a medicament for the treatment of a RHO-related disease.

In another aspect, provided herein are Class 2 Type V CRISPR:gNA systems, composition comprising Class 2 Type V CRISPR:gNA systems, or vectors comprising or encoding Class 2 Type V CRISPR:gNA systems, VLP comprising Class 2 Type V CRISPR:gNA systems, populations of cells edited using the Class 2 Type V CRISPR:gNA systems, for use in a method of treatment of a RHO-related disease in a subject in need thereof.

INCORPORATION BY REFERENCE

All publications, patents, and patent applications mentioned in this specification are herein incorporated by reference to the same extent as if each individual publication, patent, or patent application was specifically and individually indicated to be incorporated by reference. The contents of PCT/US2020/036505, filed on Jun. 5, 2020, and the contents of U.S. Provisional Patent Application No. 63/121,196, filed on Dec. 3, 2020, both which disclose CasX variants and gNA variants, are hereby incorporated by reference in their entireties.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 26 shows the improvement in editing efficiency of a CasX sgRNA variant of SEQ ID NO:5 versus the reference of SEQ ID NO:4 across 10 targets. When averaged across 10 targets, the editing efficiency of sgRNA SEQ ID NO:5 improved 176% compared to SEQ ID NO:4.

FIG. 41 *a-c*) to visualized retinal layers and stained with HA-tag (bottom row, FIG. 41 *d-f*) antibody to detect CasX expression in photoreceptors (ONL) and other retinal layers (INL;GCL). Legends: ONL=Outer nuclear layer; INL=Inner nuclear layer, GCL=Ganglion cell layer.

DETAILED DESCRIPTION

Figure 1:
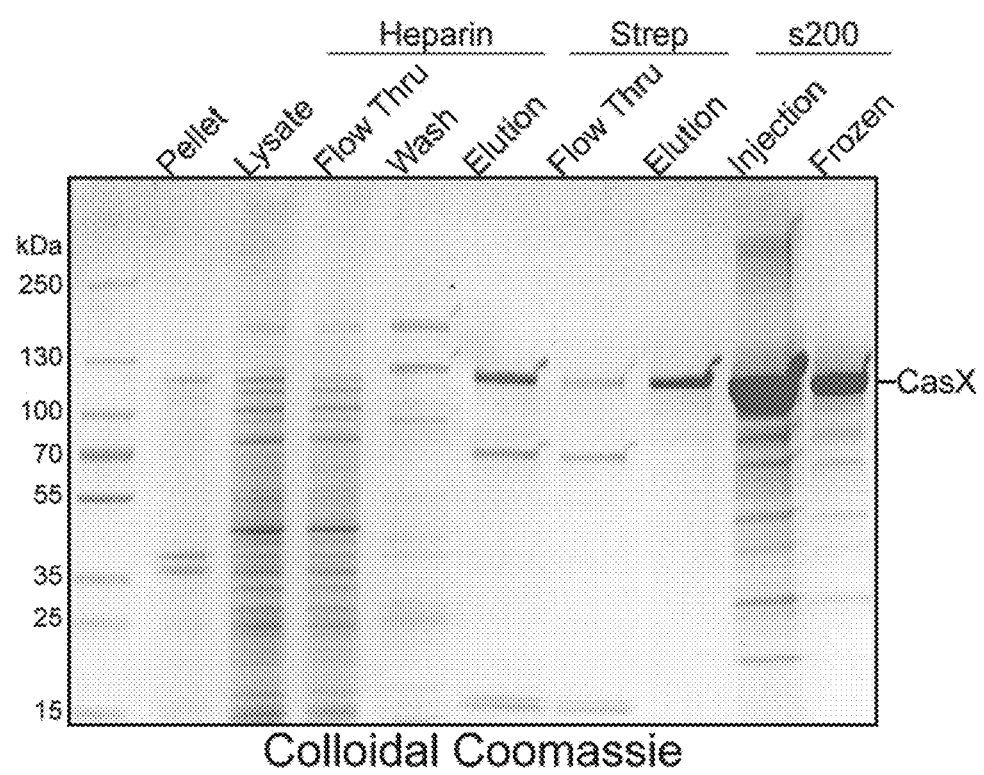
FIG. 1 shows an SDS-PAGE gel of StX2 purification fractions visualized by colloidal Coomassie staining, as described in Example 1.

While exemplary embodiments have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid sequence to be specifically hybridizable; it can have at least about 70%, at least about 80%, or at least about 90%, or at least about 95% sequence identity and still hybridize to the target nucleic acid sequence. Moreover, a polynucleotide may hybridize over one or more segments such that intervening or adjacent segments are not involved in the hybridization event (e.g., a loop structure or hairpin structure, a 'bulge', and the like).

A "gene," for the purposes of the present disclosure, includes a DNA region encoding a gene product (e.g., a protein. RNA), as well as all DNA regions which regulate the production of the gene product, whether or not such regulatory sequences are adjacent to coding and/or transcribed sequences. Accordingly, a gene may include regulatory element sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed as well as the complementary strand containing the anticodons.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "regulatory element" is used interchangeably herein with the term "regulatory sequence," and is intended to include promoters, enhancers, and other expression regulatory elements (e.g. transcription termination signals, such as polyadenylation signals and poly-U sequences). Exemplary regulatory elements include a transcription promoter such as, but not limited to, CMV. CMV+intron A, SV40, RSV, HIV-Ltr, elongation factor 1 alpha (EF1α), MMLV-ltr, internal ribosome entry site (IRES) or P2A peptide to permit translation of multiple genes from a single transcript, metallothionein, a transcription enhancer element, a transcription termination signal, polyadenylation sequences, sequences for optimization of initiation of translation, and translation termination sequences. In the case of systems utilized for exon skipping, regulatory elements include exonic splicing enhancers. It will be understood that the choice of the appropriate regulatory element will depend on the encoded component to be expressed (e.g., protein or RNA) or whether the nucleic acid comprises multiple components that require different polymerases or are not intended to be expressed as a fusion protein.

The term "promoter" refers to a DNA sequence that contains an RNA polymerase binding site, transcription start site, TATA box, and/or B recognition element and assists or promotes the transcription and expression of an associated transcribable polynucleotide sequence and/or gene (or transgene). A promoter can be synthetically produced or can be derived from a known or naturally occurring promoter sequence or another promoter sequence. A promoter can be proximal or distal to the gene to be transcribed. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive, developmental, tissue-specific, inducible, etc.

The term "enhancer" refers to regulatory DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant" polypeptide refers to a polypeptide which is not naturally occurring, e.g., is made by the artificial combination of two otherwise separated segments of amino sequence through human intervention. Thus, e.g., a polypeptide that comprises a heterologous amino acid sequence is recombinant.

As used herein, the term "contacting" means establishing a physical connection between two or more entities. For example, contacting a target nucleic acid sequence with a guide nucleic acid means that the target nucleic acid sequence and the guide nucleic acid are made to share a physical connection; e.g., can hybridize if the sequences share sequence similarity.

"Dissociation constant", or "$K_d$", are used interchangeably and mean the affinity between a ligand "L" and a protein "P", i.e., how tightly a ligand binds to a particular protein. It can be calculated using the formula $K_d$=[L][P]/[LP], where [P], [L] and [LP] represent molar concentrations of the protein, ligand and complex, respectively.

The disclosure provides compositions and methods useful for editing a target nucleic acid sequence. As used herein "editing" is used interchangeably with "modifying" and includes but is not limited to cleaving, nicking, deleting, knocking in, knocking out, and the like.

The term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant sequence. The term "knock-down" as used herein refers to reduction in the expression of a gene or its gene product(s). As a result of a gene knock-down, the protein activity or function may be attenuated or the protein levels may be reduced or eliminated.

As used herein, "homology-directed repair" (HDR) refers to the form of DNA repair that takes place during repair of double-strand breaks in cells. This process requires nucleotide sequence homology, and uses a donor template to repair or knock-out a target DNA, and leads to the transfer of genetic information from the donor to the target. Homology-directed repair can result in an alteration of the sequence of the target sequence by insertion, deletion, or mutation if the donor template differs from the target DNA sequence and part or all of the sequence of the donor template is incorporated into the target DNA.

As used herein, "non-homologous end joining" (NHEJ) refers to the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

As used herein "micro-homology mediated end joining" (MMEJ) refers to a mutagenic DSB repair mechanism, which always associates with deletions flanking the break sites without the need for a homologous template (in contrast to homology-directed repair, which requires a homologous sequence to guide repair). MMEJ often results in the loss (deletion) of nucleotide sequence near the site of the double-strand break.

A polynucleotide or polypeptide has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "polypeptide." and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an "insert", may be attached so as to bring about the replication or expression of the attached segment in a cell.

The term "naturally-occurring" or "unmodified" or "wild type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a reference amino acid sequence or to a reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., in a cell line), which eukaryotic or prokaryotic cells are used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

The term "antibody," as used herein, encompasses various antibody structures, including but not limited to monoclonal antibodies, polyclonal antibodies, multispecific antibodies (e.g., bispecific antibodies), nanobodies, single domain antibodies such as VHH antibodies, and antibody fragments so long as they exhibit the desired antigen-binding activity or immunological activity. Antibodies represent a large family of molecules that include several types of molecules, such as IgD, IgG, IgA, IgM and IgE.

As used herein, "treatment" or "treating." are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a drug or a biologic, alone or as a part of a composition, that is capable of having any detectable, beneficial effect on any symptom, aspect, measured parameter or characteristics of a disease state or condition when administered in one or repeated doses to a subject such as a human or an experimental animal. Such effect need not be absolute to be beneficial.

As used herein, "administering" is meant a method of giving a dosage of a compound (e.g., a composition of the disclosure) or a composition (e.g., a pharmaceutical composition) to a subject.

A "subject" is a mammal. Mammals include, but are not limited to, domesticated animals, non-human primates, humans, rabbits, mice, rats and other rodents.

I. General Methods

The practice of the present disclosure employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., Harbor Laboratory Press 2001); Short Protocols in Molecular Biology, 4th Ed. (Ausubel et al. eds., John Wiley & Sons 1999); Protein Methods (Bollag et al., John Wiley & Sons 19%); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included, and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the invention, which are, for clarity, described in the context of separate embodiments, may also be provided in combination in a single embodiment. In other cases, various features of the invention, which are, for brevity, described in the context of a single embodiment, may also be provided separately or in any suitable sub-combination. It is intended that all combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

II. Systems for Genetic Editing of RHO Genes

In a first aspect, the present disclosure provides systems comprising a CRISPR nuclease protein and one or more guide nucleic acids (gNA) for use in modifying a RHO gene (referred to herein as the "target nucleic acid"). The RHO gene to be modified may comprise one or more mutations, including deletions, substitutions or duplications, in the gene region selected from the group consisting of a RHO intron, a RHO exon, a RHO intron-exon junction, a RHO regulatory element, and an intergenic region. The majority of known mutations are substitutions, resulting in defects such as post-Golgi trafficking and OS targeting, misfolding, ER retention and instability, disrupted vesicular traffic and endocytosis, and altered post-translational modifications and reduced stability (Athanasiou, et al. 2018). A non-limiting list of RHO mutations contemplated for editing by the design of the editing systems of the disclosure are presented in Table 4A.

The RHO locus spans 6,706 bp and has of 5 exons. The rhodopsin protein has a molecular weight of approximately 40 kD and spans the membrane of the rod cell or the eye. Rhodopsin absorbs light as it enters the retina and becomes photoexcited, causing it to undergo a change in molecular configuration, and dissociates from the opsin, initiating a process that eventually causes electrical impulses to be sent to the brain along the optic nerve. While more than 80 mutations in the rhodopsin gene have been identified that account for 30% of all Autosomal Dominant Retinitis Pigmentosa (ADRP) cases in humans (Dryja, T P, et al. Invest Opthalmol Vis Sci 41:3124 (2000)), the P23H mutation is the most common in the United States (Olsson, et al. Neuron 9:815)(1992)). Due to problems with protein folding. Pror23His (or P23H) rhodopsin only partially reconstitutes with retinal in vitro (Liu et al. Proc Nat'l Acad Sci 93:4554 (1996)), and mutant rhodopsin expressed in transgenics causes retinal degeneration (Goto, et al. Invest Opthalmol Vis Sci 36:62 (1995)).

The RHO gene is defined as the sequence that spans chr3: 129,528,639-129,535,344 of the human genome (GRCh38.p13) (the notation refers to the chromosome 3 (chr3), starting at the 129,528,639 bp of that chromosome, and extending to the 129,535,344 bp of that chromosome). The human RHO gene (HGNC:10012; see also GenBank Accession No. NM_000539.2) has five exons and encodes a protein having the sequence (SEQ ID NO: 33)
MNGTEGPNFYVPFSNATGVVRSPFEYPQYYLAEPWQFSMLAAYMFLLIVL

GFPINFLTLYVTVQHKKLRTPLNYILLNLAVADLFMVLGGFTSTLYTSLH

GYFVFGPTGCNLEGFFATLGGEIALWSLVVLAIERYVVVCKPMSNFRFGE

NHAIMGVAFTWVMALACAAPPLAGWSRYIPEGLQCSCGIDYYTLKPEVNN

ESFVIYMFVVHFTIPMIIIFFCYGQLVFTVKEAAAQQQESATTQKAEKEV

TRMVIIMVIAFLICWVPYASVAFYIFTHQGSNFGPIFMTIPAFFAKSAAI

YNPVIYIMMNKQFRNCMLTTICCGKNPLGDDEASATVSKTETSQVAPA.

Human rhodopsin contains 348 amino acids. (Nathans J, and Hogness, D, PNAS 81:4851 (1984)). The most frequent mutation leading to retinitis pigmentosa is P23H, resulting in the sequence (SEQ ID NO: 34)
MNGTEGPNFYVPFSNATGVVRS<u>H</u>FEYPQYYLAEPWQFSMLAAYMFLLIVL

GFPINFLTLYVTVQHKKLRTPLNYILLNLAVADLFMVLGGFTSTLYTSLH

GYFVFGPTGCNLEGFFATLGGEIALWSLVVLAIERYVVVCKPMSNFRFGE

NHAIMGVAFTWVMALACAAPPLAGWSRYIPEGLQCSCGIDYYTLKPEVNN

ESFVIYMFVVHFTIPMIIIFFCYGQLVFTVKEAAAQQQESATTQKAEKEV

TRMVIIMVIAFLICWVPYASVAFYIFTHQGSNFGPIFMTIPAFFAKSAAI

YNPVIYIMMNKQFRNCMLTTICCGKNPLGDDEASATVSKTETSQVAPA.

In some embodiments, the disclosure provides systems specifically designed to modify the RHO gene in eukaryotic cells bearing one or more mutations. Generally, any portion of the RHO target nucleic acid can be targeted using the programmable compositions and methods provided herein. In some embodiments, the CRISPR nuclease is a Class 2, Type V nuclease. In some embodiments, the Class 2, Type V nuclease is selected from the group consisting of Cas12a, Cas12b, Cas12c, Cas12d (CasY), Cas12J, and CasX. In some embodiments, the disclosure provides systems comprising one or more CasX proteins and one or more guide nucleic acids (gNA) as a CasX:gNA system designed to target and edit specific locations in the RHO target nucleic acid sequence in order to correct or compensate for the one or more mutations. In other embodiments, the CasX:gNA systems of the disclosure comprise one or more CasX proteins, one or more guide nucleic acids (gNA) and one or more donor template nucleic acids comprising a nucleic acid encoding a portion of a RHO gene wherein the nucleic acid comprises a wild-type sequence, a cDNA sequence encoding a portion of a functional rhodopsin protein, a deletion, an insertion, or a mutation of one or more nucleotides in comparison to a genomic nucleic acid sequence encoding the mutant rhodopsin. The disclosure contemplates use of a donor template of sufficient length in the CasX:gNA system that may also be optimized to contain synthetic intron sequences of shortened length (relative to the genomic intron) between the exons in the donor template to ensure proper expression and processing of the RHO locus. In some embodiments, the donor polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000 nucleotides. In other embodiments, the donor polynucleotide comprises at least about 10 to about 15,000 nucleotides, or at least about 100 to about 10,000 nucleotides, or at least about 400 to about 8,000 nucleotides, or at least about 600 to about 5000 nucleotides, or at least about 1000 to about 2000 nucleotides. In some embodiments, the donor template is a single stranded DNA template or a single stranded RNA template. In other embodiments, the donor template is a double stranded DNA template.

In some embodiments, the disclosure provides gene editing pairs of a CasX and a gNA of any of the embodiments described herein that are capable of being bound together prior to their use for gene editing and, thus, are "pre-complexed" as a ribonuclear protein complex (RNP). The use of a pre-complexed RNP confers advantages in the delivery of the system components to a cell or target nucleic acid sequence for editing of the target nucleic acid sequence. In some embodiments, the functional RNP can be delivered ex vivo to a cell by electrophoresis or by chemical means. In other embodiments, the functional RNP can be delivered either ex vivo or in vivo by a vector in their functional form. The gNA can provide target specificity to the complex by including a targeting sequence (or "spacer") having a nucleotide sequence that is complementary to a sequence of the target nucleic acid sequence while the CasX protein of the pre-complexed CasX:gNA provides the site-specific activity such as cleavage or nicking of the target sequence that is guided to a target site (e.g., stabilized at a target site) within a target nucleic acid sequence by virtue of its association with the gNA. The CasX proteins and gNA components of the CasX:gNA systems and their sequences, features and functions are described more fully, below.

The CasX:gNA systems have utility in the treatment of a subject having retinitis pigmentosa. Each of the components of the CasX:gNA systems and their use in the editing of the target nucleic acids in cells is described more fully, below.

III. Guide Nucleic Acids of the Systems for Genetic Editing

In another aspect, the disclosure relates to guide nucleic acids (gNA) comprising a targeting sequence complementary to a target nucleic acid sequence of a RHO gene, wherein the gNA is capable of forming a complex with a CRISPR protein that has specificity to a protospacer adjacent motif (PAM) sequence comprising a TC motif in the complementary non-target strand, and wherein the PAM sequence is located 1 nucleotide 5' of the sequence in the non-target strand that is complementary to the target nucleic acid sequence in the target strand of the target nucleic acid. In some embodiments, the gNA is capable of forming a complex with a Class 2, Type V CRISPR nuclease. In a particular embodiment, the gNA is capable of forming a complex with a CasX nuclease.

In some embodiments, the disclosure provides gNAs utilized in the CasX:gNA systems that have utility in genome editing a RHO gene in a eukaryotic cell. The present disclosure provides specifically-designed gNAs wherein the targeting sequence (or spacer, described more fully, below) of the gNA is complementary to (and are therefore able to hybridize with) target nucleic acid sequences when used as a component of the gene editing CasX:gNA systems. Representative, but non-limiting examples of targeting sequences to the RHO target nucleic acid that can be utilized in the gNA of the embodiments are presented as SEQ ID NOs: SEQ ID NOS: 328-346, 367-376, 382-2100 and 2286-27274. In a particular embodiment, the disclosure provides the targeting sequences presented as SEQ ID NOS: 382-582, which are designed to target known mutations in the RHO gene when utilized in the CasX:gNA systems. In some embodiments, the gNA is a deoxyribonucleic acid molecule ("gDNA"); in some embodiments, the gNA is a ribonucleic acid molecule ("gRNA"); and in other embodiments, the gNA is a chimera, and comprises both DNA and RNA. As used herein, the terms gNA, gRNA, and gDNA cover naturally-occurring molecules, as well as sequence variants.

It is envisioned that in some embodiments, multiple gNAs are delivered in the methods for the modification of a target nucleic acid sequence by use of the CasX:gNA systems which is then edited by host cell repair mechanisms such as non-homologous end joining (NHEJ), homology-directed repair (HDR, which can include, for example, insertion of a donor template to replace all or a portion of the RHO exon), homology-independent targeted integration (HITI), microhomology mediated end joining (MMEJ), single strand annealing (SSA) or base excision repair (BER). For example, when an editing event is designed to delete multiple nucleotides within an exon of the RHO gene is desired, a pair of gNAs can be used in order to bind and cleave at two different sites 5' and 3' of the exon(s) bearing the mutation(s) within the RHO gene. In the context of nucleic acids, cleavage refers to the breakage of the covalent backbone of a nucleic acid molecule; either DNA or RNA, by the nuclease. Both single-stranded cleavage and double-stranded cleavage are possible, and double-stranded cleavage can occur as a result of two distinct single-stranded cleavage events. In some embodiments, small indels introduced by the CasX:gNA systems of the embodiments described herein and cellular repair systems can restore the protein reading frame of the mutant RHO gene ("reframing" strategy). When the reframing strategy is used, the cells may be contacted with a single gNA In other cases, when a deletion or a knock-down/knock-out of the RHO gene is desired, a pair of gNAs with targeting sequences to different or overlapping regions of the target nucleic acid sequence can be used in order to bind and the CasX to cleave at two different or overlapping sites within or proximal to the exon or regulatory element of the gene, which is then edited by non-homologous end joining (NHEJ), homology-directed repair (HDR, which can include, for example, insertion of a donor template to replace all or a portion of a RHO exon), homology-independent targeted integration (HITI), microhomology mediated end joining (MMEJ), single strand annealing (SSA) or base excision repair (BER).

a. Reference gNA and gNA Variants

In some embodiments, a gNA of the present disclosure comprises a wild-type sequence of a naturally-occurring gNA (a "reference gNA"). In other cases, a reference gNA of the disclosure may be subjected to one or more mutagenesis methods, such as the mutagenesis methods described herein, which may include Deep Mutational Evolution (DME), deep mutational scanning (DMS), error prone PCR, cassette mutagenesis, random mutagenesis, staggered extension PCR, gene shuffling, or domain swapping, in order to generate one or more gNA variants with enhanced or varied properties relative to the reference gNA, gNA variants also include variants comprising one or more exogenous sequences, for example fused to either the 5' or 3' end, or inserted internally. The activity of reference gNAs may be used as a benchmark against which the activity of gNA variants are compared, thereby measuring improvements in function or other characteristics of the gNA variants. In other embodiments, a reference gNA may be subjected to one or more deliberate, specifically-targeted mutations in order to produce a gNA variant, for example a rationally designed variant.

The gNAs of the disclosure comprise two segments: a targeting sequence and a protein-binding segment. The targeting segment of a gNA includes a nucleotide sequence (referred to interchangeably as a guide sequence, a spacer, a targeter, or a targeting sequence) that is complementary to (and therefore hybridizes with) a specific sequence (a target site) within the target nucleic acid sequence (e.g., a target ssRNA, a target ssDNA, a strand of a double stranded target DNA, etc.), described more fully below. The targeting sequence of a gNA is capable of binding to a target nucleic acid sequence, including a coding sequence, a complement of a coding sequence, a non-coding sequence, and to regulatory elements. The protein-binding segment (or "activator" or "protein-binding sequence") interacts with (e.g., binds to) a CasX protein as a complex, forming an RNP (described more fully, below). The protein-binding segment is alternatively referred to herein as a "scaffold", which is comprised of several regions, described more fully, below.

In the case of a dual guide RNA (dgRNA), the targeter and the activator portions each have a duplex-forming segment, where the duplex forming segment of the targeter and the duplex-forming segment of the activator have complementarity with one another and hybridize to one another to form a double stranded duplex (dsRNA duplex for a gRNA). When the gNA is a gRNA, the term "targeter" or "targeter RNA" is used herein to refer to a crRNA-like molecule (crRNA: "CRISPR RNA") of a CasX dual guide RNA (and therefore of a CasX single guide RNA when the "activator" and the "targeter" are linked together; e.g., by intervening nucleotides). The crRNA has a 5' region that anneals with the tracrRNA followed by the nucleotides of the targeting sequence. Thus, for example, a guide RNA (dgRNA or sgRNA) comprises a guide sequence and a duplex-forming segment of a crRNA, which can also be referred to as a crRNA repeat. A corresponding tracrRNA-like molecule (activator) also comprises a duplex-forming stretch of nucleotides that forms the other half of the dsRNA duplex of the protein-binding segment of the guide RNA. Thus, a targeter and an activator, as a corresponding pair, hybridize to form a dual guide NA, referred to herein as a "dual guide NA", a "dual-molecule gNA", a "dgNA", a "double-molecule guide NA", or a "two-molecule guide NA". Site-specific binding and/or cleavage of a target nucleic acid sequence (e.g., genomic DNA) by the CasX protein can occur at one or more locations (e.g., a sequence of a target nucleic acid) determined by base-pairing complementarity between the targeting sequence of the gNA and the target nucleic acid sequence. Thus, for example, the gNA of the disclosure have sequences complementarity to and therefore can hybridize with the target nucleic acid that is adjacent to a sequence complementary to a TC PAM motif or a PAM sequence, such as ATC, CTC, GTC, or TTC. Because the targeting sequence of a guide sequence hybridizes with a sequence of a target nucleic acid sequence, a targeter can be modified by a user to hybridize with a specific target nucleic acid sequence, so long as the location of the PAM sequence is considered. Thus, in some cases, the sequence of a targeter may be a non-naturally occurring sequence. In other cases, the sequence of a targeter may be a naturally-occurring sequence, derived from the gene to be edited. In other embodiments, the activator and targeter of the gNA are covalently linked to one another (rather than hybridizing to one another) and comprise a single molecule, referred to herein as a "single-molecule gNA," "one-molecule guide NA," "single guide NA", "single guide RNA", a "single-molecule guide RNA," a "one-molecule guide RNA", a "single guide DNA", a "single-molecule DNA", or a "one-molecule guide DNA", ("sgNA", "sgRNA", or a "sgDNA"). In some embodiments, the sgNA includes an "activator" or a "targeter" and thus can be an "activator-RNA" and a "targeter-RNA," respectively.

Collectively, the assembled gNAs of the disclosure comprise four distinct regions, or domains: the RNA triplex, the scaffold stem, the extended stem, and the targeting sequence that, in the embodiments of the disclosure is specific for a target nucleic acid and is located on the 3'end of the gNA. The RNA triplex, the scaffold stem, and the extended stem, together, are referred to as the "scaffold" of the gNA.

b. RNA Triplex

In some embodiments of the guide NAs provided herein (including reference sgNAs), there is a RNA-triplex, and the RNA triplex comprises the sequence of a UUU--nX(~4-15)--UUU stem loop (SEQ ID NO: 19) that ends with an AAAG after 2 intervening stem loops (the scaffold stem loop and the extended stem loop), forming a pseudoknot that may also extend past the triplex into a duplex pseudoknot. The UU-UUU-AAA sequence of the triplex forms as a nexus between the spacer, scaffold stem, and extended stem. In exemplary reference CasX sgNAs, the UUU-loop-UUU region is coded for first, then the scaffold stem loop, and then the extended stem loop, which is linked by the tetraloop, and then an AAAG closes off the triplex before becoming the spacer.

c. Scaffold Stem Loop

In some embodiments of sgNAs of the disclosure, the triplex region is followed by the scaffold stem loop. The scaffold stem loop is a region of the gNA that is bound by CasX protein (such as a reference or CasX variant protein). In some embodiments, the scaffold stem loop is a fairly short and stable stem loop. In some cases, the scaffold stem loop does not tolerate many changes, and requires some form of an RNA bubble. In some embodiments, the scaffold stem is necessary for CasX sgNA function. While it is perhaps analogous to the nexus stem of Cas9 as being a critical stem loop, the scaffold stem of a CasX sgNA, in some embodiments, has a necessary bulge (RNA bubble) that is different from many other stem loops found in CRISPR/Cas systems. In some embodiments, the presence of this bulge is conserved across sgNA that interact with different CasX proteins. An exemplary sequence of a scaffold stem loop sequence of a gNA comprises the sequence CCAGCGAC-UAUGUCGUAUGG (SEQ ID NO: 20). In other embodiments, the disclosure provides gNA variants wherein the scaffold stem loop is replaced with an RNA stem loop sequence from a heterologous RNA source with proximal 5' and 3' ends, such as, but not limited to stem loop sequences selected from MS2, Q β, U1 hairpin II, Uvsx, or PP7 stem loops. In some cases, the heterologous RNA stem loop of the gNA is capable of binding a protein, an RNA structure, a DNA sequence, or a small molecule.

d. Extended Stem Loop

In some embodiments of the CasX sgNAs of the disclosure, the scaffold stem loop is followed by the extended stem loop. In some embodiments, the extended stem comprises a synthetic tracr and crRNA fusion that is largely unbound by the CasX protein. In some embodiments, the extended stem loop can be highly malleable. In some embodiments, a single guide gRNA is made with a GAAA tetraloop linker or a GAGAAA linker between the tracr and crRNA in the extended stem loop. In some cases, the targeter and activator of a CasX sgNA are linked to one another by intervening nucleotides and the linker can have a length of from 3 to 20 nucleotides. In some embodiments of the CasX sgNAs of the disclosure, the extended stem is a large 32-bp loop that sits outside of the CasX protein in the ribonucleoprotein complex. An exemplary sequence of an extended stem loop sequence of a sgNA comprises the sequence GCGC-UUAUUUAUCG-GAGAGAAAUCCGAUAAAUAAGAAGC (SEQ ID NO: 21). In some embodiments, the extended stem loop comprises a GAGAAA spacer sequence. In some embodiments, the disclosure provides gNA variants wherein the extended stem loop is replaced with an RNA stem loop sequence from a heterologous RNA source with proximal 5' and 3' ends, such as, but not limited to stem loop sequences selected from MS2, Qβ, U1 hairpin II, Uvsx, or PP7 stem loops. In such cases, the heterologous RNA stem loop increases the stability of the gNA In other embodiments, the disclosure provides gNA variants having an extended stem loop region comprising at least 10, at least 100, at least 500, at least 1000, or at least 10,000 nucleotides, or at least 10-10,000, at least 10-1000, or at least 10-100 nucleotides.

e. Targeting Sequence

In some embodiments of the gNAs of the disclosure, the extended stem loop is followed by a region that forms part of the triplex, and then the targeting sequence (or "spacer") at the 3' end of the gNA. The targeting sequence targets the CasX ribonucleoprotein holo complex to a specific region of the target nucleic acid sequence of the gene to be modified. Thus, for example, gNA targeting sequences of the disclosure have sequences complementarity to, and therefore can hybridize to, a portion of the RHO gene in a nucleic acid in a eukaryotic cell (e.g., a eukaryotic chromosome, chromosomal sequence, a eukaryotic RNA, etc.) as a component of the RNP when the TC PAM motif or any one of the PAM sequences TTC, ATC, GTC, or CTC is located 1 nucleotide 5' to the non-target strand sequence complementary to the target sequence. The targeting sequence of a gNA can be modified so that the gNA can target a desired sequence of any desired target nucleic acid sequence, so long as the PAM sequence location is taken into consideration. In some embodiments, the gNA scaffold is 5' of the targeting sequence, with the targeting sequence on the 3' end of the gNA. In some embodiments, the PAM motif sequence recognized by the nuclease of the RNP is TC. In other embodiments, the PAM sequence recognized by the nuclease of the RNP is NTC.

In some embodiments, the targeting sequence of the gNA is complementary to a portion of a gene encoding a rhodopsin protein. In some embodiments, the targeting sequence of a gNA is complementary to a RHO exon selected from the group consisting of exons 1-5. In one embodiment, the targeting sequence of a gNA is complementary to RHO exon 1. In another embodiment, the targeting sequence of a gNA is complementary to RHO exon 2. In another embodiment, the targeting sequence of a gNA is complementary to RHO exon 3. In another embodiment, the targeting sequence of a gNA is complementary to RHO exon 4. In another embodiment, the targeting sequence of a gNA is complementary to RHO exon 5. In other embodiments, the targeting sequence of the gNA is complementary to a region within or proximal to an exon comprising a duplication. In other embodiments, the targeting sequence of a gNA is specific for a RHO intronic region, an intron-exon junction of the RHO gene, or an intergenic region. In some embodiments, the targeting sequence of the gNA is complementary to a sequence comprising one or more single nucleotide polymorphisms (SNPs) of the RHO gene or its complement. SNPs that are within a RHO coding sequence or within a RHO non-coding sequence are both within the scope of the instant disclosure. In some embodiments, the targeting sequence of the gNA is complementary to a sequence encoding or proximal to a mutation presented in Table 4A. In some embodiments, the targeting sequence of the gNA is complementary to a region within or proximal to (e.g., within 40 nucleotides of) an exon comprising a deletion. Representative targeting sequences to RHO mutations known or believed to be associated with retinitis pigmentosa that can be used in the editing systems of the disclosure are presented as SEQ ID NOS: 382-582.

In other embodiments, the targeting sequence of a gNA is specific for a junction of the exon, an intron, and/or a regulatory element of the gene. In those cases where the targeting sequence is specific for a regulatory element, such regulatory elements include, but are not limited to promoter regions, enhancer regions, intergenic regions, 5' untranslated regions (5' UTR), 3' untranslated regions (3' UTR), conserved elements, and regions comprising cis-regulatory elements. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the gene of the target nucleic acid. In the foregoing, the targets are those in which the encoding gene of the target is intended to be knocked out or knocked down such that the targeted protein is not expressed or is expressed at a lower level in a cell.

In some embodiments, the targeting sequence of the gNA has between 14 and 35 consecutive nucleotides. In some embodiments, the targeting sequence has 14, 15, 16, 18, 18, 19, 20, 21, 22, 23 24, 25, 26, 27, 28, 29, 30, 31, 32, 33, 34 or 35 consecutive nucleotides. In some embodiments, the targeting sequence consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 consecutive nucleotides. In some embodiments, the targeting sequence consists of 15 consecutive nucleotides. In some embodiments, the targeting sequence has 14, 15, 16, 17, 18, 19, 20, 21, 22, 23, 24, 25, 26, 27, 28, 29, 30, 31, 32, 33, 34 or 35 consecutive nucleotides and the targeting sequence can comprise 0 to 5, 0 to 4, 0 to 3, or 0 to 2 mismatches relative to the target nucleic acid sequence and retain sufficient binding specificity such that the RNP comprising the gNA comprising the targeting sequence can form a complementary bond with respect to the target nucleic acid.

Representative, but non-limiting examples of targeting sequences for inclusion in the gNA of the disclosure utilized with the CasX:gNA system for editing of the RHO gene are presented as SEQ ID NOs: 328-346, 367-376, 382-2100 and 2286-27274, representing targeting sequences for targeting a RHO target nucleic acid. In one embodiment, the targeting sequence of the gNA comprises a sequence having at least about 65%, at least about 75%, at least about 85%, or at least about 95% identity to a sequence selected from the group consisting of SEQ ID NOs: 328-346, 367-376, 382-2100 and 2286-27274. In one embodiment, the targeting sequence of the gNA comprises a sequence having at least about 65%, at least about 75%, at least about 85%, or at least about 95% identity to a sequence selected from the group consisting of SEQ ID NOs: 382-582. In another embodiment, the targeting sequence of the gNA consists of a sequence selected from the group consisting of SEQ ID NOs: 328-346, 367-376, 382-2100 and 2286-27274. In another embodiment, the targeting sequence of the gNA consists of a sequence selected from the group consisting of SEQ ID NOs: 382-582. In the foregoing embodiments, thymine (T) nucleotides can be substituted for one or more or all of the uracil (U) nucleotides in any of the targeting sequences such that the gNA can be a gDNA or a gRNA, or a chimera of RNA and DNA. In some embodiments, a targeting sequence of SEQ ID NOs: 328-346, 367-376, 382-2100 and 2286-27274 has at least 1, 2, 3, 4, 5, or 6 or more thymine nucleotides substituted for uracil nucleotides. In other embodiments, a gNA, gRNA, or gDNA of the disclosure comprises 1, 2, 3 or more targeting sequences of SEQ ID NOs: 328-346, 367-376, 382-2100 and 2286-27274, or targeting sequences that are at least 50% identical, at least 55% identical, at least 60% identical, at least 65% identical, at least 70% identical, at least 75% identical, at least 80% identical, at least 85% identical, at least 90% identical, at least 95% identical to one or more sequences of SEQ ID NOs: 328-346, 367-376, 382-2100 and 2286-27274. In some embodiments, a targeting sequence of SEQ ID NOs: 328-582 has at least 1, 2, 3, 4, 5, or 6 or more thymine nucleotides substituted for uracil nucleotides. In other embodiments, a gNA, gRNA, or gDNA of the disclosure comprises 1, 2, 3 or more targeting sequences of SEQ ID NOs: 328-582, or targeting sequences that are at least 50% identical, at least 55% identical, at least 60% identical, at least 65% identical, at least 70% identical, at least 75% identical, at least 80% identical, at least 85% identical, at least 90% identical, at least 95% identical to one or more sequences of SEQ ID NOs: 328-582.

In some embodiments, the CasX:gNA system comprises a first gNA and further comprises a second (and optionally a third, fourth, fifth, or more) gNA, wherein the second gNA or additional gNA has a targeting sequence complementary to a different or overlapping portion of the target nucleic acid sequence compared to the targeting sequence of the first gNA such that multiple points in the target nucleic acid are targeted, and, for example, multiple breaks are introduced in the target nucleic acid by the CasX. It will be understood that in such cases, the second or additional gNA is complexed with an additional copy of the CasX protein. By selection of the targeting sequences of the gNA, defined regions of the target nucleic acid sequence bracketing a particular location within the target nucleic acid can be modified or edited using the CasX:gNA systems described herein, including facilitating the insertion of a donor template or excision of a region or exon comprising a mutation of the RHO gene.

f. gNA Scaffolds

In some embodiments, a CasX reference gRNA comprises a sequence isolated or derived from Deltaproteobacter. In some embodiments, the sequence is a CasX tracrRNA sequence. Exemplary CasX reference tracrRNA sequences isolated or derived from Deltaproteobacter may include:

(SEQ ID NO: 22)
ACAUCUGGCGCGUUUAUUCCAUUACUUUGGAGCCAGUCCCAGCGACUAUG

UCGUAUGGACGAAGCGCUUAUUUAUCGAGA and (SEQ ID NO: 23)
ACAUCUGGCGCGUUUAUUCCAUUACUUUGGAGCCAGUCCCAGCGACUAUG

UCGUAUGGACGAAGCGCUUAUUUAUCGG.

Exemplary crRNA sequences isolated or derived from Deltaproteobacter may comprise a sequence of CCGAUAAGUAAAACGCAUCAAAG (SEQ ID NO: 24). In some embodiments, a CasX reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from Deltaproteobacter.

In some embodiments, a CasX reference guide RNA comprises a sequence isolated or derived from Planctomycetes. In some embodiments, the sequence is a CasX tracrRNA sequence. Exemplary CasX reference tracrRNA sequences isolated or derived from Planctomycetes may include:

(SEQ ID NO: 25)
UACUGGCGCUUUUAUCUCAUUACUUUGAGAGCCAUCACCAGCGACUAUGU

CGUAUGGGUAAAGCGCUUAUUUAUCGGAGA and (SEQ ID NO: 26)
UACUGGCGCUUUUAUCUCAUUACUUUGAGAGCCAUCACCAGCGACUAUGU

CGUAUGGGUAAAGCGCUUAUUUAUCGG.

Exemplary crRNA sequences isolated or derived from Planctomycetes may comprise a sequence of UCUCCGAUAAAUAAGAAGCAUCAAAG (SEQ ID NO: 27). In some embodiments, a CasX reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 980% identical, at least 99% identical, at least 99.5% identical or 100% identical to a sequence isolated or derived from Planctomycetes.

In some embodiments, a CasX reference gNA comprises a sequence isolated or derived from Candidatus Sungbacteria. In some embodiments, the sequence is a CasX tracrRNA sequence. Exemplary CasX reference tracrRNA sequences isolated or derived from Candidatus Sungbacteria may comprise sequences of: GUUUACACACUCCCUCUCAUAGGGU (SEQ ID NO: 28), GUUUACACACUCCCUCUCAUGAGGU (SEQ ID NO: 29), UUUUACAUACCCCCUCUCAUGGGAU (SEQ ID NO: 30) and GUUUACACACUCCCUCUCAUGGGGG (SEQ ID NO: 31). In some embodiments, a CasX reference guide RNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from Candidatus Sungbacteria.

Table 1 provides the sequences of reference gRNAs tracr and scaffold sequences. In some embodiments, the disclosure provides gNA sequences wherein the gNA has a scaffold comprising a sequence having at least one nucleotide modification relative to a reference gNA sequence having a sequence of any one of SEQ ID NOS:4-16 of Table 1. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein, including the sequences of Table 1 and Table 2.

TABLE 1

Reference gRNA sequences

| SEQ ID NO. | Nucleotide Sequence |
|---|---|
| 4 | ACAUCUGGCGCGUUUAUUCCAUUACUUUGGAGCCAGUCCCAGCG ACUAUGUCGUAUGGACGAAGCGCUUAUUUAUCGGAGAGAAACCG AUAAGUAAAACGCAUCAAAG |
| 5 | UACUGGCGCUUUUAUCUCAUUACUUUGAGAGCCAUCACCAGCGA CUAUGUCGUAUGGGUAAAGCGCUUAUUUAUCGGAGAGAAAUCCG AUAAAUAAGAAGCAUCAAAG |
| 6 | ACAUCUGGCGCGUUUAUUCCAUUACUUUGGAGCCAGUCCCAGCG ACUAUGUCGUAUGGACGAAGCGCUUAUUUAUCGGAGA |
| 7 | ACAUCUGGCGCGUUUAUUCCAUUACUUUGGAGCCAGUCCCAGCG ACUAUGUCGUAUGGACGAAGCGCUUAUUUAUCGG |
| 8 | UACUGGCGCUUUUAUCUCAUUACUUUGAGAGCCAUCACCAGCGA CUAUGUCGUAUGGGUAAAGCGCUUAUUUAUCGGAGA |

TABLE 1-continued

Reference gRNA sequences

| SEQ ID NO. | Nucleotide Sequence |
|---|---|
| 9 | UACUGGCGCUUUUAUCUCAUUACUUUGAGAGCCAUCACCAGCGACUAUGUCGUAUGGGUAAAGCGCUUAUUUAUCGG |
| 10 | GUUUACACACUCCCUCUCAUAGGGU |
| 11 | GUUUACACACUCCCUCUCAUGAGGU |
| 12 | UUUUACAUACCCCCUCUCAUGGGAU |
| 13 | GUUUACACACUCCCUCUCAUGGGGG |
| 14 | CCAGCGACUAUGUCGUAUGG |
| 15 | GCGCUUAUUUAUCGGAGAGAAAUCCGAUAAAUAAGAAGC |
| 16 | GGCGCUUUUAUCUCAUUACUUUGAGAGCCAUCACCAGCGACUAUGUCGUAUGGGUAAAGCGCUUAUUUAUCGGA | g. gNA Variants

In another aspect, the disclosure relates to guide nucleic acid variants (referred to herein alternatively as "gNA variant" or "gRNA variant"), which comprise one or more modifications relative to a reference gRNA scaffold. As used herein, "scaffold" refers to all parts to the gNA necessary for gNA function with the exception of the spacer sequence.

In some embodiments, a gNA variant comprises one or more nucleotide substitutions, insertions, deletions, or swapped or replaced regions relative to a reference gRNA sequence of the disclosure. In some embodiments, a mutation can occur in any region of a reference gRNA to produce a gNA variant. In some embodiments, the scaffold of the gNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO:4 or SEQ ID NO:5.

In some embodiments, a gNA variant comprises one or more nucleotide changes within one or more regions of the reference gRNA that improve a characteristic of the reference gRNA. Exemplary regions include the RNA triplex, the pseudoknot, the scaffold stem loop, and the extended stem loop. In some cases, the variant scaffold stem further comprises a bubble. In other cases, the variant scaffold further comprises a triplex loop region. In still other cases, the variant scaffold further comprises a 5' unstructured region. In one embodiment, the gNA variant scaffold comprises a scaffold stem loop having at least 60% sequence identity to SEQ ID NO:14. In another embodiment, the gNA variant comprises a scaffold stem loop having the sequence of CCAGCGACUAUGUCCUAGUGG (SEQ ID NO: 32). In another embodiment, the disclosure provides a gNA scaffold comprising, relative to SEQ ID NO:5, a C18G substitution, a G55 insertion, a U1 deletion, and a modified extended stem loop in which the original 6 nt loop and 13 most-loop-proximal base pairs (32 nucleotides total) are replaced by a Uvsx hairpin (4 nt loop and 5 loop-proximal base pairs; 14 nucleotides total) and the loop-distal base of the extended stem was converted to a fully base-paired stem contiguous with the new Uvsx hairpin by deletion of the A99 and substitution of G64U. In the foregoing embodiment, the gNA scaffold comprises the sequence (SEQ ID NO: 2238)
ACUGGCGCUUUUAUCUGAUUACUUUGAGAGCCAUCACCAGCGACUAUGUC

GUAGUGGGUAAAGCUCCCUCUUCGGAGGGAGCAUCAAAG.

All gNA variants that have one or more improved functions or characteristics, or add one or more new functions when the variant gNA is compared to a reference gRNA described herein, are envisaged as within the scope of the disclosure. A representative example of such a gNA variant is guide 174 (SEQ ID NO:2238), the design of which is described in the Examples. In some embodiments, the gNA variant adds a new function to the RNP comprising the gNA variant. In some embodiments, the gNA variant has an improved characteristic selected from: improved stability; improved solubility; improved transcription of the gNA; improved resistance to nuclease activity; increased folding rate of the gNA; decreased side product formation during folding; increased productive folding; improved binding affinity to a CasX protein; improved binding affinity to a target DNA when complexed with a CasX protein; improved gene editing when complexed with a CasX protein; improved specificity of editing when complexed with a CasX protein; and improved ability to utilize a greater spectrum of one or more PAM sequences, including ATC, CTC, GTC, or TTC, in the editing of target DNA when complexed with a CasX protein, or any combination thereof. In some cases, the one or more of the improved characteristics of the gNA variant is at least about 1.1 to about 100,000-fold improved relative to the reference gNA of SEQ ID NO:4 or SEQ ID NO:5. In other cases, the one or more improved characteristics of the gNA variant is at least about 1.1, at least about 10, at least about 100, at least about 1000, at least about 10,000, at least about 100,000-fold or more improved relative to the reference gNA of SEQ ID NO:4 or SEQ ID NO:5. In other cases, the one or more of the improved characteristics of the gNA variant is about 1.1 to 100,000-fold, about 1.1 to 10,000-fold, about 1.1 to 1,000-fold, about 1.1 to 500-fold, about 1.1 to 100-fold, about 1.1 to 50-fold, about 1.1 to 20-fold, about 10 to 100,000-fold, about 10 to 10,000-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,000-fold, about 100 to 10,000-fold, about 100 to 1,000-fold, about 100 to 500-fold, about 500 to 100,000-fold, about 500 to 10,000-fold, about 500 to 1,000-fold, about 500 to 750-fold, about 1,000 to 100,000-fold, about 10,000 to 100,000-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference gNA of SEQ ID NO:4 or SEQ ID NO:5. In other cases, the one or more improved characteristics of the gNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475- fold, or 5(K)-fold improved relative to the reference gNA of SEQ ID NO:4 or SEQ ID NO:5.

In some embodiments, a gNA variant can be created by subjecting a reference gRNA to a one or more mutagenesis methods, such as the mutagenesis methods described herein, below, which may include Deep Mutational Evolution (DME), deep mutational scanning (DMS), error prone PCR, cassette mutagenesis, random mutagenesis, staggered extension PCR, gene shuffling, or domain swapping, in order to generate the gNA variants of the disclosure. The activity of reference gRNAs may be used as a benchmark against which the activity of gNA variants are compared, thereby measuring improvements in function of gNA variants. In other embodiments, a reference gRNA may be subjected to one or more deliberate, targeted mutations, substitutions, or domain swaps in order to produce a gNA variant, for example a rationally designed variant. Exemplary gRNA variants produced by such methods are described in the Examples and representative sequences of gNA scaffolds are presented in Table 2 as SEQ ID NOS: 2101-2285.

In some embodiments, the gNA variant comprises one or more modifications compared to a reference guide nucleic acid scaffold sequence, wherein the one or more modification is selected from: at least one nucleotide substitution in a region of the gNA variant; at least one nucleotide deletion in a region of the gNA variant; at least one nucleotide insertion in a region of the gNA variant; a substitution of all or a portion of a region of the gNA variant; a deletion of all or a portion of a region of the gNA variant; or any combination of the foregoing. In some cases, the modification is a substitution of 1 to 15 consecutive or non-consecutive nucleotides in the gNA variant in one or more regions. In other cases, the modification is a deletion of 1 to 10 consecutive or non-consecutive nucleotides in the gNA variant in one or more regions. In other cases, the modification is an insertion of 1 to 10 consecutive or non-consecutive nucleotides in the gNA variant in one or more regions. In other cases, the modification is a substitution of the scaffold stem loop or the extended stem loop with an RNA stem loop sequence from a heterologous RNA source with proximal 5' and 3' ends. In some cases, a gNA variant of the disclosure comprises two or more modifications in one region. In other cases, a gNA variant of the disclosure comprises modifications in two or more regions. In other cases, a gNA variant comprises any combination of the foregoing modifications described in this paragraph.

In some embodiments, a 5' G is added to a gNA variant sequence for expression in vivo, as transcription from a U6 promoter is more efficient and more consistent with regard to the start site when the +1 nucleotide is a G. In other embodiments, two 5' Gs are added to a gNA variant sequence for in vitro transcription to increase production efficiency, as T7 polymerase strongly prefers a G in the +1 position and a purine in the +2 position. In some cases, the 5' G bases are added to the reference scaffolds SEQ ID NOS: 4-16 as set forth in Table 1. In other cases, the 5' G bases are added to the variant scaffolds of SEQ ID NOS: 2101-2285 as set forth in Table 2.

Table 2 provides exemplary gNA variant scaffold sequences. In Table 2, (−) indicates a deletion at the specified position(s) relative to the reference sequence of SEQ ID NO:5, (+) indicates an insertion of the specified base(s) at the position indicated relative to SEQ ID NO:5, (:) indicates the range of bases at the specified start:stop coordinates of a deletion or substitution relative to SEQ ID NO:5, and multiple insertions, deletions or substitutions are separated by commas; e.g., A14C, U17G. In some embodiments, the gNA variant scaffold comprises any one of the sequences listed in Table 2, SEQ ID NOS:2101-2285, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein.

TABLE 2

Exemplary gNA Scaffold Sequences

| SEQ ID NO: | NAME or Modification | NUCLEOTIDE SEQUENCE |
|---|---|---|
| 2101 | phage replication stable | UACUGGCGCUUUUAUCUCAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2102 | Kissing loop_b1 | UACUGGCGCUUUUAUCUCAUUACUUUGAGAGCCAUCACCAGCGACUAUGUCGUAUG GGUAAAGCGCUGCUCGACGCGUCCUCGAGCAGAAGCAUCAAAG |
| 2103 | Kissing loop_a | UACUGGCGCUUUUAUCUCAUUACUUUGAGAGCCAUCACCAGCGACUAUGUCGUAUG GGUAAAGCGCUGCUCGCUCCGUUCGAGCAGAAGCAUCAAAG |
| 2104 | 32: uvsX hairpin | GUACUGGCGCUUUUAUCUCAUUACUUUGAGAGCCAUCACCAGCGACUAUGUCGUAU GGGUAAAGCGCCCUCUUCGGAGGGAAGCAUCAAAG |
| 2105 | PP7 | UACUGGCGCUUUUAUCUCAUUACUUUGAGAGCCAUCACCAGCGACUAUGUCGUAUG GGUAAAGCGCAGGAGUUUCUAUGGAAACCCUGAAGCAUCAAAG |
| 2106 | 64: trip mut, extended stem truncation | GUACUGGCGCUUUUAUCUCAUUACUUUGAGAGCCAUCACCAGCGACUAUGUCGUAU GGGUAAAGCGCUUACGGACUUCGGUCCGUAAGAAGCAUCAAAG |
| 2107 | hyperstable tetraloop | UACUGGCGCUUUUAUCUCAUUACUUUGAGAGCCAUCACCAGCGACUAUGUCGUAUG GGUAAAGCGCUGCGCUUGCGCAGAAGCAUCAAAG |
| 2108 | C18G | UACUGGCGCUUUUAUCUGAUUACUUUGAGAGCCAUCACCAGCGACUAUGUCGUAUG GGUAAAGCGCUUAUUUAUCGGAGAGAAAUCCGAUAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2109 | U17G | UACUGGCGCUUUUAUCGCAUUACUUUGAGAGCCAUCACCAGCGACUAUGUCGUAUG<br>GGUAAAGCGCUUAUUUAUCGGAGAGAAAUCCGAUAAAUAAGAAGCAUCAAAG |
| 2110 | CUUCGG loop | UACUGGCGCUUUUAUCUCAUUACUUUGAGAGCCAUCACCAGCGACUAUCUCGUAUG<br>GGUAAAGCGCUUAUUUAUCGGAGACUUCGGUCCGAUAAAUAAGAAGCAUCAAAG |
| 2111 | MS2 | UACUGGCGCUUUUAUCUCAUUACUUUGAGAGCCAUCACCAGCGACUAUGUCGUAUG<br>GGUAAAGCGCACAUGAGGAUUACCCAUGUGAAGCAUCAAAG |
| 2112 | -1, A2G, -78, G77U | GCUGGCGCUUUUAUCUCAUUACUUUGAGAGCCAUCACCAGCGACUAUGUCGUAUGG<br>GUAAAGCGCUUAUUUAUCGUGAGAAAUCCGAUAAAUAAGAAGCAUCAAAG |
| 2113 | QB | UACUGGCGCUUUUAUCUCAUUACUUUGAGAGCCAUCACCAGCGACUAUGUCGUAUG<br>GGUAAAGCGCUGCAUGUCUAAGACAGCAGAAGCAUCAAAG |
| 2114 | 45, 44 hairpin | UACUGGCGCUUUUAUCUCAUUACUUUGAGAGCCAUCACCAGCGACUAUGUCGUAUG<br>GGUAAAGCGCAGGGCUUCGGCCGAAGCAUCAAAG |
| 2115 | U1A | UACUGGCGCUUUUAUCUCAUUACUUUGAGAGCCAUCACCAGCGACUAUGUCGUAUG<br>GGUAAAGCGCAAUCCAUUGCACUCCGGAUUGAAGCAUCAAAG |
| 2116 | A14C, U17G | UACUGGCGCUUUUCUCGCAUUACUUUGAGAGCCAUCACCAGCGACUAUGUCGUAUG<br>GGUAAAGCGCUUAUUUAUCGGAGAGAAAUCCGAUAAAUAAGAAGCAUCAAAG |
| 2117 | CUUCGG loop modified | UACUGGCGCUUUUAUCUCAUUACUUUGAGAGCCAUCACCAGCGACUAUGUCGUAUG<br>GGUAAAGCGCUUAUUUAUCGGACUUCGGUCCGAUAAAVAAGAAGCAUCAAAG |
| 2118 | Kissing loop_b2 | UACUGGCGCUUUUAUCUCAUUACUUUGAGAGCCAUCACCAGCGACUAUCUCGUAUG<br>GGUAAAGCGCUGCUCGUUUGCGGCUACGAGCAGAAGCAUCAAAG |
| 2119 | -76:78, -83:87 | UACUGGCGCUUUUAUCUCAUUACUUUGAGAGCCAUCACCAGCGACUAUGUCGUAUG<br>GGUAAAGCGCUUAUUUAUCGAGAGAUAAAUAAGAAGCAUCAAAG |
| 2120 | -4 | UACGGCGCUUUUAUCUCAUUACUUUGAGAGCCAUCACCAGCGACUAUGUCGUAUGG<br>GUAAAGCGCUUAUUUAUCGGAGAGAAAUCCGAUAAAUAAGAAGCAUCAAAG |
| 2121 | extended stem truncation | UACUGGCGCCUUUUAUCUCAUUACUUUGAGAGCCAUCACCAGCGACUAUGUCGUAU<br>GGGUAAAGCGCUUACGGACUUCGGUCCGUAAGAAGCAUCAAAG |
| 2122 | C55 | UACUGGCGCUUUUAUCUCAUUACUUUGAGAGCCAUCACCAGCGACUAUGUCGUAUC<br>GGUAAAGCGCUUAUUUAUCGGAGAGAAAUCCGAUAAAVAAGAAGCAUCAAAG |
| 2123 | trip mut | UACUGGCGCCUUUAUCUCAUUACUUUGAGAGCCAUCACCAGCGACUAUGUCGUAUG<br>GGUAAAGCGCUUAUUUAUCGGACUUCGGUCCGAUAAAUAAGAAGCAUCAAAG |
| 2124 | -76:78 | UACUGGCGCUUUUAUCUCAUUACUUUGAGAGCCAUCACCAGCGACUAUGUCGUAUG<br>GGUAAAGCGCUUAUUUAUCGAGAAAUCCGAUAAAUAAGAAGCAUCAAAG |
| 2125 | -1:5 | GCGCUUUUAUCUCAUUACUUUGAGAGCCAUCACCAGCGACUAUGUCGUAUGGGUAA<br>AGCGCUUAUUUAUCGGAGAGAAAUCCGAUAAAUAAGAAGCAUCAAAG |
| 2126 | -83:87 | UACUGGCGCUUUUAUCUCAUUACUUUGAGAGCCAUCACCAGCGACUAUGUCGUAUG<br>GGUAAAGCGCUUAUUUAUCGGAGAGAGAUAAAUAAGAAGCAUCAAAG |
| 2127 | =+G28, A82U, -84, | UACUGGCGCUUUUAUCUCAUUACUUUGGAGAGCCAUCACCAGCGACUAUGUCGUAU<br>GGGUAAAGCGCUUAUUUAUCGGAGAGUAUCCGAUAAAUAAGAAGCAUCAAAG |
| 2128 | =+51U | UACUGGCGCUUUUAUCUCAUUACUUUGAGAGCCAUCACCAGCGACUAUGUUCGUAU<br>GGGUAAAGCGCUUAUUUAUCGGAGAGAAAUCCGAUAAAUAAGAAGCAUCAAAG |
| 2129 | -1:4, +G5A, +G86, | AGCGCUUUUAUCUCAUUACUUUGAGAGCCAUCACCAGCGACUAUGUCGUAUGGGUA<br>AAGCGCUUAUUUAUCGGAGAGAAAUGCCGAUAAAUAAGAAGCAUCAAAG |
| 2130 | =+A94 | UACUGGCGCUUUUAUCUCAUUACUUUGAGAGCCAUCACCAGCGACUAUGUCGUAUG<br>GGUAAAGCGCUUAUUUAUCGGAGAGAAAUCCGAUAAAUAAGAAGCAUCAAAG |
| 2131 | =+G72 | UACUGGCGCUUUUAUCUCAUUACUUUGAGAGCCAUCACCAGCGACUAUGUCGUAUG<br>GGUAAAGCGCUUAUUUGUAUCGGAGAGAAAUCCGAUAAAUAAGAAGCAUCAAAG |
| 2132 | shorten front, CUUCGG loop modified, extend extended | GCGCUUUUAUCUCAUUACUUUGAGAGCCAUCACCAGCGACUAUGUCGUAUGGGUAA<br>AGCGCUUAUUUAUCGGACUUCGGUCCGAUAAAUAAGCGCAUCAAAG |

TABLE 2-continued

Exemplary gNA Scaffold Sequences

| SEQ ID NO: | NAME or Modification | NUCLEOTIDE SEQUENCE |
|---|---|---|
| 2133 | A14C | UACUGGCGCUUUUCUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAG |
| 2134 | -1:3, +G3 | GUGGCGCUUUUAUCUCAUUACUUUGAGAGCCAUCACCAGCGACUAUGUCGUAUGGG UAAAGCGCUUAUUUAUCGGAGAGAAAUCCGAUAAAUAAGAAGCAUCAAAG |
| 2135 | =+C45, +U46 | UACUGGCGCUUUUAUCUCAUUACUUUGAGAGCCAUCACCAGCGACCUUAUGUCGUA UGGGUAAAGCGCUUAUUUAUCGGAGAGAAAUCCGAUAAAUAAGAAGCAUCAAAG |
| 2136 | CUUCGG loop modified, fun start | GAUGGCGCUUUUAUCUCAUUACUUUGAGAGCCAUCACCAGCGACUAUGUCGUAUGG GUAAAGCGCUUAUUUAUCGGACUUCGGUCCGAUAAAUAAGAASCAUCAAAG |
| 2137 | -93:94 | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAAGAAGCAUCAAAG |
| 2138 | =+U45 | UACUGGCGCUUUUAUCUCAUUACUUUGAGAGCCAUCACCAGCGAUCUAUGUCGUAU GGGUAAAGCGCUUAUUUAUCGGAGAGAAAUCCGAUAAAUAAGAAGCAUCAAAG |
| 2139 | -69, -94 | UACUGGCGCUUUUAUCUCAUUACUUUGAGAGCCAUCACCAGCGACUAUGUCGUAUG GGUAAAGGCUUAUUUAUCGGAGAGAAAUCCGAUAAAAGAAGCAUCAAAG |
| 2140 | -94 | UACUGGCGCUUUUAUCUCAUUACUUUGAGAGCCAUCACCAGCGACUAUGUCGUAUG GGUAAAGCGCUUAUUUAUCGGAGACAAAUCCGAUAAAAAGAAGCAUCAAAG |
| 2141 | modified CUUCGG, minus U in 1st triplex | UACUGGCGCUUUAUCUCAUUACUUUGAGAGCCAUCACCAGCGACUAUGUCGUAUGG GUAAAGCGCUUAUUUAUCGGACUUCGGUCCGAUAAAUAAGAAGCAUCAAAG |
| 2142 | -1:4, +C4, A14C, U17G, +G72, -76:78, -83:87 | CGGCGCUUUUCUCGCAUUACUUUGAGAGCCAUCACCAGCGACUAUGUCGUAUGGGU AAAGCGCUUAUUGUAUCGAGAGAUAAAUAAGAAGCAUCAAAG |
| 2143 | U1C, -73 | CACUGGCGCUUUUAUCUCAUUACUUUGAGAGCCAUCACCAGCGACUAUGUCGUAUG GGUAAAGCGCUAUUUUCGGAGAGAAAUCCGAUAAAUAAGAAGCAUCAAAG |
| 2144 | Scaffold uuCG, stem uuCG. Stem swap, 1 shorten | UACUGGCGCUUUUAUCUCAUUACUUUGAGAGCCAUCACCAGCGACUUCGGUCGUAUG GGUAAAGCGCUUAUGUAUCGGCUUCGGCCGAUACAUAAGAAGCAUCAAAG |
| 2145 | Scaffold uuCG, stem uuCG. Stem swap | UACUGGCGCUUUUAUCUCAUUACUUUGAGAGCCAUCACCAGCGACUUCGGUCGUAU GGGUAAAGCGCUUAUGUAUCGGCUUCGGCCGAUACAUAAGAAGCAUCAAAG |
| 2146 | =+G60 | UACUGGCGCUUUUAUCUCAUUACUUUGAGAGCCAUCACCAGCGACUAUGUCGUAUG GGUGAAAGCGCUUAUUUAUCGGAGAGAAAUCCGAUAAAUAAGAAGCAUCAAAG |
| 2147 | no stem Scaffold uuCG | UACUGGCGCUUUUAUCUCAUUACUUUGAGAGCCAUCACCAGCGACUUCGGUCGUAU GGGUAAAG |
| 2148 | no stem Scaffold uuCG, fun start | GAUGGGCUUUUAUCUCAUUACUUUGAGAGCCAUCACCAGCGACUUCGGUCGUAUGG GUAAAG |
| 2149 | Scaffold uuCG, stem uuCG, fun start | GAUGGGCUUUUAUCUCAUUACUUUGAGAGCCAUCACCAGCGACUUCGGUCGUAUGG CUAAAGCGCUUAUUUAUCGGCUUCGGCCGAUAAAUAAGAAGCAUCAAAG |
| 2150 | Pseudoknots | UACUGGCGCUUUUAUCUCAUUACUUUGAGAGCCAUCACCAGCGACUAUGUCGUAUG GGUAAAGCGCUACACUGGGAUCGCUGAAUUAGAGAUCGGCGUCCUUUCAUUCUAUA UACUUUGGAGUUUUAAAAUGUCUCUAAGUACAGAAGCAUCAAAG |
| 2151 | Scaffold uuCG, stem uuCG | GGCGCUUUAUCUCAUUACUUUGAGAGCCAUCACCAGCGACUUCGGUCGUAUGGGU AAAGCGCUUAUUUAUCGGCUUCGGCCGAUAAAUAAGAAGCAUCAAAG |
| 2152 | Scaffold uuCG, stem uuCG, no start | GCUGGCGCUUUUAUCUCAUUACUUUGAGAGCCAUCACCAGCGACUUCGGUCGUAUG GGUAAAGCCCUUAUUUAUCGGCUUCGGCCGAUAAAUAAGAAGCAUCAAAG |
| 2153 | Scaffold uuCG | UACUGGCGCUUUUAUCUCAUUACUUUGAGAGCCAUCACCAGCGACUUCGGUCGUAU GGGUAAAGCGCUUAUUUAUCGGAGAGAAAUCCGAUAAAUAAGAAGCAUCAAAG |
| 2154 | =+GCUC36 | UACUGGCGCUUUUAUCUCAUUACUUUGAGAGCCAUGCUCCACCAGCGACUAUGUCG UAUGGGUAAAGCGCUUAUUUAUCGGAGAGAAAUCCGAUAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2155 | G quadriplex telomere basket + ends | UACUGGCGCUUUUAUCUCAUUACUUUGAGAGCCAUCACCAGCGACUAUGUCGUAUG GGUAAAGCGGGGUUAGGGUUAGGGUUAGGGAAGCAUCAAAG |
| 2156 | G quadriplex M3q | UACUGGCGCUUUUAUCUCAUUACUUUGAGAGCCAUCACCAGCGACUAUGUCGUAUG GGUAAAGCGGAGGGAGGGAGGGAGAGGGAAAGCAUCAAAG |
| 2157 | G quadriplex telomere basket no ends | UACUGGCGCUUUUAUCUCAUUACUUUGAGAGCCAUCACCAGCGACUAUCUCGUAUG GGUAAAGCGUUGGGUUAGGGUUAGGGUUAGGGAAAAGCAUCAAAG |
| 2158 | 45, 44 hairpin (old version) | UACUGGCGCUUUUAUCUCAUUACUUUGAGAGCCAUCACCAGCGACUAUGUCGUAUG GGUAAAGCGC--------AGGGCUUCGGCCG---------GAAGCAUCAAAG |
| 2159 | Sarcin-ricin loop | UACUGGCGCUUUUAUCUCAUUACUUUGAGAGCCAUCACCAGCGACUAUGUCGUAUG GGUAAAGCGCCUGCUCAGUACGAGAGGAACCGCAGGAAGCAUCAAAG |
| 2160 | uvsX, C18G | UACUGGCGCUUUUAUCUGAUUACUUUGAGAGCCAUCACCAGCGACUAUGUCGUAUG GGUAAAGCGCCCUCUUCGGAGGGAAGCAUCAAAG |
| 2161 | truncated stem loop, C18G, trip mat (U10C) | UACUGGCGCCUUUUAUCUGAUUACUUUGAGAGCCAUCACCAGCGACUAUGUCGUAUG GGUAAAGCGCUUACGGACUUCGGUCCGUAAGAAGCAUCAAAG |
| 2162 | short phage rep, C18G | UACUGGCGCUUUUAUCUGAUUACUUUGAGAGCCAUCACCAGCGACUAUGUCGUAUG GGUAAAGCGCGGACGACCUCUCGGUCGUCCGAAGCAUCAAAG |
| 2163 | phage rep loop, C18G | UACUGGCGCUUUUAUCUGAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2164 | =+G18, stacked onto 64 | UACUGGCGCCUUUUAUCUGCAUUACUUUGAGAGCCAUCACCAGCGACUAUGUCGUAU GGGUAAAGCGCUUACGGACUUCGGUCCGUAAGAAGCAUCAAAG |
| 2165 | truncated stem loop, C18G, -1 A2G | GCUGGCGCUUUUAUCUGAUUACUUUGAGAGCCAUCACCAGCGACUAUGUCGUAUGG GUAAAGCGCUUACGGACUUCGGUCCGUAAGAAGCAUCAAAG |
| 2166 | phage rep loop, C18G, trip mut (U10C) | UACUGGCGCCUUUUAUCUGAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2167 | short phage rep, C18G, trip mut (U10C) | UACUGGCGCCUUUUAUCUGAUUACUUUGAGAGCCAUCACCAGCGACUAUGUCGUAUG GGUAAAGCGCGGACGACCUCUCGGUCGUCCGAAGCAUCAAAG |
| 2168 | avsX, trip mut (U10C) | UACUGGCGCCUUUUAUCUCAUUACUUUGAGAGCCAUCACCAGCGACUAUGUCGUAUG GGUAAAGCGCCCUCUUCGGAGGGAAGCAUCAAAG |
| 2169 | truncated stem loop | UACUGGCGCUUUUAUCUCAUUACUUUGAGAGCCAUCACCAGCGACUAUGUCGUAUG GGUAAAGCGCUUACGGACUUCGGUCCGUAAGAAGCAUCAAAG |
| 2170 | =+A17, stacked onto 64 | UACUGGCGCCUUUAUCAUCAUUACUUUGAGAGCCAUCACCAGCGACUAUGUCGUAU GGGUAAAGCGCUUACGGACUUCGGUCCGUAAGAAGCAUCAAAG |
| 2171 | 3' HDV genomic ribozyme | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGGCC GGCAUGGUCCCAGCCUCCUCGCUGGCGCCGGCUGGGCAACAUUCCGAGGGGACCGU CCCCUCGGUAAUGGCGAAUGGGACCC |
| 2172 | phage rep loop, top mut (U10C) | UACUGGCGCCUUUAUCUCAUUACUUUGAGAGCCAUCACCAGCGACUAUGUCGUAUG GGUAAAGCGCAGGUGGGACGACCUCUCGGUCGUCCUAUCUGAAGCAUCAAAG |
| 2173 | -79:80 | UACUGGCGCUUUUAUCUCAUUACUUUGAGAGCCAUCACCAGCGACUAUGUCGUAUG GGUAAAGCGCUUAUUUAUCGGAGAAAUCCGAUAAAUAAGAAGCAUCAAAG |
| 2174 | short phage rep, trip mut (U10C) | UACUGGCGCCUUUAUCUCAUUACUUUGAGAGCCAUCACCAGCGACUAUGUCGUAUG GGUAAAGCGCGGACGACCUCUCGGUCGUCCGAAGCAUCAAAG |
| 2175 | extra truncated stem loop | UACUGGCGCUUUUAUCUCAUUACUUUGAGAGCCAUCACCAGCGACUAUGUCGUAUG GGUAAAGCGCCGGACUUCGGUCCGGAAGCAUCAAAG |
| 2176 | U17G, C18G | UACUGGCGCUUUUAUCGGAUUACUUUGAGAGCCAUCACCAGCGACUAUGUCGUAUG GGUAAAGCGCUUAUUUAUCGGAGAGAAAUCCGAUAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2177 | short phage rep | UACUGGCGCUUUUAUCUCAUUACUUUGAGAGCCAUCACCAGCGACUAUGUCGUAUG GGUAAAGCGCGGACGACCUCUCGGUCGUCCGAAGCAUCAAAG |
| 2178 | uvsX, C18G, -1 A2G | GCUGGCGCUUUUAUCUGAUUACUUUGAGAGCCAUCACCAGCGACUAUGUCGUAUGG GUAAAGCGCCCUCUUCGGAGGGAAGCAUCAAAG |
| 2179 | uvsX, C18G, trip mut (U10C), -1 A2G, HDV -99 G65U | GCUGGCGCCUUUAUCUGAUUACUUUGAGAGCCAUCACCAGCGACUAUGUCGUAUGG GUAAAGCUCCCUCUUCGGAGGGAGCAUCAAAG |
| 2180 | 3' HDV antigenomic ribozyme | UAuUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGGGU CGGCAUGGCAUCUCCACCUCCUCGCGGUCCGACCUGGGCAUCCGAAGGAGGACGCA CGUCCACUCGGAUGGCUAAGGGAGAGCCA |
| 2181 | uvsX, C18G, trip mat (U10C), -1 A2G, HDV AA(98:99)C | GCUGGCGCCUUUAUCUGAUUACUUUGAGAGCCAUCACCAGCGACUAUGUCGUAUGG GUAAAGCGCCCUCUUCGGAGGGCGCAUCAAAG |
| 2182 | 3' HDV ribozyme (Lior Nissim, Timothy Lu) | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGUUUU GGCCGGCAUGGUCCCAGCCUCCUCGCUGGCGCCGGCUGGGCAACAUGCUUCGGCAU GGCGAAUGGGACCCCGGG |
| 2183 | TAC(1:3)GA, stacked onto 64 | GAUGGCGCCUUUAUCUCAUUACUUUGAGAGCCAUCACCAGCGACUAUGUCGUAUGG GUAAAGCGCUUACGGACUUCGGUCCGUAAGAAGCAUCAAAG |
| 2184 | uvsX, -1 A2G | GCUGGCGCUUUUAUCUGAUUACUUUGAGAGCCAUCACCAGCGACUAUGUCGUAUGG GUAAAGCGCCCUCUUCGGAGGGAAGCAUCAAAG |
| 2185 | truncated stem loop, C18G, trip mut (U10C), -1 A2G, HDV -99 G65U | GCUGGCGCCUUUAUCUGAUUACUUUGAGAGCCAUCACCAGCGACUAUGUCGUAUGG GUAAAGCUCUUACGGACUUCGGUCCGUAAGAGCAUCAAAG |
| 2186 | short phage rep, C18G, trip mut (U10C), -1 A2G, HDV -99 G65U | GCUGGCGCCUUUAUCUGAUUACUUUGAGAGCCAUCACCAGCGACUAUGUCGUAUGG GUAAAGCUCGGACGAGCUCUCGGUCGUCCGAGCAUCAAAG |
| 2187 | 3' sTRSV WT viral Hammerhead ribozyme | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGCCUG UCACCGGAUGUGCUUUCCGGUCUGAUGAGUCCGUGAGGACGAAACAGG |
| 2188 | short phage rep, C18G, -1 A2G | GCUGGCGCUUUUAUCUGAUUACUUUGAGAGCCAUCACCAGCGACUAUGUCGUAUGG GUAAAGCGCGGACGACCUCUCGGUCGUCCGAAGCAUCAAAG |
| 2189 | short phage rep, C18G, trip mut (U10C), -1 A2G, 3' genomic HDV | GCUGGCGCCUUUAUCUGAUUACUUUGAGAGCCAUCACCAGCGACUAUGUCGUAUGG GUAAAGCGCGGACGACCUCUCGGUCGUCCGAAGCAUCAAAG |
| 2190 | phage rep loop, C18G, trip mut (U10C), -1 A2G, HDV -99 G65U | GCUGGCGCCUUUAUCUGAUUACUUUGAGAGCCAUCACCAGCGACUAUGUCGUAUGG GUAAAGCUCAGGUGGGACGACCUCUCGGUCGUCCUAUCUGAGCAUCAAAG |
| 2191 | 3' HDV ribozyme (Owen Ryan, Jamie Cate) | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGAUG GCCGGCAUGGUCCCAGCCUCCUCGCUGGCGCCGGCUGGGCAACACCUUCGGGUGGC GAAUGGGAC |
| 2192 | phage rep loop, C18G, -1 A2G | GCUGGCGCUUUUAUCUGAUUACUUUGAGAGCCAUCACCAGCGACUAUGUCGUAUGG GUAAAGCGCAGGUGGGACGACCUCUCGGUCGUCCUAUCUGAAGCAUCAAAG |
| 2193 | 0.14 | UACUGGCGCUUUUAUCUCAUUACUUUGAGAGCCAUCACCAGCGACUAUGUCGUACU GGGUAAAGCGCUUAUUUAUCGGAGAGAAAUCCGAUAAAUAAGAAGCAUCAAAG |
| 2194 | -78, G77U | UACUGGCGCUUUUAUCUCAUUACUUUGAGAGCCAUCACCAGCGACUAUGUCGUAUG GGUAAAGCGCUUAUUUAUCGUGAGAAAUCCGAUAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2195 | | GUACUGGCGCUUUUAUCUCAUUACUUUGAGAGCCAUCACCAGCGACUAUGUCGUAU GGGUAAAGCGCUUAUUUAUCGGAGAGAAAUCCGAUAAAUAAGAAGCAUCAAAG |
| 2196 | short phage rep, -1 A2G | GCUGGCGCUUUUAUCUCAUUACUUUGAGAGCCAUCACCAGCGACUAUGUCGUAUGG GUAAAGCGCGGACGACCUCUCGGUCGUCCGAAGCAUCAAAG |
| 2197 | truncated stem loop, C18G, trip mut (U10C), -1 A2G | GCUGGCGCCUUUAUCUGAUUACUUUGAGAGCCAUCACCAGCGACUAUGUCGUAUGG GUAAAGCGCUUACGGACUUCGGUCCGUAAGAAGCAUCAAAG |
| 2198 | -1, A2G | GCUGGCGCUUUUAUCUCAUUACUUUGAGAGCCAUCACCAGCGACUAUGUCGUAUGG GUAAAGCGCUUAUUUAUCGGAGAGAAAUCCGAUAAAUAAGAAGCAUCAAAG |
| 2199 | truncated stem loop, trip mut (U10C), -1 A2G | GCUGGCGCUUUUAUCUCAUUACUUUGAGAGCCAUCACCAGCGACUAUGUCGUAUGG GUAAAGCGCUUACGGACUUCGGUCCGUAAGAAGCAUCAAAG |
| 2200 | uvsX, C18G, trip mut (U10C), -1 A2G | GCUGGCGCCUUUAUCUGAUUACUUUGAGAGCCAUCACCAGCGACUAUGUCGUAUGG GUAAAGCGCCCUCUUCGGAGGGAAGCAUCAAAG |
| 2201 | phage rep loop, -1 A2G | GCUGGCGCUUUUAUCUCAUUACUUUGAGAGCCAUCACCAGCGACUAUGUCGUAUGG GUAAAGCGCAGGUGGGACGACCUCUCGGUCGUCCUAUCUGAAGCAUCAAAG |
| 2202 | phage rep loop, top mut (U10C), -1 A2G | GCUGGCGCUUUUAUCUCAUUACUUUGAGAGCCAUCACCAGCGACUAUGUCGUAUGG GUAAAGCGCAGGUGGGACGACCUCUCGGUCGUCCUAUCUGAAGCAUCAAAG |
| 2203 | phage rep loop, C18G, trip mut (U10C), -1 A2G | GCUGGCGCUUUUAUCUGAUUACUUUGAGAGCCAUCACCAGCGACUAUGUCGUAUGG GUAAAGCGCAGGUGGGACGACCUCUCGGUCGUCCUAUCUGAAGCAUCAAAG |
| 2204 | truncated stem loop, C18G | UACUGGCGCUUUUAUCUGAUUACUUUGAGAGCCAUCACCAGCGACUAUGUCGUAUC GGUAAAGCGCUUACGGACUUCGGUCCGUAAGAAGCAUCAAAG |
| 2205 | uvsX, trip mut (U10C), -1 A2G | GCUGGCGCUUUUAUCUCAUUACUUUGAGAGCCAUCACCAGCGACUAUGUCGUAUGG GUAAAGCGCCCUCUUCGGAGGGAAGCAUCAAAG |
| 2206 | truncated stem loop, -1 A2G | GCUGGCGCUUUUAUCUCAUUACUUUGAGAGCCAUCACCAGCGACUAUGUCGUAUGG GUAAAGCGCUUACGGACUUCGGUCCGUAAGAAGCAUCAAAG |
| 2207 | short phage rep, trip mut (U10C), -1 A2G | GCUGGCGCUUUUAUCUCAUUACUUUGAGAGCCAUCACCAGCGACUAUGUCGUAUGG GUAAAGCGCGGACGACCUCUCGGUCGUCCGAAGCAUCAAAG |
| 2208 | 5'HDV ribozyme (Owen Ryan, Jamie Cate) | GAUGGCCGGCAUGGUCCCAGCCUCCUCGCUGGCGCCGGCUGGGCAACACCUUCGGG UGGCGAAUGGGACUACUGGCGCUUUUAUCUCAUUACUUUGAGAGCCAUCACCAGCG ACUAUGUCGUAUGGGUAAAGCGCUUAUUUAUCGGAGAGAAAUCCGAUAAAUAAGAA GCAUCAAAG |
| 2209 | 5'HDV genomic ribozyme | GGCCGGCAUGGUCCCAGCCUCCUCGCUGGCGCCGGCUGGGCAACAUUCCGAGGGGA CCGUCCCCUCGGUAAUGGCGAAUGGGACCCUACUGGCGCUUUUAUCUCAUUACUUU GAGAGCCAUCACCAGCGACUAUGUCGUAUGGGUAAAGCGCUUAUUUAUCGGAGAGA AAUCCGAUAAAUAAGAAGCAUCAAAG |
| 2210 | truncated stem loop, C18G, trip mut (U10C), -1 A2G, HDV AA(98:99)C | GCUGGCGCCUUUAUCUGAUUACUUUGAGAGCCAUCACCAGCGACUAUGUCGUAUGG GUAAAGCGCUUACGGACUUCGGUCCGUAAGCGCAUCAAAG |
| 2211 | 5'env25 pistol ribozyme (with an added CUUCGG loop) | CGUGGUUAGGGCCACGUUAAAUAGUUGCUUAAGCCCUAAGCGUUGAUCUUCGGAUC AGGUGCAAUACUGGCGCUUUUAUCUCAUUACUUUGAGAGCCAUCACCAGCGACUAU GUCGUAUGGGUAAAGCGCUUAUUUAUCGGAGAGAAAUCCGAUAAAUAAGAAGCAUC AAAG |
| 2212 | 5'HDV antigenomic ribozyme | GGGUCGGCAUGGCAUCUCCACCUCCUCGCGGUCCGACCUGGGCAUCCGAAGGAGGA CGCACGUCCACUCGGAUGGCUAAGGGAGAGCCAUACUGGCGCUUUUAUCUCAUUAC UUUGAGAGCCAUCACCAGCGACUAUGUCGUAUGGGUAAAGCGCUUAUUUAUCGGAG AGAAAUCCGAUAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2213 | 3' Hammerhead ribozyme (Lior Nissim, Timothy Lu) guide scaffold scar | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGCCAG UACUGAUGAGUCCGUGAGGACGAAACGAGUAAGCUCGUCUACUGGCGCUUUUAUCU CAU |
| 2214 | =+A27, stacked onto 64 | UACUGGCGCCUUUAUCUCAUUACUUUGAGAGCCAUCACCAGCGACUAUGUCGUAU GGGUAAAGCGCUUACGGACUUCGGUCCGUAAGAAGCAUCAAAG |
| 2215 | 5'Hammerhead ribozyme (Lior Nissim, Timothy Lu) smaller scar | CGACUACUGAUGAGUCCGUGAGGACGAAACGAGUAAGCUCGUCUAGUCGUACUGGC GCUUUUAUCUCAUUACUUUGAGAGCCAUCACCAGCGACUAUGUCGUAUGGGUAAAG CGCUUAUUUAUCGGAGAGAAAUCCGAUAAAUAAGAAGCAUCAAAG |
| 2216 | phage rep loop, C18G, trip mut (U10C), -1 A2G, HDV AA(98:99)C | GCUGGCGCCUUUAUCUGAUUACUUUGAGAGCCAUCACCAGCGACUAUGUCGUAUGG GUAAAGCGCAGGUGGGACGACCUCUCGGUCGUCCUAUCUGCGCAUCAAAG |
| 2217 | -27, stacked onto 64 | UACUGGCGCCUUUAUCUCAUUACUUUGAGAGCCAUCACCAGCGACUAUGUCGUAUGG GUAAAGCGCUUACGGACUUCGGUCCGUAAGAAGCAUCAAAG |
| 2218 | 3' Hatchet | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGCAUU CCUCAGAAAAUGACAAACCUGUGGGGCGUAAGUAGAUCUUCGGAUCUAUGAUCGUG CAGACGUUAAAAUGAGGU |
| 2219 | 3' Hammerhead ribozyme (Lior Nissim, Timothy Lu) | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGCGAC UACUGAUGAGUCCGUGAGGACGAAACGAGUAAGCUCGUCUAGUCGCGUGUAGCGAA GCA |
| 2220 | 5' Hatchet | CAUUCCUCAGAAAAUGACAAACCUGUGGGGCGUAAGUAGAUCUUCGGAUCUAUGAU CGUGCAGACGUUAAAAUCAGGUUACUGGCGCUUUUAUCUCAUUACUUUGAGAGCCA UCACCAGCGACUAUGUCGUAUGGGUAAAGCGCUUAUUUAUCGGAGAGAAAUCCGAU AAAUAAGAAGCAUCAAAG |
| 2221 | 5' HDV ribozyme (Lior Nissim, Timothy Lu) | UUUUGGCCGGCAUGGUCCCAGCCUCCUCGCUGGCGCCGGCUGGGCAACAUGCUUCG GCAUGGCGAAUGGGACCCCGGUCAUCUGGCGCUUUUAUCUCAUUACUUUGAGAGCCA UCACCAGCGACUAUGUCGUAUGGGUAAAGCGCUUAUUUAUCGGAGAGAAAUCCGAU AAAUAAGAAGCAUCAAAG |
| 2222 | 5' Hammerhead ribozyme (Lior Nissim, Timothy Lu) | CGACUACUGAUGAGUCCGUGAGGACGAAACGAGUAAGCUCGUCUAGUCGCGUGUAG CGAAGCAUACUGGCGCUUUUAUCUCAUUACUUUGAGAGCCAUCACCAGCGACUAUG UCGUAUGGGUAAAGCGCUUAUUUAUCGGAGAGAAAUCCGAUAAAUAAGAAGCAUCA AAG |
| 2223 | 3' HH15 Minimal Hammerhead ribozyme | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGGGA GCCCCGCUGAUGAGGUCGGGGAGACCGAAAGGGACUUCGGUCCCUACGGGGCUCCC |
| 2224 | 5' RBMX recruiting motif | CCACCCCCACCACCACCCCCACCCCCACCACCACCCUACUGGCGCUUUUAUCUCAU UACUUUGAGAGCCAUCACCAGCGACUAUGUCGUAUGGGUAAAGCGCUUAUUUAUCG GAGAGAAAUCCGAUAAAUAAGAAGCAUCAAAG |
| 2225 | 3' Hammerhead ribozyme (Lior Nissim, Timothy Lu) smaller scar | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGCGAC UACUGAUGAGUCCGUGAGGACGAAACGAGUAAGCUCGUCUAGUCG |
| 2226 | 3' env25 pistol ribozyme (with an added CUUCGG loop) | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGCUUG GUUAGGGCCACGUUAAAUAGUUGCUUAAGCCCUAAGCGUUGAUCUUCGGAUCAGGU GCAA |
| 2227 | 3' Env-9 Twister | UACUGGCGCUUUUAUCUCAUUACUUUGAGAGCCAUCACCAGCGACUAUGUCGUAUG GGUAAAGCGCUUAUUUAUCGGAGAGAAAUCCGAUAAAUAAGAAGCAUCAAAGGGCA AUAAGCGGUUACAAGCCCGCAAAAAUAGCAGAGUAAUGUCGCGAUAGCGCGGCAU UAAUGCAGCUUUAUUG |
| 2228 | =+AUUAUCUC AUUACU25 | UACUGGCGCUUUUAUCUCAUUACUAUUAUCUCAUUACUUUGAGAGCCAUCACCAGC GACUAUGUCGUAUGGGUAAAGCGCUUAUUUAUCGGAGAGAAAUCCGAUAAAUAAGA AGCAUCAAAG |

TABLE 2-continued

Exemplary gNA Scaffold Sequences

| SEQ ID NO: | NAME or Modification | NUCLEOTIDE SEQUENCE |
|---|---|---|
| 2229 | 5' Env-9 Twister | GGCAAUAAAGCGGUUACAAGCCCGCAAAAAUAGCAGAGUAAUGUCGCGAUAGCGCGGCAUUAAUGCAGCUUUAUUGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2230 | 3' Twisted Sister 1 | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGACCCGCAAGGCCGACGGCAUCCUUUUCCUCUGGUGLAAGUCUAGCCGUCCCUUCUGGGGCGGGCGCUCAUGGGUAAC |
| 2231 | no stem | UACUGGCGCUUUUAUCUCAUUACUUUGAGAGCCAUCACCAGCGACUAUGUCGUAUGGGUAAAG |
| 2232 | 5' HH15 Minimal Hammerhead ribozyme | GGGAGCCCCGCUGAUGAGGUCGGGGAGACCGAAAGGGACUUCGGUCCCUACGGGGCUCCCUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2233 | 5' Hammerhead ribozyme (Lior Nissim, Timothy Lu) guide scaffold scar | CCAGUACUGAUGAGUCCGUGAGGACGAAACGAGUAAGCUCGUCUACUGGCGCUUUUAUCUCAUUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCA |
| 2234 | 5' Twisted Sister 1 | ACCCGCAAGGCCGACGGCAUCUGCCGCCGCUGGUGCAAGUCCAGCCGCCCCUUCGGGGGCGGGCGCUCAUGGGUAACUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2235 | 5' sTRSV WT viral Hammerhead ribozyme | CCUGUCACCGGAUGUGCUUUCCGGUCUGAUGAGUCCGUGAGGACGAAACAGGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2236 | 148: =+G55, stacked onto 64 | GUACUGGCGCUUUUAUCUCAUUACUUUGAGAGCCAUCACCAGCGACUAUGUCGUAGUGGGUAAAGCGCUUACGGACUUCGGUCCGUAAGAAGCAUCAAAG |
| 2237 | 158: 103 + 148(+G55) -99, G65U | GUACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2238 | 174: Uvsx Extended stem with [A99] G65U), C18G, ^G55, [GU-1] | ACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2239 | 175: extended stem truncation, U10C, [GU-1] | ACUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2240 | 176: 174 with A1G substitution for T7 transcription | GCUGGCGCUUUUAUCUGAUUACUUUGAGAGCCAUCACCAGCGACUAUGUCGUAGUGGGUAAAGCUCCCUCUUCGGAGGGAGCAUCAAAG |
| 2241 | 177: 174 with bubble (+G55) removed | ACUGGCGCUUUUAUCUGAUUACUUUGAGAGCCAUCACCAGCGACUAUGUCGUAUGGGUAAAGCUCCCUCUUCGGAGGGAGCAUCAAAG |
| 2242 | 181: stem 42 (truncated stem loop); U10C, C18G, [GU-1] (95 + [GU-1]) | ACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2243 | 182: stem 42 (truncated stem loop); C18G, [GU-1] | ACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2244 | 183: stem 42 (truncated stem loop); C18G, ^G55, [GU-1] | ACUGGCGCUUUUAUCUGAUUACUUUGAGAGCCAUCACCAGCGACUAUGUCGUAGUG GGUAAAGCGCUUACGGACUUCGGUCCGUAAGAAGCAUCAAAG |
| 2245 | 184: stem 48 (uvsx, -99 g65t); C18G, ^T55, [GU-1] | ACUGGCGCUUUUAUCUGAUUACUUUGAGAGCCAUCACCAGCGACUAUGUCGUAUUG GGUAAAGCUCCCUCUUCGGAGGGAGCAUCAAAG |
| 2246 | 185: stem 42 (truncated stem loop); C18G, ^U55, [GU-1] | ACUGGCGCUUUUAUCUGAUUACUUUGAGAGCCAUCACCAGCGACUAUGUCGUAUUG GGUAAAGCGCUUACGGACUUCGGUCCGUAAGAAGCAUCAAAG |
| 2247 | 186: stem 42 (truncated stem loop); U10C, ^A17, [GU-1] | ACUGGCGCCUUUAUCAUCAUUACUUUGAGAGCCAUCACCAGCGACUAUGUCGUAUG GGUAAAGCGCUUACGGACUUCGGUCCGUAAGAAGCAUCAAAG |
| 2248 | 187: stem 46 (uvsx); C18G, ^G55, [GU-1] | ACUGGCGCUUUUAUCUGAUUACUUUGAGAGCCAUCACCAGCGACUAUGUCGUAGUG GGUAAAGCGCCCUCUUCGGAGGGAAGCAUCAAAG |
| 2249 | 188: stem 50 (ms2 U15C, -99, g65t); C18G, ^G55, [GU-1] | ACUGGCGCUUUUAUCUGAUUACUUUGAGAGCCAJCACCAGCGACUAUGUCGUAGUG GGUAAAGCUCACAUGAGGAUCACCCAUGUGAGCAUCAAAG |
| 2250 | 189: 174 + G8A; U15C; U35A | ACUGGCACUUUUACCUGAUUACUUUGAGAGCCAACACCAGCGACUAUGUCGUAGUG GGUAAAGCUCCCUCUUCGGAGGGAGCAUCAAAG |
| 2251 | 190: 174 + G8A | ACUGGCACUUUUAUCUGAUUACUUUGAGAGCCAUCACCAGCGACUAUGUCGUAGUG GGUAAAGCUCCCUCUUCGGAGGGAGCAUCAAAG |
| 2252 | 191: 174 + G8C | ACUGGCCCUUUUAUCUGAUUACUUUGAGAGCCAUCACCAGCGACUAUGUCGUAGUG GGUAAAGCUCCCUCUUCGGAGGGAGCAUCAAAG |
| 2253 | 192: 174 + U15C | ACUGGCGCUUUUACCUGAUUACUUUGAGAGCCAUCACCAGCGACUAUGUCGUAGUG GGUAAAGCUCCCUCUUCGGAGGGAGCAUCAAAG |
| 2254 | 193, 174 + U35A | ACUGGCGCUUUUAUCUGAUUACUUUGAGAGCCAACACCAGCGACUAUGUCGUAGUG GGUAAAGCUCCCUCUUCGGAGGGAGCAUCAAAG |
| 2255 | 195: 175 + C18G + G8A; U15C; U35A | ACUGGCACCUUUACCUGAUUACUUUGAGAGCCAACACCAGCGACUAUGUCGUAUGG GUAAAGCGCUUACGGACUUCGGUCCGUAAGAAGCAUCAAAG |
| 2256 | 196: 175 + C18G + G8A | ACUGGCACCUUUAUCUGAUUACUUUGAGAGCCAUCACCAGCGACUAUGUCGUAUGG GUAAAGCGCUUACGGACUUCGGUCCGUAAGAAGCAUCAAAG |
| 2257 | 197: 175 + C18G + G8C | ACUGGCCCUUUUAUCUGAUUACUUUGAGAGCCAUCACCAGCGACUAUGUCGUAUGG GUAAAGCGCUUACGGACUUCGGUCCGUAAGAAGCAUCAAAG |
| 2258 | 198: 175 + C18G + U35A | ACUGGCGCUUUUAUCUGAUUACUUUGAGAGCCAACACCAGCGACUAUGUCGUAUGG GUAAAGCGCUUACGGACUUCGGUCCGUAAGAAGCAUCAAAG |
| 2259 | 199: 174 + A2G (test G transcription at start; ccGCT . . . ) | GCUGGCGCUUUUAUCUGAUUACUUUGAGAGCCAUCACCAGCGACUAUGUCGUAGUG GGUAAAGCUCCCUCUUCGGAGGGAGCAUCAAAG |
| 2260 | 200: 174 + ^G1 (ccGACU . . . ) | GACUGGCGCUUUUAUCUGAUUACUUUGAGAGCCAUCACCAGCGACUAUGUCGUAGU GGGUAAAGCUCCCUCUUCGGAGGGAGCAUCAAAG |
| 2261 | 201: 174 + U10C; ^G28 | ACUGGCGCCUUUAUCUGAUUACUUUGGAGAGCCAUCACCAGCGACUAUGUCGUAGU GGGUAAAGCUCCCUCUUCGGAGGGAGCAUCAAAG |

TABLE 2-continued

Exemplary gNA Scaffold Sequences

| SEQ ID NO: | NAME or Modification | NUCLEOTIDE SEQUENCE |
|---|---|---|
| 2262 | 202: 174 + U10A; A28U | ACUGGCGCAUUUAUCUGAUUACUUUGUGAGCCAUCACCAGCGACUAUGUCGUAGUGGGUAAAGCUCCCUCUUCGGAGGGAGCAUCAAAG |
| 2263 | 203: 174 + U10C | ACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2264 | 204: 174 + ^G28 | ACUGGCGCUUUUAUCUGAUUACUUUGGAGAGCCAUCACCAGCGACUAUGUCGUAGUGGGUAAAGCUCCCUCUUCGGAGGGAGCAUCAAAG |
| 2265 | 205: 174 + U10A | ACUGGCGCAUUUAUCUGAUUACUUUGAGAGCCAUCACCAGCGACUAUGUCGUAGUGGGUAAAGCUCCCUCUUCGGAGGGAGCAUCAAAG |
| 2266 | 206, 174 + A28U | ACUGGCGCUUUUAUCUGAUUACUUUGUGAGCCAUCACCAGCGACUAUGUCGUAGUGGGUAAAGCUCCCUCUUCGGAGGGAGCAUCAAAG |
| 2267 | 207: 174 + ^U15 | ACUGGCGCUUUUAUUCUGAUUACUUUGAGAGCCAUCACCAGCGACUAUGUCGUAGUGGGUAAAGCUCCCUCUUCGGAGGGAGCAUCAAAG |
| 2268 | 208: 174 + [U4] | ACGGCGCUUUUAUCUGAUUACUUUGAGAGCCAUCACCAGCGACUAUGUCGUAGUGGUAAAGCUCCCUCUUCGGAGGGAGCAUCAAAG |
| 2269 | 209: 174 + C16A | ACUGGCGCUUUUAUAUGAUUACUUUGAGAGCCAUCACCAGCGACUAUGUCGUAGUGGGUAAAGCUCCCUCUUCGGAGGGAGCAUCAAAG |
| 2270 | 210: 174 + ^U17 | ACUGGCGCUUUUAUCUUGAUUACUUUGAGAGCCAUCACCAGCGACUAUGUCGUAGUGGGUAAAGCUCCCUCUUCGGAGGGAGCAUCAAAG |
| 2271 | 211: 174 + U35G (compare with 174 + U35A above) | ACUGGCGCUUUUAUCUGAUUACUUUGAGAGCCAGCACCAGCGACUAUGUCGUAGUGGGUAAAGCUCCCUCUUCGGAGGGAGCAUCAAAG |
| 2272 | 212: 174 + U11G, A105G (A86G), U26C | ACUGGCGCUGUUAUCUGAUUACUUCGAGAGCCAUCACCAGCGACUAUGUCGUAGUGGGUAAAGCUCCCUCUUCGGAGGGAGCAUCGAAG |
| 2273 | 213: 174 + U11C, A105G (A86G), U26C | ACUGGCGCUCUUAUCUGAUUACUUCGAGAGCCAUCACCAGCGACUAUGUCGUAGUGGGUAAAGCUCCCUCUUCGGAGGGAGCAUCGAAG |
| 2274 | 214: 174 + U12G; A106G (A87G), U25C | ACUGGCGCUUGUAUCUGAUUACUCGAGAGCCAUCACCAGCGACUAUGUCGUAGUGGGUAAAGCUCCCUCUUCGGAGGGAGCAUCAGAG |
| 2275 | 215: 174 + U12C; A106G (A87G), U25C | ACUGGCGCUUCUAUCUGAUUACUCGAGAGCCAUCACCAGCGACUAUGUCGUAGUGGGUAAAGCUCCCUCUUCGGAGGGAGCAUCAGAG |
| 2276 | 216: 174_tx_11.G, 87.G, 22.C | ACUGGCGCUUUGAUCUGAUUACCUUGAGAGCCAUCACCAGCGACUAUGUCGUAGUGGGUAAAGCUCCCUCUUCGGAGGGAGCAUCAAGG |
| 2277 | 217: 174_tx_11.C, 87.G, 22.C | ACUGGCGCUUUCAUCUGAUUACCUUGAGAGCCAUCACCAGCGACUAUGUCGUAGUGGGUAAAGCUCCCUCUUCGGAGGGAGCAUCAAGG |
| 2278 | 218: 174 + U11G | ACUGGCGCUGUUAUCUGAUUACUUUGAGAGCCAUCACCAGCGACUAUGUCGUAGUGGGUAAAGCUCCCUCUUCGGAGGGAGCAUCAAAG |
| 2279 | 219: 174 + A105G (A86G) | ACUGGCGCUUUUAUCUGAUUACUUUGAGAGCCAUCACCAGCGACUAUGUCGUAGUGGGUAAAGCUCCCUCUUCGGAGGGAGCAUCGAAG |
| 2280 | 220; 174 + U26C | ACUGGCGCUUUUAUCUGAUUACUUCGAGAGCCAUCACCAGCGACUAUGUCGUAGUGGGUAAAGCUCCCUCUUCGGAGGGAGCAUCAAAG |
| 2281 | 221: 182 + G8A (196) + 215 mutations + ^C63, A88G | ACUGGCACUUCUAUCUGAUUACUCUGAGAGCCAUCACCAGCGACUAUGUCGUAUGGGUAAAGCCGCUUACGGACUUCGGUCCGUAAGAGGCAUCAGAG |
| 2282 | 222: 174 + G8A (196) + 215 mutations | ACUGGCACUUCUAUCUGAUUACUCUGAGAGCCAUCACCAGCGACUAUGUCGUAGUGGGUAAAGCUCCCUCUUCGGAGGGAGCAUCAGAG |

TABLE 2-continued

Exemplary gNA Scaffold Sequences

| SEQ ID NO: | NAME or Modification | NUCLEOTIDE SEQUENCE |
|---|---|---|
| 2283 | 223: 181 + G8A (196) + ^C63, A88G | ACUGGCACCUUUAUCUGAUUACUUUGAGAGCCAUCACCAGCGACUAUGUCGUAUGG GUAAAGCCGCUUACGGACUUCGGUCCGUAAGAGGCAUCAAAG |
| 2284 | 224: 182 + G8A (196) + 214 mutations + ^C63, A88G | ACUGGCACUUGUAUCUGAUUACUCUGAGAGCCAUCACCAGCGACUAUGUCGUAUGG GUAAAGCCGCUUACGGACUUCGGUUUUUAAGAGGCAUCAGAG |
| 2285 | 225: 174 + G8A (196) + 214 mutations | ACUGGCACUUGUAUCUGAUUACUCUGAGAGCCAUCACCAGCGACUAUGUCGUAGUG GGUAAAGCUCCCUCUUCGGAGGGAGCAUCAGAG |

In some embodiments, the gNA variant comprises a tracrRNA stem loop comprising the sequence -UUU-N4-25-UUU- (SEQ ID NO: 381). For example, the gNA variant comprises a scaffold stem loop or a replacement thereof, flanked by two triplet U motifs that contribute to the triplex region. In some embodiments, the scaffold stem loop or replacement thereof comprises at least 4 nucleotides, at least 5 nucleotides, at least 6 nucleotides, at least 7 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides.

In some embodiments, the gNA variant comprises a crRNA sequence with -AAAG- in a location 5' to the spacer region. In some embodiments, the -AAAG- sequence is immediately 5' to the spacer region.

In some embodiments, the at least one nucleotide modification to a reference gNA to produce a gNA variant comprises at least one nucleotide deletion in the CasX variant gNA relative to the reference gRNA. In some embodiments, a gNA variant comprises a deletion of 1, 2, 3, 4, 5, 6, 7, 8, 9, 10, 11, 12, 13, 14, 15, 16, 17, 18, 19 or 20 consecutive or non-consecutive nucleotides relative to a reference gNA. In some embodiments, the at least one deletion comprises a deletion of 1, 2, 3, 4, 5, 6, 7, 8, 9, 10, 11, 12, 13, 14, 15, 16, 17, 18, 19 or 20 or more consecutive nucleotides relative to a reference gNA. In some embodiments, the gNA variant comprises 2, 3, 4, 5, 6, 7, 8, 9, 10, 11, 12, 13, 14, 15, 16, 17, 18, 19 or 20 or more nucleotide deletions relative to the reference gNA, and the deletions are not in consecutive nucleotides. In those embodiments where there are two or more non-consecutive deletions in the gNA variant relative to the reference gRNA, any length of deletions, and any combination of lengths of deletions, as described herein, are contemplated as within the scope of the disclosure. In some embodiments, a gNA variant comprises at least two deletions in different regions of the reference gRNA. In some embodiments, a gNA variant comprises at least two deletions in the same region of the reference gRNA. For example, the regions may be the extended stem loop, scaffold stem loop, scaffold stem bubble, triplex loop, pseudoknot, triplex, or a 5' end of the gNA variant. The deletion of any nucleotide in a reference gRNA is contemplated as within the scope of the disclosure.

In some embodiments, the at least one nucleotide modification of a reference gRNA to generate a gNA variant comprises at least one nucleotide insertion. In some embodiments, a gNA variant comprises an insertion of 1, 2, 3, 4, 5, 6, 7, 8, 9 or 10 consecutive or non-consecutive nucleotides relative to a reference gRNA. In some embodiments, the at least one nucleotide insertion comprises an insertion of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more insertions relative to the reference gRNA, and the insertions are not consecutive. In those embodiments where there are two or more non-consecutive insertions in the gNA variant relative to the reference gRNA, any length of insertions, and any combination of lengths of insertions, as described herein, are contemplated as within the scope of the disclosure. For example, in some embodiments, a gNA variant may comprise a first insertion of one nucleotide, and a second insertion of two nucleotides and the two insertions are not consecutive. In some embodiments, a gNA variant comprises at least two insertions in different regions of the reference gRNA. In some embodiments, a gNA variant comprises at least two insertions in the same region of the reference gRNA. For example, the regions may be the extended stem loop, scaffold stem loop, scaffold stem bubble, triplex loop, pseudoknot, triplex, or a 5' end of the gNA variant. Any insertion of A, G, C, U (or T, in the corresponding DNA) or combinations thereof at any location in the reference gRNA is contemplated as within the scope of the disclosure.

In some embodiments, the at least one nucleotide modification of a reference gRNA to generate a gNA variant comprises at least one nucleic acid substitution. In some embodiments, a gNA variant comprises 1, 2, 3, 4, 5, 6, 7, 8, 9, 10, 11, 12, 13, 14, 15, 16, 17, 18, 19 or 20 or more consecutive or non-consecutive substituted nucleotides relative to a reference gRNA. In some embodiments, a gNA variant comprises 1-4 nucleotide substitutions relative to a reference gRNA. In some embodiments, the at least one substitution comprises a substitution of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more substitutions relative to the reference gRNA, and the substitutions are not consecutive. In those embodiments where there are two or more non-consecutive substitutions in the gNA variant relative to the reference gRNA, any length of substituted nucleotides, and any combination of lengths of substituted nucleotides, as described herein, are contemplated as within the scope of the disclosure. For example, in some embodiments, a gNA variant may comprise a first substitution of one nucleotide, and a second substitution of two nucleotides and the two substitutions are not consecutive. In some embodiments, a gNA variant comprises at least two substitutions in different regions of the reference gRNA. In some embodiments, a gNA variant comprises at least two substitutions in the same region of the reference gRNA. For example, the regions may be the triplex, the extended stem loop, scaffold stem loop, scaffold stem bubble, triplex loop, pseudoknot, triplex, or a 5' end of the gNA variant. Any substitution of A, G, C. U (or T, in the corresponding DNA) or combinations thereof at any location in the reference gRNA is contemplated as within the scope of the disclosure.

Any of the substitutions, insertions and deletions described herein can be combined to generate a gNA variant of the disclosure. For example, a gNA variant can comprise at least one substitution and at least one deletion relative to a reference gRNA, at least one substitution and at least one insertion relative to a reference gRNA, at least one insertion and at least one deletion relative to a reference gRNA, or at least one substitution, one insertion and one deletion relative to a reference gRNA.

In some embodiments, the gNA variant comprises a scaffold region at least 20% identical, at least 30% identical, at least 40% identical, at least 50% identical, at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to any one of SEQ ID NOS:4-16. In some embodiments, the gNA variant comprises a scaffold region at least 60% homologous (or identical) to any one of SEQ ID NOS:4-16.

In some embodiments, the gNA variant comprises a tracr stem loop at least 60% identical, at least 65% identical, at least 70% identical, at least 75% identical, at least 80% identical, at least 85% identical, at least 90% identical, or at least 95% identical to SEQ ID NO:14. In some embodiments, the gNA variant comprises a tracr stem loop at least 60% homologous (or identical) to SEQ ID NO:14.

In some embodiments, the gNA variant comprises an extended stem loop at least 60% identical, at least 65% identical, at least 70% identical, at least 75% identical, at least 80% identical, at least 85% identical, at least 90% identical, or at least 95% identical to SEQ ID NO:15. In some embodiments, the gNA variant comprises an extended stem loop at least 60% homologous (or identical) to SEQ ID NO:15.

In some embodiments, the gNA variant comprises an exogenous extended stem loop, with such differences from a reference gNA described as follows. In some embodiments, an exogenous extended stem loop has little or no identity to the reference stem loop regions disclosed herein (e.g., SEQ ID NO:15). In some embodiments, an exogenous stem loop is at least 10 bp, at least 20 bp, at least 30 bp, at least 40 bp, at least 50 bp, at least 60 bp, at least 70 bp, at least 80 bp, at least 90 bp, at least 100 bp, at least 200 bp, at least 300 bp, at least 400 bp, at least 500 bp, at least 600 bp, at least 700 bp, at least 800 bp, at least 900 bp, at least 1,000 bp, at least 2,000 bp, at least 3,000 bp, at least 4,000 bp, at least 5,000 bp, at least 6,000 bp, at least 7,000 bp, at least 8,000 bp, at least 9,000 bp, at least 10,000 bp, at least 12,000 bp, at least 15,000 bp or at least 20,000 bp. In some embodiments, the gNA variant comprises an extended stem loop region comprising at least 10, at least 100, at least 500, at least 1000, or at least 10,000 nucleotides. In some embodiments, the heterologous stem loop increases the stability of the gNA. In some embodiments, the heterologous RNA stem loop is capable of binding a protein, an RNA structure, a DNA sequence, or a small molecule. In some embodiments, an exogenous stem loop region replacing the stem loop comprises an RNA stem loop or hairpin in which the resulting gNA has increased stability and, depending on the choice of loop, can interact with certain cellular proteins or RNA. Such exogenous extended stem loops can comprise, for example a thermostable RNA such as MS2 (ACAUGAGGAUUACCCAUGU (SEQ ID NO: 35)), Qβ (UGCAUGUCUAAGACAGCA (SEQ ID NO: 36)), U1 hairpin II (AAUCCAUUGCACUCCGGAUU (SEQ ID NO: 37)), Uvsx (CCUCUUCGGAGG (SEQ ID NO: 38)), PP7 (AGAAGUUUCUAUGGAAACCCU (SEQ ID NO: 39)), Phage replication loop (AGGUGGGACGACCUCUCGGU-CGUCCUAUCU (SEQ ID NO: 40)), Kissing loop_a (UG-CUCGCUCCGUUCGAGCA (SEQ ID NO: 41)), Kissing loop_b1 (UGCUCGACGCGUCCUCGAGCA (SEQ ID NO: 42)), Kissing loop_b2 (UGCUCGUUUGCGGC-UACGAGCA (SEQ ID NO: 43)), G quadriplex M3q (AGG-GAGGGAGGGAGAGG (SEQ ID NO: 44)), G quadriplex telomere basket (GGUUAGGGUUAGGGUUAGG (SEQ ID NO: 45)), Sarcin-ricin loop (CUGCUC-AGUACGAGAGGAACCGCAG (SEQ ID NO: 46)) or Pseudoknots

```
                                    (SEQ ID NO: 47))
(UACACUGGGAUCGCUGAAUUAGAGAUCGGCGUCCUUUCAUUCUAUAU

ACUUUGGAGUUUUAAAAUGUCUCUAAGUACA).
```

In some embodiments, an exogenous stem loop comprises a long non-coding RNA (lncRNA). As used herein, a lncRNA refers to a non-coding RNA that is longer than approximately 200 bp in length. In some embodiments, the 5' and 3' ends of the exogenous stem loop are base paired; i.e., interact to form a region of duplex RNA. In some embodiments, the 5' and 3' ends of the exogenous stem loop are base paired, and one or more regions between the 5' and 3' ends of the exogenous stem loop are not base paired. In some embodiments, the at least one nucleotide modification comprises: (a) substitution of 1 to 15 consecutive or non-consecutive nucleotides in the gNA variant in one or more regions; (b) a deletion of 1 to 10 consecutive or non-consecutive nucleotides in the gNA variant in one or more regions; (c) an insertion of 1 to 10 consecutive or non-consecutive nucleotides in the gNA variant in one or more regions; (d) a substitution of the scaffold stem loop or the extended stem loop with an RNA stem loop sequence from a heterologous RNA source with proximal 5' and 3 ends; or any combination of (a)-(d).

In some embodiments, the gNA variant comprises a scaffold stem loop sequence of CCAGCGACUAUGU-CGUAGUGG (SEQ ID NO: 32). In some embodiments, the gNA variant comprises a scaffold stem loop sequence of CCAGCGACUAUGUCGUAGUGG (SEQ ID NO: 32) with at least 1, 2, 3, 4, or 5 mismatches thereto.

In some embodiments, the gNA variant comprises an extended stem loop region comprising less than 32 nucleotides, less than 31 nucleotides, less than 30 nucleotides, less than 29 nucleotides, less than 28 nucleotides, less than 27 nucleotides, less than 26 nucleotides, less than 25 nucleotides, less than 24 nucleotides, less than 23 nucleotides, less than 22 nucleotides, less than 21 nucleotides, or less than 20 nucleotides. In some embodiments, the gNA variant comprises an extended stem loop region comprising less than 32 nucleotides. In some embodiments, the gNA variant further comprises a thermostable stem loop.

In some embodiments, a sgRNA variant comprises a sequence of SEQ ID NO:2104, SEQ ID NO:2106, SEQ ID NO:2163, SEQ ID NO:2107, SEQ ID NO:2164, SEQ ID NO:2165, SEQ ID NO:2166, SEQ ID NO:2103, SEQ ID NO:2167, SEQ ID NO:2105, SEQ ID NO:2108, SEQ ID NO:2112, SEQ ID NO:2160, SEQ ID NO:2170, SEQ ID NO:2114, SEQ ID NO:2171, SEQ ID NO:2112, SEQ ID NO:2173, SEQ ID NO:2102, SEQ ID NO:2174, SEQ ID NO:2175, SEQ ID NO:2109, SEQ ID NO:2176, SEQ ID NO:2238, SEQ ID NO:2239, SEQ ID NO:2240, SEQ ID NO:2241, SEQ ID NO:2274, SEQ ID NO:2275, or 2279.

In some embodiments, the gNA variant comprises the sequence of any one of SEQ ID NOS:2236, 2237, 2238, 2241, 2244, 2248, 2249, or 2259-2285, or having at least about 80%, at least about 90%, at least about 95%, at least about 96%, at least about 97%, at least about 98%, at least about 99% identity thereto. In some embodiments, the gNA variant comprises one or more additional changes to a sequence of any one of SEQ ID NOs: 2201-2285. In some embodiments, the gNA variant comprises the sequence of any one of SEQ ID NOS:2236, 2237, 2238, 2241, 2244, 2248, 2249, or 2259-2285. In some embodiments, the gNA variant scaffold consists of the sequence of any one of SEQ ID NOS:2236, 2237, 2238, 2241, 2244, 2248, 2249, or 2259-2285, and further comprises a targeting sequence of any of the embodiments described herein.

In some embodiments, a sgRNA variant comprises one or more additional changes to a sequence of SEQ ID N0:2104, SEQ ID NO:2163, SEQ ID NO:2107, SEQ ID NO:2164, SEQ ID NO:2165, SEQ ID NO:2166, SEQ ID NO:2103, SEQ ID NO:2167, SEQ ID NO:2105, SEQ ID NO:2108, SEQ ID NO:2112, SEQ ID NO:2160, SEQ ID NO:2170. SEQ ID NO:2114. SEQ ID NO:2171, SEQ ID NO:2112, SEQ ID NO:2173, SEQ ID NO:2102, SEQ ID NO:2174, SEQ ID NO:2175, SEQ ID NO:2109, SEQ ID NO:2176, SEQ ID NO:2238, SEQ ID NO:2239, SEQ ID NO:2240, SEQ ID NO:2241, SEQ ID NO:2274, SEQ ID NO:2275, or 2279.

In some embodiments of the gNA variants of the disclosure, the gNA variant comprises at least one modification, wherein the at least one modification compared to the reference guide scaffold of SEQ ID NO:5 is selected from one or more of: (a) a C18G substitution in the triplex loop; (b) a G55 insertion in the stem bubble; (c) a U1 deletion; (d) a modification of the extended stem loop wherein (i) a 6 nt loop and 13 loop-proximal base pairs are replaced by a Uvsx hairpin; and (ii) a deletion of A99 and a substitution of G65U that results in a loop-distal base that is fully base-paired. In such embodiments, the gNA variant comprises the sequence of any one of SEQ ID NOS:2236, 2237, 2238, 2241, 2244, 2248, 2249, or 2259-2285.

In the embodiments of the gNA variants, the gNA variant further comprises a targeting sequence (or spacer) region located at the 3' end of the gNA, described more fully, supra, which comprises at least 14 to about 35 nucleotides wherein the targeting sequence is designed with a sequence that is complementary to a target nucleic acid of the RHO gene, including wild-type and sequences having one or more mutations. In some embodiments, the gNA variant comprises a targeting sequence of at least 10 to 30 nucleotides complementary to a target nucleic acid. In some embodiments, the targeting sequence has 14, 15, 16, 17, 18, 19, 20, 21, 22, 23, 24, 25, 26, 27, 28, 29, 30, 31, 32, 33, 34 or 35 nucleotides. In some embodiments, the gNA variant comprises a targeting sequence having 20 nucleotides. In some embodiments, the targeting sequence has 25 nucleotides. In some embodiments, the targeting sequence has 24 nucleotides. In some embodiments, the targeting sequence has 23 nucleotides. In some embodiments, the targeting sequence has 22 nucleotides. In some embodiments, the targeting sequence has 21 nucleotides. In some embodiments, the targeting sequence has 19 nucleotides. In some embodiments, the targeting sequence has 18 nucleotides. In some embodiments, the targeting sequence has 17 nucleotides. In some embodiments, the targeting sequence has 16 nucleotides. In some embodiments, the targeting sequence has 15 nucleotides.

In some embodiments, the targeting sequence of a gNA is complementary to a RHO exon selected from the group consisting of exons 1-5. In other embodiments, the targeting sequence of a gNA is specific for a RHO intronic region, an intron-exon junction of the RHO gene, or an intergenic region. In some embodiments, the targeting sequence of the gNA is complementary to a sequence comprising one or more single nucleotide polymorphisms (SNPs) of the RHO gene or its complement. SNPs that are within a RHO coding sequence or within a RHO non-coding sequence are both within the scope of the instant disclosure. Representative targeting sequences to rhodopsin mutations known or believed to be associated with retinitis pigmentosa and related disorders and that are designed to be utilized in the CasX:gNA systems of the disclosure comprise a sequence of SEQ ID NOS. 382-582, or a sequence that is at least 50% identical, at least 55% identical, at least 60% identical, at least 65% identical, at least 70% identical, at least 75% identical, at least 80% identical, at least 85% identical, at least 90% identical, at least 95% identical thereto. In other embodiments, the disclosure provides targeting sequences for inclusion in the gNA variants of the disclosure comprising a sequence that is at least 50% identical, at least 55% identical, at least 60% identical, at least 65% identical, at least 70% identical, at least 75% identical, at least 80% identical, at least 85% identical, at least 90% identical, at least 95% identical, or 100° % identical to a sequence of SEQ ID NOs: 328-346, 367-376, 382-2100 and 2286-27274. In some embodiments, the targeting sequence of the gNA variant comprises a sequence a sequence of SEQ ID NOs: 328-346, 367-376, 382-2100 and 2286-27274 with a single nucleotide removed from the 3' end of the sequence. In other embodiments, the targeting sequence of the gNA variant comprises a sequence a sequence of SEQ ID NOs: 328-346, 367-376, 382-2100 and 2286-27274 with two nucleotides removed from the 3' end of the sequence. In other embodiments, the targeting sequence of the gNA variant comprises a sequence a sequence of SEQ ID NOs: 328-346, 367-376, 382-2100 and 2286-27274 with three nucleotides removed from the 3' end of the sequence. In other embodiments, the targeting sequence of the gNA variant comprises a sequence a sequence of SEQ ID NOs: 328-346, 367-376, 382-2100 and 2286-27274 with four nucleotides removed from the 3' end of the sequence. In other embodiments, the targeting sequence of the gNA variant comprises a sequence a sequence of SEQ ID NOs: 328-346, 367-376, 382-2100 and 2286-27274 with five nucleotides removed from the 3' end of the sequence. In some embodiments, the targeting sequence of the gNA variant comprises a sequence a sequence of SEQ ID NOs: 382-582 with a single nucleotide removed from the 3' end of the sequence. In other embodiments, the targeting sequence of the gNA variant comprises a sequence a sequence of SEQ ID NOs: 382-582 with two nucleotides removed from the 3' end of the sequence. In other embodiments, the targeting sequence of the gNA variant comprises a sequence a sequence of SEQ ID NOs: 382-582 with three nucleotides removed from the 3' end of the sequence. In other embodiments, the targeting sequence of the gNA variant comprises a sequence a sequence of SEQ ID NOs: 382-582 with four nucleotides removed from the 3' end of the sequence. In other embodiments, the targeting sequence of the gNA variant comprises a sequence a sequence of SEQ ID NOs: 382-582 with five nucleotides removed from the 3' end of the sequence.

In some embodiments, the gNA variant further comprises a targeting sequence region located at the 3' end of the gNA, wherein the targeting sequence is designed with a sequence that is complementary to a target nucleic acid. In some embodiments, the target nucleic acid comprises a PAM sequence located 5' of the targeting sequence with at least a single nucleotide separating the PAM from the first nucleotide of the targeting sequence. In some embodiments, the PAM is located on the non-targeted strand of the target region, i.e. the strand that is complementary to the target nucleic acid. In some embodiments, the PAM sequence is ATC. In some embodiments, the targeting sequence for an ATC PAM comprises SEQ ID NOs: 583-2100 or 2286-5554, or a sequence that is at least 50% identical, at least 55% identical, at least 60% identical, at least 65% identical, at least 70% identical, at least 75% identical, at least 80% identical, at least 85% identical, at least 90% identical, at least 95% identical, or at least 99% identical to SEQ ID NOs: 583-2100 or 2286-5554. In some embodiments, the targeting sequence for an ATC PAM is selected from the group consisting of SEQ ID NOs: 583-2100 or 2286-5554. In some embodiments, the PAM sequence is CTC. In some embodiments, the targeting sequence for a CTC PAM comprises SEQ ID NOs: 367-369, 372, or 10487-19917 or a sequence that is at least 50% identical, at least 55% identical, at least 60% identical, at least 65% identical, at least 70% identical, at least 75% identical, at least 80% identical, at least 85% identical, at least 90% identical, at least 95% identical, or at least 99% identical to SEQ ID NOs: 367-369, 372, or 10487-19917. In some embodiments, the targeting sequence for a CTC PAM is selected from the group consisting of SEQ ID NOs: 367-369, 372, or 10487-19917. In some embodiments, the PAM sequence is GTC. In some embodiments, the targeting sequences for a GTC PAM comprises SEQ ID NOs: 5555-10486 or a sequence that is at least 50% identical, at least 55% identical, at least 60% identical, at least 65% identical, at least 70% identical, at least 75% identical, at least 80% identical, at least 85% identical, at least 90% identical, at least 95% identical, or at least 99% identical to SEQ ID NOs: 5555-10486. In some embodiments, the targeting sequence for a GTC PAM is selected from the group consisting of SEQ ID NOs: 5555-10486. In some embodiments, the PAM sequence is TTC. In some embodiments, a targeting sequences for a TTC PAM comprises SEQ ID NOs: 370-371, 373-376, 19918-27274, or a sequence that is at least 50% identical, at least 55% identical, at least 60% identical, at least 65% identical, at least 70% identical, at least 75% identical, at least 80% identical, at least 85% identical, at least 90% identical, at least 95% identical, or at least 99% identical to SEQ ID NOs: 370-371, 373-376, or 19918-27274. In some embodiments, a targeting sequence for a TTC PAM is selected from the group consisting of SEQ ID NOs: 370-371, 373-376, or 19918-27274.

In some embodiments, the scaffold of the gNA variant is part of an RNP with a CasX variant protein comprising any one of the sequences of SEQ ID NOS: 49-160, 237-239, 243-246, 251-263 or 273-281 as set forth in Tables 3, 6, 7, 8, or 10 or a sequence having at least about 50%, at least about 60%, at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% identity thereto. In the foregoing embodiments, the gNA further comprises a targeting sequence.

In some embodiments, the scaffold of the gNA variant is a variant comprising one or more additional changes to a sequence of a reference gRNA that comprises SEQ ID NO:4 or SEQ ID NO:5. In those embodiments where the scaffold of the reference gRNA is derived from SEQ ID NO:4 or SEQ ID NO:5, the one or more improved or added characteristics of the gNA variant are improved compared to the same characteristic in SEQ ID NO:4 or SEQ ID NO:5.

h. Complex Formation with CasX Protein

In some embodiments, a gNA variant has an improved ability to form a complex with a CasX protein (such as a reference CasX or a CasX variant protein) when compared to a reference gRNA. In some embodiments, a gNA variant has an improved affinity for a CasX protein (such as a reference or variant protein) when compared to a reference gRNA, thereby improving its ability to form a ribonucleoprotein (RNP) complex with the CasX protein, as described in the Examples. Improving ribonucleoprotein complex formation may, in some embodiments, improve the efficiency with which functional RNPs are assembled. In some embodiments, greater than 90%, greater than 93%, greater than 95%, greater than 96%, greater than 97%, greater than 98% or greater than 99% of RNPs comprising a gNA variant and its targeting sequence are competent for gene editing of a target nucleic acid.

Exemplary nucleotide changes that can improve the ability of gNA variants to form a complex with CasX protein may, in some embodiments, include replacing the scaffold stem with a thermostable stem loop. Without wishing to be bound by any theory, replacing the scaffold stem with a thermostable stem loop could increase the overall binding stability of the gNA variant with the CasX protein. Alternatively, or in addition, removing a large section of the stem loop could change the gNA variant folding kinetics and make a functional folded gNA easier and quicker to structurally-assemble, for example by lessening the degree to which the gNA variant can get "tangled" in itself. In some embodiments, choice of scaffold stem loop sequence could change with different targeting sequences that are utilized for the gNA. In some embodiments, scaffold sequence can be tailored to the targeting sequence and therefore the target sequence. Biochemical assays can be used to evaluate the binding affinity of CasX protein for the gNA variant to form the RNP, including the assays of the Examples. For example, a person of ordinary skill can measure changes in the amount of a fluorescently tagged gNA that is bound to an immobilized CasX protein, as a response to increasing concentrations of an additional unlabeled "cold competitor" gNA. Alternatively, or in addition, fluorescence signal can be monitored to or seeing how it changes as different amounts of fluorescently labeled gNA are flowed over immobilized CasX protein. Alternatively, the ability to form an RNP can be assessed using in vitro cleavage assays against a defined target nucleic acid sequence.

i. gNA Stability

In some embodiments, a gNA variant has improved stability when compared to a reference gRNA. Increased stability and efficient folding may, in some embodiments, increase the extent to which a gNA variant persists inside a target cell, which may thereby increase the chance of forming a functional RNP capable of carrying out CasX functions such as gene editing. Increased stability of gNA variants may also, in some embodiments, allow for a similar outcome with a lower amount of gNA delivered to a cell, which may in turn reduce the chance of off-target effects during gene editing. Guide RNA stability can be assessed in a variety of ways, including for example in vitro by assembling the guide, incubating for varying periods of time in a solution that mimics the intracellular environment, and then measuring functional activity via the in vitro cleavage assays described herein. Alternatively. or in addition, gNAs can be harvested from cells at varying time points after initial transfection/transduction of the gNA to determine how long gNA variants persist relative to reference gRNAs.

j. Solubility

In some embodiments, a gNA variant has improved solubility when compared to a reference gRNA. In some embodiments, a gNA variant has improved solubility of the CasX protein:gNA RNP when compared to a reference gRNA. In some embodiments, solubility of the CasX protein:gNA RNP is improved by the addition of a ribozyme sequence to a 5' or 3' end of the gNA variant, for example the 5' or 3' of a reference sgRNA. Some ribozymes, such as the M1 ribozyme, can increase solubility of proteins through RNA mediated protein folding. Increased solubility of CasX RNPs comprising a gNA variant as described herein can be evaluated through a variety of means known to one of skill in the art, such as by taking densitometry readings on a gel of the soluble fraction of lysed *E. coli* in which the CasX and gNA variants are expressed.

k. Resistance to Nuclease Activity

In some embodiments, a gNA variant has improved resistance to nuclease activity compared to a reference gRNA that may, for example, increase the persistence of a variant gNA in an intracellular environment, thereby improving gene editing. Resistance to nuclease activity may be evaluated through a variety of methods known to one of skill in the art. For example, in vitro methods of measuring resistance to nuclease activity may include for example contacting reference gNA and variants with one or more exemplary RNA nucleases and measuring degradation. Alternatively, or in addition, measuring persistence of a gNA variant in a cellular environment using the methods described herein can indicate the degree to which the gNA variant is nuclease resistant.

l. Binding Affinity to a Target DNA

In some embodiments, a gNA variant has improved affinity for the target DNA relative to a reference gRNA. In certain embodiments, a ribonucleoprotein complex comprising a gNA variant has improved affinity for the target DNA, relative to the affinity of an RNP comprising a reference gRNA. In some embodiments, the improved affinity of the RNP for the target DNA comprises improved affinity for the target sequence, improved affinity for the PAM sequence, improved ability of the RNP to search DNA for the target sequence, or any combinations thereof. In some embodiments, the improved affinity for the target DNA is the result of increased overall DNA binding affinity.

Without wishing to be bound by theory, it is possible that nucleotide changes in the gNA variant that affect the function of the OBD in the CasX protein may increase the affinity of CasX variant protein binding to the protospacer adjacent motif (PAM), as well as the ability to bind or utilize an increased spectrum of PAM sequences other than the canonical TTC PAM recognized by the reference CasX protein of SEQ ID NO:2, including PAM sequences selected from the group consisting of TTC, ATC, GTC, and CTC, thereby increasing the affinity and diversity of the CasX variant protein for target DNA sequences, resulting in a substantial increase in the target nucleic acid sequences that can be edited and/or bound, compared to a reference CasX. As described more fully, below, increasing the sequences of the target nucleic acid that can be edited, compared to a reference CasX, refers to both the PAM and the protospacer sequence and their directionality according to the orientation of the non-target strand. This does not imply that the PAM sequence of the non-target strand, rather than the target strand, is determinative of cleavage or mechanistically involved in target recognition. For example, when reference is to a TTC PAM, it may in fact be the complementary GAA sequence that is required for target cleavage, or it may be some combination of nucleotides from both strands. In the case of the CasX proteins disclosed herein, the PAM is located 5' of the protospacer with at least a single nucleotide separating the PAM from the first nucleotide of the protospacer. Alternatively, or in addition, changes in the gNA that affect function of the helical I and/or helical II domains that increase the affinity of the CasX variant protein for the target DNA strand can increase the affinity of the CasX RNP comprising the variant gNA for target DNA.

m. Adding or Changing gNA Function

In some embodiments, gNA variants can comprise larger structural changes that change the topology of the gNA variant with respect to the reference gRNA, thereby allowing for different gNA functionality. For example, in some embodiments a gNA variant has swapped an endogenous stem loop of the reference gRNA scaffold with a previously identified stable RNA structure or a stem loop that can interact with a protein or RNA binding partner to recruit additional moieties to the CasX or to recruit CasX to a specific location, such as the inside of a viral capsid, that has the binding partner to the said RNA structure. In other scenarios the RNAs may be recruited to each other, as in Kissing loops, such that two CasX proteins can be co-localized for more effective gene editing at the target DNA sequence. Such RNA structures may include MS2, Qβ, U1 hairpin II, Uvsx, PP7, Phage replication loop, Kissing loop_a. Kissing loop_b1, Kissing loop_b2, G quadriplex M3q, G quadriplex telomere basket, Sarcin-ricin loop, or a Pseudoknot.

In some embodiments, a gNA variant comprises a terminal fusion partner. Exemplary terminal fusions may include fusion of the gRNA to a self-cleaving ribozyme or protein binding motif. As used herein, a "ribozyme" refers to an RNA or segment thereof with one or more catalytic activities similar to a protein enzyme. Exemplary ribozyme catalytic activities may include, for example, cleavage and/or ligation of RNA, cleavage and/or ligation of DNA, or peptide bond formation. In some embodiments, such fusions could either improve scaffold folding or recruit DNA repair machinery. For example, a gRNA may in some embodiments be fused to a hepatitis delta virus (HDV) antigenomic ribozyme, HDV genomic ribozyme, hatchet ribozyme (from metagenomic data), env25 pistol ribozyme (representative from Aliistipes putredinis), HH15 Minimal Hammerhead ribozyme, tobacco ringspot virus (TRSV) ribozyme, WT viral Hammerhead ribozyme (and rational variants), or Twisted Sister 1 or RBMX recruiting motif. Hammerhead ribozymes are RNA motifs that catalyze reversible cleavage and ligation reactions at a specific site within an RNA molecule. Hammerhead ribozymes include type I, type II and type III hammerhead ribozymes. The HDV, pistol, and hatchet ribozymes have self-cleaving activities, gNA variants comprising one or more ribozymes may allow for expanded gNA function as compared to a gRNA reference. For example, gNAs comprising self-cleaving ribozymes can, in some embodiments, be transcribed and processed into mature gNAs as part of polycistronic transcripts. Such fusions may occur at either the 5' or the 3' end of the gNA. In some embodiments, a gNA variant comprises a fusion at both the 5' and the 3' end, w % herein each fusion is independently as described herein. In some embodiments, a gNA variant comprises a phage replication loop or a tetraloop. In some embodiments, a gNA comprises a hairpin loop that is capable of binding a protein. For example, in some embodiments the hairpin loop is an MS2, Qβ, U1 hairpin II, Uvsx, or PP7 hairpin loop.

In some embodiments, a gNA variant comprises one or more RNA aptamers. As used herein, an "RNA aptamer" refers to an RNA molecule that binds a target with high affinity and high specificity. In some embodiments, a gNA variant comprises one or more riboswitches. As used herein, a "riboswitch" refers to an RNA molecule that changes state upon binding a small molecule. In some embodiments, the gNA variant further comprises one or more protein binding motifs. Adding protein binding motifs to a reference gRNA or gNA variant of the disclosure may, in some embodiments, allow a CasX RNP to associate with additional proteins, which can, for example, add the functionality of those proteins to the CasX RNP.

n. Chemically Modified gNA

In some embodiments, the disclosure relates to chemically-modified gNA. In some embodiments, the present disclosure provides a chemically-modified gNA that has guide RNA functionality and has reduced susceptibility to cleavage by a nuclease. A gNA that comprises any nucleotide other than the four canonical ribonucleotides A, C, G, and U, or a deoxynucleotide, is a chemically modified gNA. In some cases, a chemically-modified gNA comprises any backbone or internucleotide linkage other than a natural phosphodiester internucleotide linkage. In certain embodiments, the retained functionality includes the ability of the modified gNA to bind to a CasX of any of the embodiments described herein. In certain embodiments, the retained functionality includes the ability of the modified gNA to bind to a target nucleic acid sequence. In certain embodiments, the retained functionality includes targeting a CasX protein or the ability of a pre-complexed CasX protein-gNA to bind to a target nucleic acid sequence. In certain embodiments, the retained functionality includes the ability to nick a target polynucleotide by a CasX-gNA. In certain embodiments, the retained functionality includes the ability to cleave a target nucleic acid sequence by a CasX-gNA. In certain embodiments, the retained functionality is any other known function of a gNA in a CasX system with a CasX protein of the embodiments of the disclosure.

In some embodiments, the disclosure provides a chemically-modified gNA in which a nucleotide sugar modification is incorporated into the gNA selected from the group consisting of 2'-O—$C_{1-4}$alkyl such as 2'-O-methyl (2'-OMe), 2'-deoxy (2'-H), 2'-O—$C_{1-3}$alkyl-O—$C_{1-3}$alkyl such as 2'-methoxyethyl ("2'-MOE"), 2'-fluoro ("2'-F"), 2'-amino ("2'-NH$_2$"), 2'-arabinosyl ("2'-arabino") nucleotide, 2-F-arabinosyl ("2'-F-arabino") nucleotide, 2'-locked nucleic acid ("LNA") nucleotide, 2'-unlocked nucleic acid ("ULNA") nucleotide, a sugar in L form ("L-sugar"), and 4'-thioribosyl nucleotide. In other embodiments, an internucleotide linkage modification incorporated into the guide RNA is selected from the group consisting of: phosphorothioate "P(S)" (P(S)), phosphonocarboxylate (P(CH$_2$)$_n$COOR) such as phosphonoacetate "PACE" (P(CH$_2$COO—)), thio-phosphonocarboxylate ((S)P(CH$_2$)$_n$COOR) such as thio-phosphonoacetate "thioPACE" ((S)P(CH$_2$)$_n$COO—)), alkylphosphonate (P(C$_{1-3}$alkyl) such as methylphosphonate —P(CH$_3$), boranophosphonate (P(BH$_3$)), and phosphorodithioate (P(S)$_2$).

In certain embodiments, the disclosure provides a chemically-modified gNA in which a nucleobase ("base") modification is incorporated into the gNA selected from the group consisting of: 2-thiouracil ("2-thioU"), 2-thiocytosine ("2-thioC"), 4-thiouracil ("4-thioU"), 6-thioguanine ("6-thioG"), 2-aminoadenine ("2-aminoA"), 2-aminopurine, pseudouracil, hypoxanthine, 7-deazaguanine, 7-deaza-8-azaguanine, 7-deazaadenine, 7-deaza-8-azaadenine, 5-methylcytosine ("5-methylC"), 5-methyluracil ("5-methylU"), 5-hydroxymethylcytosine, 5-hydroxymethyluracil, 5,6-dihydrouracil, 5-propynylcytosine, 5-propynyluracil, 5-ethynylcytosine, 5-ethynyluracil, 5-allyluracil ("5-allylU"), 5-allylcytosine ("5-allylC"), 5-aminoallyluracil ("5-aminoallylU"), 5-aminoallyl-cytosine ("5-aminoallylC"), an abasic nucleotide, Z base, P base, Unstructured Nucleic Acid ("UNA"), isoguanine ("isoG"), isocytosine ("isoC"), 5-methyl-2-pyrimidine, x(A,G,C,T) and y(A,G,C,T).

In other embodiments, the disclosure provides a chemically-modified gNA in which one or more isotopic modifications are introduced on the nucleotide sugar, the nucleobase, the phosphodiester linkage and/or the nucleotide phosphates, including nucleotides comprising one or more $^{15}$N, $^{13}$C, $^{14}$C, deuterium, $^3$H, $^{32}$P, $^{125}$I, $^{131}$I atoms or other atoms or elements used as tracers.

In some embodiments, an "end" modification incorporated into the gNA is selected from the group consisting of: PEG (polyethyleneglycol), hydrocarbon linkers (including: heteroatom (O,S,N)-substituted hydrocarbon spacers; halo-substituted hydrocarbon spacers; keto-, carboxyl-, amido-, thionyl-, carbamoyl-, thionocarbamaoyl-containing hydrocarbon spacers), spermine linkers, dyes including fluorescent dyes (for example fluoresceins, rhodamines, cyanines) attached to linkers such as for example 6-fluorescein-hexyl, quenchers (for example dabcyl, BHQ) and other labels (for example biotin, digoxigenin, acridine, streptavidin, avidin, peptides and/or proteins). In some embodiments, an "end" modification comprises a conjugation (or ligation) of the gNA to another molecule comprising an oligonucleotide of deoxynucleotides and/or ribonucleotides, a peptide, a protein, a sugar, an oligosaccharide, a steroid, a lipid, a folic acid, a vitamin and/or other molecule. In certain embodiments, the disclosure provides a chemically-modified gNA in which an "end" modification (described above) is located internally in the gNA sequence via a linker such as, for example, a 2-(4-butylamidofluorescein)propane-1,3-diol bis (phosphodiester) linker, which is incorporated as a phosphodiester linkage and can be incorporated anywhere between two nucleotides in the gNA.

In some embodiments, the disclosure provides a chemically-modified gNA having an end modification comprising a terminal functional group such as an amine, a thiol (or sulflhydryl), a hydroxyl, a carboxyl, carbonyl, thionyl, thiocarbonyl, a carbamoyl, a thiocarbamoyl, a phoshoryl, an alkene, an alkyne, an halogen or a functional group-terminated linker that can be subsequently conjugated to a desired moiety selected from the group consisting of a fluorescent dye, a non-fluorescent label, a tag (for $^{14}$C, example biotin, avidin, streptavidin, or moiety containing an isotopic label such as $^{15}$N, $^{13}$C, deuterium, $^3$H, $^{32}$P, $^{125}$I and the like), an oligonucleotide (comprising deoxynucleotides and/or ribonucleotides, including an aptamer), an amino acid, a peptide, a protein, a sugar, an oligosaccharide, a steroid, a lipid, a folic acid, and a vitamin. The conjugation employs standard chemistry well-known in the art, including but not limited to coupling via N-hydroxysuccinimide, isothiocyanate, DCC (or DCI), and/or any other standard method as described in "Bioconjugate Techniques" by Greg T. Hermanson, Publisher Eslsevier Science, $3^{rd}$ed. (2013), the contents of which are incorporated herein by reference in its entirety.

IV. Proteins for Modifying a Target Nucleic Acid

The present disclosure provides systems comprising a CRISPR nuclease that have utility in genome editing of eukaryotic cells. In some embodiments, the CRISPR nuclease employed in the genome editing systems is a Class 2, Type V nuclease. Although members of Class 2, Type V CRISPR-Cas systems have differences, they share some common characteristics that distinguish them from the Cas9 systems. Firstly, the Type V nucleases possess a single RNA-guided RuvC domain-containing effector but no HNH domain, and they recognize T-rich PAM 5' upstream to the target region on the non-targeted strand, which is different from Cas9 systems that rely on G-rich PAM at 3' side of target sequences. Type V nucleases generate staggered double-stranded breaks distal to the PAM sequence, unlike Cas9, which generates a blunt end in the proximal site close to the PAM. In addition. Type V nucleases degrade ssDNA in trans when activated by target dsDNA or ssDNA binding in cis. In some embodiments, the Type V nucleases of the embodiments recognize a 5'-TC PAM motif and produce staggered ends cleaved solely by the RuvC domain. In some embodiments, the Type V nuclease is selected from the group consisting of Cas12a, Cas12b, Cas12c, Cas12d (CasY), Cas12J, and CasX. In some embodiments, the present disclosure provides systems comprising a CasX protein and one or more gNA acids (CasX:gNA system) that are specifically designed to modify a target nucleic acid sequence in eukaryotic cells.

The term "CasX protein", as used herein, refers to a family of proteins, and encompasses all naturally occurring CasX proteins, proteins that share at least 50% identity to naturally occurring CasX proteins, as well as CasX variants exhibiting one or more improved characteristics relative to a naturally-occurring reference CasX protein.

Exemplary improved characteristics of the CasX variant embodiments include, but are not limited to improved folding of the variant, improved binding affinity to the gNA, improved binding affinity to the target nucleic acid, improved ability to utilize a greater spectrum of PAM sequences in the editing and/or binding of target DNA, improved unwinding of the target DNA, increased editing activity, improved editing efficiency, improved editing specificity, increased percentage of a eukaryotic genome that can be efficiently edited, increased activity of the nuclease, increased target strand loading for double strand cleavage, decreased target strand loading for single strand nicking, decreased off-target cleavage, improved binding of the non-target strand of DNA, improved protein stability, improved protein:gNA (RNP) complex stability, improved protein solubility, improved protein:gNA (RNP) complex solubility, improved protein yield, improved protein expression, and improved fusion characteristics, as described more fully, below. In some embodiments, the RNP of the CasX variant and the gNA variant exhibit one or more of the improved characteristics that are at least about 1.1 to about 100,000-fold improved relative to an RNP of the reference CasX protein of SEQ ID NO:1, SEQ ID NO:2, or SEQ ID NO:3 and the gNA of Table 1, when assayed in a comparable fashion. In other cases, the one or more improved characteristics of an RNP of the CasX variant and the gNA variant are at least about 1.1, at least about 10, at least about 100, at least about 1000, at least about 10.000, at least about 100,000-fold or more improved relative to an RNP of the reference CasX protein of SEQ ID NO:1, SEQ ID NO:2, or SEQ ID NO:3 and the gNA of Table 1. In other cases, the one or more of the improved characteristics of an RNP of the CasX variant and the gNA variant are about 1.1 to 100,000-fold, about 1.1 to 10,000-fold, about 1.1 to 1,000-fold, about 1.1 to 500-fold, about 1.1 to 100-fold, about 1.1 to 50-fold, about 1.1 to 20-fold, about 10 to 100,000-fold, about 10 to 10,000-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100.00-fold, about 100 to 10,000-fold, about 100 to 1,000-fold, about 100 to 500-fold, about 500 to 100,000-fold, about 500 to 10,000-fold, about 500 to 1,000-fold, about 500 to 750-fold, about 1,000 to 100,000-fold, about 10,000 to 100,000-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to an RNP of the reference CasX protein of SEQ ID NO:1, SEQ ID NO:2, or SEQ ID NO:3 and the gNA of Table 1, when assayed in a comparable fashion. In other cases, the one or more improved characteristics of an RNP of the CasX variant and the gNA variant are about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to an RNP of the reference CasX protein of SEQ ID NO:1, SEQ ID NO:2, or SEQ ID NO:3 and the gNA of Table 1, when assayed in a comparable fashion.

The term "CasX variant" is inclusive of variants that are fusion proteins, i.e., the CasX is "fused to" a heterologous sequence. This includes CasX variants comprising CasX variant sequences and N-terminal, C-terminal, or internal fusions of the CasX to a heterologous protein or domain thereof.

CasX proteins of the disclosure comprise at least one of the following domains; a non-target strand binding (NTSB) domain, a target strand loading (TSL) domain, a helical I domain, a helical II domain, an oligonucleotide binding domain (OBD), and a RuvC DNA cleavage domain (the last of which may be modified or deleted in a catalytically dead CasX variant), described more fully, below. Additionally, the CasX variant proteins of the disclosure have an enhanced ability to efficiently edit and/or bind target DNA, when complexed with a gNA as an RNP, utilizing PAM TC motif, including PAM sequences selected from TTC, ATC, GTC, or CTC, compared to an RNP of a reference CasX protein and reference gNA. In the foregoing, the PAM sequence is located at least 1 nucleotide 5' to the non-target strand of the protospacer having identity with the targeting sequence of the gNA in a assay system compared to the editing efficiency and/or binding of an RNP comprising a reference CasX protein and reference gNA in a comparable assay system. In one embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is TTC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is ATC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is CTC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is GTC. In the foregoing embodiments, the increased editing efficiency and/or binding affinity for the one or more PAM sequences is at least 1.5-fold greater or more compared to the editing efficiency and/or binding affinity of an RNP of any one of the CasX proteins of SEQ ID NOS:1-3 and the gNA of Table 1 for the PAM sequences.

In some embodiments, a CasX protein can bind and/or modify (e.g., cleave, nick, methylate, demethylate, etc.) a target nucleic acid and/or a polypeptide associated with target nucleic acid (e.g., methylation or acetylation of a histone tail). In some embodiments, the CasX protein is catalytically dead (dCasX) but retains the ability to bind a target nucleic acid. An exemplary catalytically dead CasX protein comprises one or more mutations in the active site of the RuvC domain of the CasX protein. In some embodiments, a catalytically dead CasX protein comprises substitutions at residues 672, 769 and/or 935 of SEQ ID NO:1. In one embodiment, a catalytically dead CasX protein comprises substitutions of D672A, E769A and/or D935A in a reference CasX protein of SEQ ID NO:1. In other embodiments, a catalytically dead CasX protein comprises substitutions at amino acids 659, 756 and/or 922 in a reference CasX protein of SEQ ID NO:2. In some embodiments, a catalytically dead CasX protein comprises D659A, E756A and/or D922A substitutions in a reference CasX protein of SEQ ID NO:2. In further embodiments, a catalytically dead CasX protein comprises deletions of all or part of the RuvC domain of the CasX protein. It will be understood that the same foregoing substitutions can similarly be introduced into the CasX variants of the disclosure, resulting in a dCasX variant. In one embodiment, all or a portion of the RuvC domain is deleted from the CasX variant, resulting in a dCasX variant. Catalytically inactive dCasX variant proteins can, in some embodiments, be used for base editing or epigenetic modifications. With a higher affinity for DNA, in some embodiments, catalytically inactive dCasX variant proteins can, relative to catalytically active CasX, find their target nucleic acid faster, remain bound to target nucleic acid for longer periods of time, bind target nucleic acid in a more stable fashion, or a combination thereof, thereby improving these functions of the catalytically dead CasX variant protein compared to a CasX variant that retains its cleavage capability.

a. Non-Target Strand Binding Domain

The reference CasX proteins of the disclosure comprise a non-target strand binding domain (NTSBD). The NTSBD is a domain not previously found in any Cas proteins; for example this domain is not present in Cas proteins such as Cas9, Cas12a/Cpf1, Cas13. Cas14, CASCADE, CSM, or CSY. Without being bound to theory or mechanism, a NTSBD in a CasX allows for binding to the non-target DNA strand and may aid in unwinding of the non-target and target strands. The NTSBD is presumed to be responsible for the unwinding, or the capture, of a non-target DNA strand in the unwound state. The NTSBD is in direct contact with the non-target strand in CryoEM model structures derived to date and may contain a non-canonical zinc finger domain. The NTSBD may also play a role in stabilizing DNA during unwinding, guide RNA invasion and R-loop formation. In some embodiments, an exemplary NTSBD comprises amino acids 101-191 of SEQ ID NO:1 or amino acids 103-192 of SEQ ID NO:2. In some embodiments, the NTSBD of a reference CasX protein comprises a four-stranded beta sheet.

b. Target Strand Loading Domain

The reference CasX proteins of the disclosure comprise a Target Strand Loading (TSL) domain. The TSL domain is a domain not found in certain Cas proteins such as Cas9, CASCADE, CSM, or CSY. Without wishing to be bound by theory or mechanism, it is thought that the TSL domain is responsible for aiding the loading of the target DNA strand into the RuvC active site of a CasX protein. In some embodiments, the TSL acts to place or capture the target-strand in a folded state that places the scissile phosphate of the target strand DNA backbone in the RuvC active site. The TSL comprises a cys4 (CXXC, CXXC zinc finger/ribbon domain (SEQ ID NO: 48) that is separated by the bulk of the TSL. In some embodiments, an exemplary TSL comprises amino acids 825-934 of SEQ ID NO:1 or amino acids 813-921 of SEQ ID NO:2.

c. Helical I Domain

The reference CasX proteins of the disclosure comprise a helical I domain. Certain Cas proteins other than CasX have domains that may be named in a similar way. However, in some embodiments, the helical 1 domain of a CasX protein comprises one or more unique structural features, or comprises a unique sequence, or a combination thereof, compared to non-CasX proteins. For example, in some embodiments, the helical I domain of a CasX protein comprises one or more unique secondary structures compared to domains in other Cas proteins that may have a similar name. For example, in some embodiments the helical I domain in a CasX protein comprises one or more alpha helices of unique structure and sequence in arrangement, number and length compared to other CRISPR proteins. In certain embodiments, the helical I domain is responsible for interacting with the bound DNA and targeting sequence of the guide RNA. Without wishing to be bound by theory, it is thought that in some cases the helical I domain may contribute to binding of the protospacer adjacent motif (PAM). In some embodiments, an exemplary helical I domain comprises amino acids 57-100 and 192-332 of SEQ ID NO:1, or amino acids 59-102 and 193-333 of SEQ ID NO:2. In some embodiments, the helical I domain of a reference CasX protein comprises one or more alpha helices.

d. Helical II Domain

The reference CasX proteins of the disclosure comprise a helical II domain. Certain Cas proteins other than CasX have domains that may be named in a similar way. However, in some embodiments, the helical II domain of a CasX protein comprises one or more unique structural features, or a unique sequence, or a combination thereof, compared to domains in other Cas proteins that may have a similar name. For example, in some embodiments, the helical II domain comprises one or more unique structural alpha helical bundles that align along the target DNA:guide RNA channel. In some embodiments, in a CasX comprising a helical II domain, the target strand and guide RNA interact with helical II (and the helical I domain, in some embodiments) to allow RuvC domain access to the target DNA. The helical II domain is responsible for binding to the guide RNA scaffold stem loop as well as the bound DNA. In some embodiments, an exemplary helical II domain comprises amino acids 333-509 of SEQ ID NO:1, or amino acids 334-501 of SEQ ID NO:2.

e. Oligonucleotide Binding Domain

The reference CasX proteins of the disclosure comprise an Oligonucleotide Binding Domain (OBD). Certain Cas proteins other than CasX have domains that may be named in a similar way. However, in some embodiments, the OBD comprises one or more unique functional features, or comprises a sequence unique to a CasX protein, or a combination thereof. For example, in some embodiments the bridged helix (BH), helical I domain, helical II domain, and Oligonucleotide Binding Domain (OBD) together are responsible for binding of a CasX protein to the guide RNA. Thus, for example, in some embodiments the OBD is unique to a CasX protein in that it interacts functionally with a helical I domain, or a helical II domain, or both, each of which may be unique to a CasX protein as described herein. Specifically, in CasX the OBD largely binds the RNA triplex of the guide RNA scaffold. The OBD may also be responsible for binding to the protospacer adjacent motif (PAM). An exemplary OBD domain comprises amino acids 1-56 and 510-660 of SEQ ID NO:1, or amino acids 1-58 and 502-647 of SEQ ID NO:2.

f. RuvC DNA Cleavage Domain

The reference CasX proteins of the disclosure comprise a RuvC domain, that includes 2 partial RuvC domains (RuvC-I and RuvC-II). The RuvC domain is the ancestral domain of all Cas12 CRISPR proteins. The RuvC domain originates from a TNPB (transposase B) like transposase. Similar to other RuvC domains, the CasX RuvC domain has a DED catalytic triad that is responsible for coordinating a magnesium (Mg) ion and cleaving DNA. In some embodiments, the RuvC has a DED motif active site that is responsible for cleaving both strands of DNA (one by one, most likely the non-target strand first at 11-14 nucleotides (nt) into the targeted sequence and then the target strand next at 2-4 nucleotides after the target sequence). Specifically in CasX, the RuvC domain is unique in that it is also responsible for binding the guide RNA scaffold stem loop that is critical for CasX function. An exemplary RuvC domain comprises amino acids 661-824 and 935-986 of SEQ ID NO:1, or amino acids 648-812 and 922-978 of SEQ ID NO:2.

g. Reference CasX Proteins

The disclosure provides naturally-occurring CasX proteins (referred to herein as a "reference CasX protein") that function as an endonuclease that catalyzes a double strand break at a specific sequence in a targeted double-stranded DNA (dsDNA). The sequence specificity is provided by the targeting sequence of the associated gNA to which it is complexed, which hybridizes to a target sequence within the target nucleic acid. For example, reference CasX proteins can be isolated from naturally occurring prokaryotes, such as Deltaproteobacteria, Planctomycetes, or Candidatus Sungbacteria species. A reference CasX protein (sometimes referred to herein as a reference CasX protein) is a Type V CRISPR/Cas endonuclease belonging to the CasX (sometimes referred to as Cas12e) family of proteins that is capable of interacting with a guide NA to form a ribonucleoprotein (RNP) complex. In some embodiments, the RNP complex comprising the reference CasX protein can be targeted to a particular site in a target nucleic acid via base pairing between the targeting sequence (or spacer) of the gNA and a target sequence in the target nucleic acid. In some embodiments, the RNP comprising the reference CasX protein is capable of cleaving target DNA. In some embodiments, the RNP comprising the reference CasX protein is capable of nicking target DNA. In some embodiments, the RNP comprising the reference CasX protein is capable of editing target DNA, for example in those embodiments where the reference CasX protein is capable of cleaving or nicking DNA, followed by non-homologous end joining (NHEJ), homology-directed repair (HDR), homology-independent targeted integration (HITI), micro-homology mediated end joining (MMEJ), single strand annealing (SSA) or base excision repair (BER). In some embodiments, the RNP comprising the CasX protein is a catalytically dead (is catalytically inactive or has substantially no cleavage activity) CasX protein (dCasX), but retains the ability to bind the target DNA, described more fully, supra.

In some cases, a Type V reference CasX protein is isolated or derived from Deltaproteobacteria. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89°% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of:

(SEQ ID NO: 1)

```
  1  MEKRINKIRK  KLSADNATKP  VSRSGPMKTL  LVRVMTDDLK  KRLEKRRKKP  EVMPQVISNN

61  AANNLRMLLD  DYTKMKEAIL  QVYWQEFKDD  HVGLMCKFAQ  PASKKIDQNK  LKPEMDEKGN

121  LTTAGFACSQ  CGQPLFVYKL  EQVSEKGKAY  TNYFGRCNVA  EHEKLILLAQ  LKPEKDSDEA

181  VTYSLGKFGQ  RALDFYSIHV  TKESTHPVKP  LAQIAGNRYA  SGPVGKALSD  ACMGTIASFL

241  SKYQDIIIEH  QKVVKGNQKR  LESLRELAGK  ENLEYPSVTL  PPQPHTKEGV  DAYNEVIARV
```

```
301 RMWVNLNLWQ KLKLSRDDAK PLLRLKGFPS FPVVERRENE VDWWNTINEV KKLIDAKRDM

361 GRVFWSGVTA EKRNTILEGY NYLPNENDHK KREGSLENPK KPAKRQFGDL LLYLEKKYAG

421 DWGKVFDEAW ERIDKKIAGL TSHIEREEAR NAEDAQSKAV LTDWLRAKAS FVLERIKEMD

481 EKEFYACEIQ LQKWYGDLRG NPFAVEAENR VVDISGESIG SDGHSIQYRN LLAWKYLENG

541 KREFYLLMNY GKKGRIRFTD GTDIKKSGKW QGLLYGGGKA KVIDLTFDPD DEQLIILPLA

601 FGTRQGREFI WNDLLSLETG LIKLANGRVI EKTIYNKKIG RDEPALFVAL TFERREVVDP

661 SNIKPVNLIG VDRGENIPAV IALTDPEGCP LPEFKDSSGG PTDILRIGEG YKEKQRAIQA

721 AKEVEQRRAG GYSRKFASKS RNLADDMVRN SARDLFYHAV THDAVLVFEN LSRGFGRQGK

781 RTFMTERQYT KMEDWLTAKL AYEGLTSKTY LSKTLAQYTS KTCSNCGFTI TTADYDGMLV

841 RLKKTSDGWA TTLNNKELKA EGQITYYNRY KRQTVEKELS AELDRLSEES GNNDISKWTK

901 GRRDEALFLL KKRFSHRPVQ EQFVCLDCGH EVHADEQAAL NIARSWLFLN SNSTEFKSYK

961 SGKQPFVGAW QAFYKRRLKE VWKPNA.
```

In some cases, a Type V reference CasX protein is isolated or derived from Planctomycetes. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of:

```
                                                             (SEQ. ID NO: 2)
  1 MQEIKRINKI RRRLVKDSNT KKAGKTGPMK TLLVRVMTPD LRERLENLRK KPENIPQPIS

61 NTSRANLNKL LTDYTEMKKA ILHVYKEEFQ KDPVGIMSRV AQPAPKNIDQ RKLIPVKDGN

121 ERLTSSGFAC SQCCQPLYVY KLEQVNDKGK PHTNYFGRCN VSEHERLILL SPHKPEANDE

181 LVTYSLGKFG QRALDFYSIH VTRESNHPVK PLEQIGGNSC ASGPVGKALS DACMGAVASF

241 LTKYQDIILE HQKVIKKNEK RLANLKDIAS ANGLAFPKIT LPPQPHTKEG IEAYNNVVAQ

301 IVIWVNLNLW QKLKIGRDEA KPLQRLKGFP SFPLVERQAN EVDWWDMVCN VKKLINEKKE

361 DGKVFWQNLA GYKRQEALLP YLSSEEDRKK GKKFARYQFG DLLLHLEKKH GEDWGKVYDE

421 AWERIDKKVE GLSKHIKLEE ERRSEDAQSK AALTDWLRAK ASFVIEGLKE ADKDEFCRCE

481 LKLQKWYGDL RGKPFAIEAE NSILDISGFS KQYNCAFIWQ KDGVKKLNLY LIINYFKGGK

541 LRFKKIKPEA FEANPFYTVI NKKSGEIVPM EVNFNFDDPN LIILPLAFGK RQGREFIWND

601 LLSLETGSLK LANGRVIEKT LYNRRTRQDE PALFVALTFE RREVLDSSNI KPMNLIGIDR

661 GENIPAVIAL TDPEGCPLSR FKDSLGNPTH ILRIGESYKE KQRTIQAAKE VEQRRAGGYS

721 RKYASKAKNL ADDMVRNTAR DLLYYAVTQD AMLIFENLSR GFGRQGKRTF MAERQYTRME

781 DWLTAKLAYE GLPSKTYLSK TLAQYTSKTC SNCGFTITSA DYDRVLEKLK KTATGWMTTI

841 NGKELKVEGQ ITYYNRYKRQ NVVKDLSVEL DRLSEESVNN DISSWTKGRS GEALSLIKKR

901 FSHRPVQEKF VCLNCGFETH ADEQAALNIA RSWIFLRSQE YKKYQTNKTT GNTDKRAFVE

961 TWQSFYRKKL KEVWKPAV.
```

In some embodiments, the CasX protein comprises the sequence of SEQ ID NO:2, or at least 60% similarity thereto. In some embodiments, the CasX protein comprises the sequence of SEQ ID NO:2, or at least 80% similarity thereto. In some embodiments, the CasX protein comprises the sequence of SEQ ID NO:2, or at least 90% similarity thereto. In some embodiments, the CasX protein comprises the sequence of SEQ ID NO:2, or at least 95% similarity thereto. In some embodiments, the CasX protein consists of the sequence of SEQ ID NO:2. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO:2. These mutations can be insertions, deletions, amino acid substitutions, or any combinations thereof.

In some cases, a Type V reference CasX protein is isolated or derived from Candidatus Sungbacteria. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of sequence of SEQ ID NO:3, or at least 95% similarity thereto. In some embodiments, the CasX protein consists of the sequence of SEQ ID NO:3. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO:3. These mutations can be insertions, deletions, amino acid substitutions, or any combinations thereof.

h. CasX Variant Proteins

The present disclosure provides variants of a reference CasX protein (interchangeably referred to herein as "CasX variant" or "CasX variant protein"), wherein the CasX variants comprise at least one modification in at least one domain of the reference CasX protein, including the sequences of SEQ ID NOS:1-3. In some embodiments, the CasX variant exhibits at least one improved characteristic compared to the reference CasX protein. All variants that improve one or more functions or characteristics of the CasX variant protein when compared to a reference CasX protein described herein are envisaged as being within the scope of the disclosure. In some embodiments, the modification is a mutation in one or more amino acids of the reference CasX. In other embodiments, the modification is a substitution of one or more domains of the reference CasX with one or more domains from a different CasX. In some embodiments, insertion includes the insertion of a part or all of a domain from a different CasX protein. Mutations can occur in any one or more domains of the reference CasX protein, and may include, for example, deletion of part or all of one or more domains, or one or more amino acid

```
                                                           (SEQ ID NO: 3)
  1 MDNANKPSTK SLVNTTRISD HFGVTPGQVT RVFSFGIIPT KRQYAIIERW FAAVEAARER

61 LYGMLYAHFQ ENPPAYLKEK FSYETFFKGR PVLNGLRDID PTIMTSAVFT ALRHKAEGAM

121 AAFHTNHRRL FEEARKKMRE YAECLKANEA LLRGAADIDW DKIVNALRTR LNTCLAPEYD

181 AVIADFGALC AFRALIAETN ALKGAYNHAL NQMLPALVKV DEPEEAEESP RLRFFNGRIN

241 DLPKFPVAER ETPPDTETII RQLEDMARVI PDTAEILGYI HRIRHKAARR KPGSAVPLPQ

301 RVALYCAIRM ERNPEEDPST VAGHFLGEID RVCEKRRQGL VRTPFDSQIR ARYMDIISFR

361 ATLAHPDRWT EIQFLPENAA SRRVRPAETIS APFEGFSWTS NRTNPAPQYG MALAK-
    DANAP

421 ADAPELCICL SPSSAAFSVR EKGGDLIYMR PTGGRPGKDN PGKEITWVPG SFDEYPASGV

481 ALKLRLYFGR SQARRMLTNK TWGTLLSDNPR VFAA-
    NAELVG KKRNPQDRWK LFFHMVISGP

541 PPVEYLDFSS DVRSRARTVI GINRGEVNPL AYAVVSVEDG QVLEEGLLGK KEYIDQLIET

601 RRRISEYQSR EQTPPRDLRQ RVRHLQDTVL GSARAKIHSL IAFWKGILAI ERLDDQFHGR

661 EQKIIPKKTY LANKTGFMNA LSFSGAVRVD KKGNPWGGMI EIYPGGISRT CTQCGTVWLA

721 RRPKNPGHRD AMVVIPDIVD DAAATGFDNV DCDAGTVDYG ELFTLSREWV RLTPRYSRVM

781 RGTLGDLERA IRQGDDRKSR QMLELALEPQ PQWGQFFCHR CGFNGQSDVL AATNLARRAI

841 SLIRRLPDTD TPPTP.
```

In some embodiments, the CasX protein comprises the sequence of SEQ ID NO:3, or at least 60% similarity thereto. In some embodiments, the CasX protein comprises the sequence of SEQ ID NO:3, or at least 80% similarity thereto. In some embodiments, the CasX protein comprises the sequence of SEQ ID NO:3, or at least 90% similarity thereto. In some embodiments, the CasX protein comprises the substitutions, deletions, or insertions in any domain of the reference CasX protein. The domains of CasX proteins include the non-target strand binding (NTSB) domain, the target strand loading (TSL) domain, the helical I domain, the helical II domain, the oligonucleotide binding domain (OBD), and the RuvC DNA cleavage domain. Any change in amino acid sequence of a reference CasX protein that leads to an improved characteristic of the CasX protein is considered a CasX variant protein of the disclosure. For example, CasX variants can comprise one or more amino acid substitutions, insertions, deletions, or swapped domains, or any combinations thereof, relative to a reference CasX protein sequence.

In some embodiments, the CasX variant protein comprises at least one modification in at least each of two domains of the reference CasX protein, including the sequences of SEQ ID NOS:1-3. In some embodiments, the CasX variant protein comprises at least one modification in at least 2 domains, in at least 3 domains, at least 4 domains or at least 5 domains of the reference CasX protein. In some embodiments, the CasX variant protein comprises two or more modifications in at least one domain of the reference CasX protein. In some embodiments, the CasX variant protein comprises at least two modifications in at least one domain of the reference CasX protein, at least three modifications in at least one domain of the reference CasX protein or at least four modifications in at least one domain of the reference CasX protein. In some embodiments, wherein the CasX variant comprises two or more modifications compared to a reference CasX protein, each modification is made in a domain independently selected from the group consisting of a NTSBD, TSLD, Helical I domain, Helical II domain, OBD, and RuvC DNA cleavage domain.

In some embodiments, the at least one modification of the CasX variant protein comprises a deletion of at least a portion of one domain of the reference CasX protein, including the sequences of SEQ ID NOS:1-3. In some embodiments, the deletion is in the NTSBD, TSLD, Helical I domain, Helical II domain, OBD, or RuvC DNA cleavage domain.

Suitable mutagenesis methods for generating CasX variant proteins of the disclosure may include, for example, Deep Mutational Evolution (DME), deep mutational scanning (DMS), error prone PCR, cassette mutagenesis, random mutagenesis, staggered extension PCR, gene shuffling, or domain swapping. In some embodiments, the CasX variants are designed, for example by selecting one or more desired mutations in a reference CasX. In certain embodiments, the activity of a reference CasX protein is used as a benchmark against which the activity of one or more CasX variants are compared, thereby measuring improvements in function of the CasX variants. Exemplary improvements of CasX variants include, but are not limited to, improved folding of the variant, improved binding affinity to the gNA, improved binding affinity to the target DNA, altered binding affinity to one or more PAM sequences, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved protein:gNA complex stability, improved protein solubility, improved protein:gNA complex solubility, improved protein yield, improved protein expression, and improved fusion characteristics, as described more fully, below.

In some embodiments of the CasX variants described herein, the at least one modification comprises: (a) a substitution of 1 to 100 consecutive or non-consecutive amino acids in the CasX variant compared to a reference CasX of SEQ ID NO:1, SEQ ID NO:2, or SEQ ID NO:3; (b) a deletion of 1 to 100 consecutive or non-consecutive amino acids in the CasX variant compared to a reference CasX; (c) an insertion of 1 to 100 consecutive or non-consecutive amino acids in the CasX compared to a reference CasX; or (d) any combination of (a)-(c). In some embodiments, the at least one modification comprises: (a) a substitution of 5-10 consecutive or non-consecutive amino acids in the CasX variant compared to a reference CasX of SEQ ID NO:1, SEQ ID NO:2, or SEQ ID NO:3; (b) a deletion of 1-5 consecutive or non-consecutive amino acids in the CasX variant compared to a reference CasX; (c) an insertion of 1-5 consecutive or non-consecutive amino acids in the CasX compared to a reference CasX: or (d) any combination of (a)-(c).

In some embodiments, the CasX variant protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO:1, SEQ ID NO:2, or SEQ ID NO:3. These mutations can be insertions, deletions, amino acid substitutions, or any combinations thereof.

In some embodiments, the CasX variant protein comprises at least one amino acid substitution in at least one domain of a reference CasX protein. In some embodiments, the CasX variant protein comprises at least about 1-4 amino acid substitutions, 1-10 amino acid substitutions, 1-20 amino acid substitutions, 1-30 amino acid substitutions, 1-40 amino acid substitutions, 1-50 amino acid substitutions, 1-6) amino acid substitutions, 1-70 amino acid substitutions, 1-80 amino acid substitutions, 1-90 amino acid substitutions, 1-100 amino acid substitutions, 2-10 amino acid substitutions, 2-20 amino acid substitutions, 2-30 amino acid substitutions, 3-10 amino acid substitutions, 3-20 amino acid substitutions, 3-30 amino acid substitutions, 4-10 amino acid substitutions, 4-20 amino acid substitutions, 3-300 amino acid substitutions, 5-10 amino acid substitutions, 5-20 amino acid substitutions, 5-30 amino acid substitutions, 10-50 amino acid substitutions, or 20-50 amino acid substitutions, relative to a reference CasX protein, w % hich can be consecutive or non-consecutive, or in different domains. As used herein "consecutive amino acids" refer to amino acids that are contiguous in the primary sequence of a polypeptide. In some embodiments, the CasX variant protein comprises at least about 100 or more amino acid substitutions relative to a reference CasX protein. In some embodiments, the amino acid substitutions are conservative substitutions. In other embodiments, the substitutions are non-conservative; e.g., a polar amino acid is substituted for a non-polar amino acid, or vice versa.

Any amino acid can be substituted for any other amino acid in the substitutions described herein. The substitution can be a conservative substitution (e.g., a basic amino acid is substituted for another basic amino acid). The substitution can be a non-conservative substitution (e.g., a basic amino acid is substituted for an acidic amino acid or vice versa). For example, a proline in a reference CasX protein can be substituted for any of arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine to generate a CasX variant protein of the disclosure.

In some embodiments, a CasX variant protein comprises at least one amino acid deletion relative to a reference CasX protein. In some embodiments, a CasX variant protein comprises a deletion of 1-4 amino acids, 1-10 amino acids, 1-20 amino acids, 1-30 amino acids, 1-40 amino acids, 1-50 amino acids, 1-60 amino acids, 1-70 amino acids, 1-80 amino acids, 1-90 amino acids, 1-100 amino acids, 2-10 amino acids, 2-20 amino acids, 2-30 amino acids, 3-10 amino acids, 3-20 amino acids, 3-30 amino acids, 4-10 amino acids, 4-20 amino acids, 3-300 amino acids, 5-10 amino acids, 5-20 amino acids, 5-30 amino acids, 10-50 amino acids or 20-50 amino acids relative to a reference CasX protein. In some embodiments, a CasX protein comprises a deletion of at least about 100 consecutive amino acids relative to a reference CasX protein. In some embodiments, a CasX variant protein comprises a deletion of at least 1, 2, 3, 4, 5, 6, 7, 8, 9, 10, 20, 30, 40, 50 or 100 consecutive amino acids relative to a reference CasX protein. In some embodiments, a CasX variant protein comprises a deletion of 1, 2, 3, 4, 5, 6, 7, 8, 9 or 10 consecutive amino acids.

In some embodiments, a CasX variant protein comprises two or more deletions relative to a reference CasX protein, and the two or more deletions are not consecutive amino acids. For example, a first deletion may be in a first domain of the reference CasX protein, and a second deletion may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive deletions relative to a reference CasX protein. In some embodiments, a CasX variant protein comprises at least 20 non-consecutive deletions relative to a reference CasX protein. Each non-consecutive deletion may be of any length of amino acids described herein, e.g., 1-4 amino acids, 1-10 amino acids, and the like.

In some embodiments, the CasX variant protein comprises one or more amino acid insertions relative to the sequence of SEQ ID NOS:1, 2, or 3. In some embodiments, a CasX variant protein comprises an insertion of 1 amino acid, an insertion of 2-3 consecutive or non-consecutive amino acids, 2-4 consecutive or non-consecutive amino acids, 2-5 consecutive or non-consecutive amino acids, 2-6 consecutive or non-consecutive amino acids, 2-7 consecutive or non-consecutive amino acids, 2-8 consecutive or non-consecutive amino acids, 2-9 consecutive or non-consecutive amino acids, 2-10 consecutive or non-consecutive amino acids, 2-20 consecutive or non-consecutive amino acids, 2-30 consecutive or non-consecutive amino acids, 2-40 consecutive or non-consecutive amino acids, 2-50 consecutive or non-consecutive amino acids, 2-60 consecutive or non-consecutive amino acids, 2-70 consecutive or non-consecutive amino acids, 2-80 consecutive or non-consecutive amino acids, 2-90 consecutive or non-consecutive amino acids, 2-100 consecutive or non-consecutive amino acids, 3-10 consecutive or non-consecutive amino acids, 3-20 consecutive or non-consecutive amino acids, 3-30 consecutive or non-consecutive amino acids, 4-10 consecutive or non-consecutive amino acids, 4-20 consecutive or non-consecutive amino acids, 3-300 consecutive or non-consecutive amino acids, 5-10 consecutive or non-consecutive amino acids, 5-20 consecutive or non-consecutive amino acids, 5-30 consecutive or non-consecutive amino acids, 10-50 consecutive or non-consecutive amino acids or 20-50 consecutive or non-consecutive amino acids relative to a reference CasX protein. In some embodiments, the CasX variant protein comprises an insertion of 2, 3, 4, 5, 6, 7, 8, 9, 10, 11, 12, 13, 14, 15, 16, 17, 18, 19 or 20 consecutive or non-consecutive amino acids. In some embodiments, a CasX variant protein comprises an insertion of at least about 100 consecutive or non-consecutive amino acids. Any amino acid, or combination of amino acids, can be inserted in the insertions described herein to generate a CasX variant protein.

Any permutation of the substitution, insertion and deletion embodiments described herein can be combined to generate a CasX variant protein of the disclosure. For example, a CasX variant protein can comprise at least one substitution and at least one deletion relative to a reference CasX protein sequence, at least one substitution and at least one insertion relative to a reference CasX protein sequence, at least one insertion and at least one deletion relative to a reference CasX protein sequence, or at least one substitution, one insertion and one deletion relative to a reference CasX protein sequence.

In some embodiments, the CasX variant protein has at least about 60% sequence similarity to SEQ ID NO:2 or a portion thereof. In some embodiments, the CasX variant protein comprises a substitution of Y789T of SEQ ID NO:2, a deletion of P793 of SEQ ID NO:2, a substitution of Y789D of SEQ ID NO:2, a substitution of T72S of SEQ ID NO:2, a substitution of I546V of SEQ ID NO:2, a substitution of E552A of SEQ ID NO:2, a substitution of A636D of SEQ ID NO:2, a substitution of F536S of SEQ ID NO:2, a substitution of A708K of SEQ ID NO:2, a substitution of Y797L of SEQ ID NO:2, a substitution of L792G SEQ ID NO:2, a substitution of A739V of SEQ ID NO:2, a substitution of G791M of SEQ ID NO:2, an insertion of A at position 661 of SEQ ID NO:2, a substitution of A788W of SEQ ID NO:2, a substitution of K390R of SEQ ID NO:2, a substitution of A751S of SEQ ID NO:2, a substitution of E385A of SEQ ID NO:2, an insertion of P at position 696 of SEQ ID NO:2, an insertion of M at position 773 of SEQ ID NO:2, a substitution of G695H of SEQ ID NO:2, an insertion of AS at position 793 of SEQ ID NO:2, an insertion of AS at position 795 of SEQ ID NO:2, a substitution of C477R of SEQ ID NO:2, a substitution of C477K of SEQ ID NO:2, a substitution of C479A of SEQ ID NO:2, a substitution of C479L of SEQ ID NO:2, a substitution of I55F of SEQ ID NO:2, a substitution of K210R of SEQ ID NO:2, a substitution of C233S of SEQ ID NO:2, a substitution of D231N of SEQ ID NO:2, a substitution of Q338E of SEQ ID NO:2, a substitution of Q338R of SEQ ID NO:2, a substitution of L379R of SEQ ID NO:2, a substitution of K390R of SEQ ID NO:2, a substitution of L481Q of SEQ ID NO:2, a substitution of F495S of SEQ ID NO:2, a substitution of D600N of SEQ ID NO:2, a substitution of T886K of SEQ ID NO:2, a substitution of A739V of SEQ ID NO:2, a substitution of K460N of SEQ ID NO:2, a substitution of I199F of SEQ ID NO:2, a substitution of G492P of SEQ ID NO:2, a substitution of T153I of SEQ ID NO:2, a substitution of R591I of SEQ ID NO:2, an insertion of AS at position 795 of SEQ ID NO:2, an insertion of AS at position 796 of SEQ ID NO:2, an insertion of L at position 889 of SEQ ID NO:2, a substitution of E121D of SEQ ID NO:2, a substitution of S270W of SEQ ID NO:2, a substitution of E712Q of SEQ ID NO:2, a substitution of K942Q of SEQ ID NO:2, a substitution of E552K of SEQ ID NO:2, a substitution of K25Q of SEQ ID NO:2, a substitution of N47D of SEQ ID NO:2, an insertion of T at position 696 of SEQ ID NO:2, a substitution of L685I of SEQ ID NO:2, a substitution of N880D of SEQ ID NO:2, a substitution of Q102R of SEQ ID NO:2, a substitution of M734K of SEQ ID NO:2, a substitution of A724S of SEQ ID NO:2, a substitution of T704K of SEQ ID NO:2, a substitution of P224K of SEQ ID NO:2, a substitution of K25R of SEQ ID NO:2, a substitution of M29E of SEQ ID NO:2, a substitution of H152D of SEQ ID NO:2, a substitution of S219R of SEQ ID NO:2, a substitution of E475K of SEQ ID NO:2, a substitution of G226R of SEQ ID NO:2, a substitution of A377K of SEQ ID NO:2, a substitution of E480K of SEQ ID NO:2, a substitution of K416E of SEQ ID NO:2, a substitution of H164R of SEQ ID NO:2, a substitution of K767R of SEQ ID NO:2, a substitution of 17F of SEQ ID NO:2, a substitution of M29R of SEQ ID NO:2, a substitution of H435R of SEQ ID NO:2, a substitution of E385Q of SEQ ID NO:2, a substitution of E385K of SEQ ID NO:2, a substitution of 1279F of SEQ ID NO:2, a substitution of D489S of SEQ ID NO:2, a substitution of D732N of SEQ ID NO:2, a substitution of A739T of SEQ ID NO:2, a substitution of W885R of SEQ ID NO:2, a substitution of E53K of SEQ ID NO:2, a substitution of A238T of SEQ ID NO:2, a substitution of P283Q of SEQ ID NO:2, a substitution of E292K of SEQ ID NO:2, a substitution of Q628E of SEQ ID NO:2, a substitution of R388Q of SEQ ID NO:2, a substitution of G791M of SEQ ID NO:2, a substitution of L792K of SEQ ID NO:2, a substitution of L792E of SEQ ID NO:2, a substitution of M779N of SEQ ID NO:2, a substitution of G27D of SEQ ID NO:2, a substitution of K955R of SEQ ID NO:2, a substitution of S867R of SEQ ID NO:2, a substitution of R693I of SEQ ID NO:2, a substitution of F189Y of SEQ ID NO:2, a substitution of V635M of SEQ ID NO:2, a substitution of F399L of SEQ ID NO:2, a substitution of E498K of SEQ ID NO:2, a substitution of E386R of SEQ ID NO:2, a substitution of V254G of SEQ ID NO:2, a substitution of P793S of SEQ ID NO:2, a substitution of K188E of SEQ ID NO:2, a substitution of QT945KI of SEQ ID NO:2, a substitution of T620P of SEQ ID NO:2, a substitution of T946P of SEQ ID NO:2, a substitution of TT949PP of SEQ ID NO:2, a substitution of N952T of SEQ ID NO:2, a substitution of K682E of SEQ ID NO:2, a substitution of K975R of SEQ ID NO:2, a substitution of L212P of SEQ ID NO:2, a substitution of E292R of SEQ ID NO:2, a substitution of 1303K of SEQ ID NO:2, a substitution of C349E of SEQ ID NO:2, a substitution of E385P of SEQ ID NO:2, a substitution of E386N of SEQ ID NO:2, a substitution of D387K of SEQ ID NO:2, a substitution of L404K of SEQ ID NO:2, a substitution of E466H of SEQ ID NO:2, a substitution of C477Q of SEQ ID NO:2, a substitution of C477H of SEQ ID NO:2, a substitution of C479A of SEQ ID NO:2, a substitution of D659H of SEQ ID NO:2, a substitution of T806V of SEQ ID NO:2, a substitution of K808S of SEQ ID NO:2, an insertion of AS at position 797 of SEQ ID NO:2, a substitution of V959M of SEQ ID N0:2, a substitution of K975Q of SEQ ID NO:2, a substitution of W974G of SEQ ID NO:2, a substitution of A708Q of SEQ ID NO:2, a substitution of V711K of SEQ ID NO:2, a substitution of D733T of SEQ ID NO:2, a substitution of L742W of SEQ ID NO:2, a substitution of V747K of SEQ ID NO:2, a substitution of F755M of SEQ ID NO:2, a substitution of M771A of SEQ ID NO:2, a substitution of M771Q of SEQ ID NO:2, a substitution of W782Q of SEQ ID NO:2, a substitution of G791F, of SEQ ID NO:2 a substitution of L792D of SEQ ID NO:2, a substitution of L792K of SEQ ID NO:2, a substitution of P793Q of SEQ ID NO:2, a substitution of P793G of SEQ ID NO:2, a substitution of Q804A of SEQ ID NO:2, a substitution of Y966N of SEQ ID NO:2, a substitution of Y723N of SEQ ID NO:2, a substitution of Y857R of SEQ ID NO:2, a substitution of S890R of SEQ ID NO:2, a substitution of S932M of SEQ ID NO:2, a substitution of L897M of SEQ ID NO:2, a substitution of R624G of SEQ ID NO:2, a substitution of S603G of SEQ ID NO:2, a substitution of N737S of SEQ ID NO:2, a substitution of L307K of SEQ ID NO:2, a substitution of I658V of SEQ ID NO:2, an insertion of PT at position 688 of SEQ ID NO:2, an insertion of SA at position 794 of SEQ ID NO:2, a substitution of S877R of SEQ ID NO:2, a substitution of N580T of SEQ ID NO:2, a substitution of V335G of SEQ ID NO:2, a substitution of T620S of SEQ ID NO:2, a substitution of W345G of SEQ ID NO:2, a substitution of T280S of SEQ ID NO:2, a substitution of L406P of SEQ ID NO:2, a substitution of A612D of SEQ ID NO:2, a substitution of A751S of SEQ ID NO:2, a substitution of E386R of SEQ ID NO:2, a substitution of V351M of SEQ ID NO:2, a substitution of K210N of SEQ ID NO:2, a substitution of D40A of SEQ ID NO:2, a substitution of E773G of SEQ ID NO:2, a substitution of H207L of SEQ ID NO:2, a substitution of T62A SEQ ID NO:2, a substitution of T287P of SEQ ID NO:2, a substitution of T832A of SEQ ID NO:2, a substitution of A893S of SEQ ID NO:2, an insertion of V at position 14 of SEQ ID NO:2, an insertion of AG at position 13 of SEQ ID NO:2, a substitution of RI IV of SEQ ID NO:2, a substitution of RI2N of SEQ ID NO:2, a substitution of R13H of SEQ ID NO:2, an insertion of Y at position 13 of SEQ ID NO:2, a substitution of R12L of SEQ ID NO:2, an insertion of Q at position 13 of SEQ ID NO:2, an substitution of V15S of SEQ ID NO:2, an insertion of D at position 17 of SEQ ID NO:2 or a combination thereof.

In some embodiments, the CasX variant comprises at least one modification in the NTSB domain.

In some embodiments, the CasX variant comprises at least one modification in the TSL domain. In some embodiments, the at least one modification in the TSL domain comprises an amino acid substitution of one or more of amino acids Y857, S890, or S932 of SEQ ID NO:2.

In some embodiments, the CasX variant comprises at least one modification in the helical I domain. In some embodiments, the at least one modification in the helical I domain comprises an amino acid substitution of one or more of amino acids S219, L249, E259, Q252, E292, L307, or D318 of SEQ ID NO:2.

In some embodiments, the CasX variant comprises at least one modification in the helical 11 domain. In some embodiments, the at least one modification in the helical 11 domain comprises an amino acid substitution of one or more of amino acids D361. L379, E385, E386. D387, F399, L404, R458, C477, or D489 of SEQ ID NO:2.

In some embodiments, the CasX variant comprises at least one modification in the OBD domain. In some embodiments, the at least one modification in the OBD comprises an amino acid substitution of one or more of amino acids F536. E552, T620, or 1658 of SEQ ID NO:2.

In some embodiments, the CasX variant comprises at least one modification in the RuvC DNA cleavage domain. In some embodiments, the at least one modification in the RuvC DNA cleavage domain comprises an amino acid substitution of one or more of amino acids K682, G695, A708, V711, D732, A739, D733, L742, V747, F755, M771, M779, W782, A788, G791, L792, P793, Y797, M799, Q804, S819, or Y857 or a deletion of amino acid P793 of SEQ ID NO:2.

In some embodiments, the CasX variant comprises at least one modification compared to the reference CasX sequence of SEQ ID NO:2 is selected from one or more of: (a) an amino acid substitution of L379R; (b) an amino acid substitution of A708K; (c) an amino acid substitution of T620P; (d) an amino acid substitution of E385P; (e) an amino acid substitution of Y857R; (f) an amino acid substitution of 1658V; (g) an amino acid substitution of F399L; (h) an amino acid substitution of Q252K; (i) an amino acid substitution of L404K; (j) an amino acid substitution of G223Y; (k) an amino acid deletion of P793; and an insertion of R at position 26.

In some embodiments, a CasX variant comprises at least two amino acid changes to the sequence of a reference CasX variant protein selected from the group consisting of: a substitution of Y789T of SEQ ID NO:2, a deletion of P793 of SEQ ID NO:2, a substitution of Y789D of SEQ ID NO:2, a substitution of T72S of SEQ ID NO:2, a substitution of I546V of SEQ ID NO:2, a substitution of E552A of SEQ ID NO:2, a substitution of A636D of SEQ ID NO:2, a substitution of F536S of SEQ ID NO:2, a substitution of A708K of SEQ ID NO:2, a substitution of Y797L of SEQ ID NO:2, a substitution of L792G SEQ ID NO:2, a substitution of A739V of SEQ ID NO:2, a substitution of G791M of SEQ ID NO:2, an insertion of A at position 661 of SEQ ID NO:2, a substitution of A788W of SEQ ID NO:2, a substitution of K390R of SEQ ID NO:2, a substitution of A751S of SEQ ID NO:2, a substitution of E385A of SEQ ID NO:2, an insertion of P at position 696 of SEQ ID NO:2, an insertion of M at position 773 of SEQ ID NO:2, a substitution of G695H of SEQ ID NO:2, an insertion of AS at position 793 of SEQ ID NO:2, an insertion of AS at position 795 of SEQ ID NO:2, a substitution of C477R of SEQ ID NO:2, a substitution of C477K of SEQ ID NO:2, a substitution of C479A of SEQ ID NO:2, a substitution of C479L of SEQ ID NO:2, a substitution of I55F of SEQ ID NO:2, a substitution of K210R of SEQ ID NO:2, a substitution of C233S of SEQ ID NO:2, a substitution of D231N of SEQ ID NO:2, a substitution of Q338E of SEQ ID NO:2, a substitution of Q338R of SEQ ID NO:2, a substitution of L379R of SEQ ID NO:2, a substitution of K390R of SEQ ID NO:2, a substitution of L481Q of SEQ ID NO:2, a substitution of F495S of SEQ ID NO:2, a substitution of D600N of SEQ ID NO:2, a substitution of T886K of SEQ ID NO:2, a substitution of A739V of SEQ ID NO:2, a substitution of K460N of SEQ ID NO:2, a substitution of I199F of SEQ ID NO:2, a substitution of G492P of SEQ ID NO:2, a substitution of T1531 of SEQ ID NO:2, a substitution of R591I of SEQ ID NO:2, an insertion of AS at position 795 of SEQ ID NO:2, an insertion of AS at position 796 of SEQ ID NO:2, an insertion of L at position 889 of SEQ ID NO:2, a substitution of E121D of SEQ ID NO:2, a substitution of S270W of SEQ ID NO:2, a substitution of E712Q of SEQ ID NO:2, a substitution of K942Q of SEQ ID NO:2, a substitution of E552K of SEQ ID NO:2, a substitution of K25Q of SEQ ID NO:2, a substitution of N47D of SEQ ID NO:2, an insertion of T at position 696 of SEQ ID NO:2, a substitution of L685I of SEQ ID NO:2, a substitution of N880D of SEQ ID NO:2, a substitution of Q102R of SEQ ID NO:2, a substitution of M734K of SEQ ID NO:2, a substitution of A724S of SEQ ID NO:2, a substitution of T704K of SEQ ID NO:2, a substitution of P224K of SEQ ID NO:2, a substitution of K25R of SEQ ID NO:2, a substitution of M29E of SEQ ID NO:2, a substitution of H152D of SEQ ID NO:2, a substitution of S219R of SEQ ID NO:2, a substitution of E475K of SEQ ID NO:2, a substitution of G226R of SEQ ID NO:2, a substitution of A377K of SEQ ID NO:2, a substitution of E480K of SEQ ID NO:2, a substitution of K416E of SEQ ID NO:2, a substitution of H164R of SEQ ID NO:2, a substitution of K767R of SEQ ID NO:2, a substitution of I7F of SEQ ID NO:2, a substitution of M29R of SEQ ID NO:2, a substitution of H435R of SEQ ID NO:2, a substitution of E385Q of SEQ ID NO:2, a substitution of E385K of SEQ ID NO:2, a substitution of I279F of SEQ ID NO:2, a substitution of D489S of SEQ ID NO:2, a substitution of D732N of SEQ ID NO:2, a substitution of A739T of SEQ ID NO:2, a substitution of W885R of SEQ ID NO:2, a substitution of E53K of SEQ ID NO:2, a substitution of A238T of SEQ ID NO:2, a substitution of P283Q of SEQ ID NO:2, a substitution of E292K of SEQ ID NO:2, a substitution of Q628E of SEQ ID NO:2, a substitution of R388Q of SEQ ID NO:2, a substitution of G791M of SEQ ID NO:2, a substitution of L792K of SEQ ID NO:2, a substitution of L792E of SEQ ID NO:2, a substitution of M779N of SEQ ID NO:2, a substitution of G27D of SEQ ID NO:2, a substitution of K955R of SEQ ID NO:2, a substitution of S867R of SEQ ID NO:2, a substitution of R693I of SEQ ID NO:2, a substitution of F189Y of SEQ ID NO:2, a substitution of V635M of SEQ ID NO:2, a substitution of F399L of SEQ ID NO:2, a substitution of E498K of SEQ ID NO:2, a substitution of E386R of SEQ ID NO:2, a substitution of V254G of SEQ ID NO:2, a substitution of P793S of SEQ ID NO:2, a substitution of K188E of SEQ ID NO:2, a substitution of QT945KI of SEQ ID NO:2, a substitution of T620P of SEQ ID NO:2, a substitution of T946P of SEQ ID NO:2, a substitution of TT949PP of SEQ ID NO:2, a substitution of N952T of SEQ ID NO:2, a substitution of K682E of SEQ ID NO:2, a substitution of K975R of SEQ ID NO:2, a substitution of L212P of SEQ ID NO:2, a substitution of E292R of SEQ ID NO:2, a substitution of I303K of SEQ ID NO:2, a substitution of C349E of SEQ ID NO:2, a substitution of E385P of SEQ ID NO:2, a substitution of E386N of SEQ ID NO:2, a substitution of D387K of SEQ ID NO:2, a substitution of L404K of SEQ ID NO:2, a substitution of E466H of SEQ ID NO:2, a substitution of C477Q of SEQ ID NO:2, a substitution of C477H of SEQ ID NO:2, a substitution of C479A of SEQ ID NO:2, a substitution of D659H of SEQ ID NO:2, a substitution of T806V of SEQ ID NO:2, a substitution of K808S of SEQ ID NO:2, an insertion of AS at position 797 of SEQ ID NO:2, a substitution of V959M of SEQ ID NO:2, a substitution of K975Q of SEQ ID NO:2, a substitution of W974G of SEQ ID NO:2, a substitution of A708Q of SEQ ID NO:2, a substitution of V711K of SEQ ID NO:2, a substitution of D733T of SEQ ID NO:2, a substitution of L742W of SEQ ID NO:2, a substitution of V747K of SEQ ID NO:2, a substitution of F755M of SEQ ID NO:2, a substitution of M771A of SEQ ID NO:2, a substitution of M771Q of SEQ ID NO:2, a substitution of W782Q of SEQ ID NO:2, a substitution of G791F, of SEQ ID NO:2 a substitution of L792D of SEQ ID NO:2, a substitution of L792K of SEQ ID NO:2, a substitution of P793Q of SEQ ID NO:2, a substitution of P793G of SEQ ID NO:2, a substitution of Q804A of SEQ ID NO:2, a substitution of Y966N of SEQ ID NO:2, a substitution of Y723N of SEQ ID NO:2, a substitution of Y857R of SEQ ID NO:2, a substitution of S890R of SEQ ID NO:2, a substitution of S932M of SEQ ID NO:2, a substitution of L897M of SEQ ID NO:2, a substitution of R624G of SEQ ID NO:2, a substitution of S603G of SEQ ID NO:2, a substitution of N737S of SEQ ID NO:2, a substitution of L307K of SEQ ID NO:2, a substitution of I658V of SEQ ID NO:2, an insertion of PT at position 688 of SEQ ID NO:2, an insertion of SA at position 794 of SEQ ID NO:2, a substitution of S877R of SEQ ID NO:2, a substitution of N580T of SEQ ID NO:2, a substitution of V335G of SEQ ID NO:2, a substitution of T620S of SEQ ID NO:2, a substitution of W345G of SEQ ID NO:2, a substitution of T280S of SEQ ID NO:2, a substitution of L406P of SEQ ID NO:2, a substitution of A612D of SEQ ID NO:2, a substitution of A751S of SEQ ID NO:2, a substitution of E386R of SEQ ID NO:2, a substitution of V351M of SEQ ID NO:2, a substitution of K210N of SEQ ID NO:2, a substitution of D40A of SEQ ID NO:2, a substitution of E773G of SEQ ID NO:2, a substitution of H207L of SEQ ID NO:2, a substitution of T62A SEQ ID NO:2, a substitution of T287P of SEQ ID NO:2, a substitution of T832A of SEQ ID NO:2, a substitution of A893S of SEQ ID NO:2, an insertion of V at position 14 of SEQ ID NO:2, an insertion of AG at position 13 of SEQ ID NO:2, a substitution of RI IV of SEQ ID NO:2, a substitution of R12N of SEQ ID NO:2, a substitution of R13H of SEQ ID NO:2, an insertion of Y at position 13 of SEQ ID NO:2, a substitution of R12L of SEQ ID NO:2, an insertion of Q at position 13 of SEQ ID NO:2, an substitution of V15S of SEQ ID NO:2 and an insertion of D at position 17 of SEQ ID NO:2. In some embodiments, the at least two amino acid changes to a reference CasX protein are selected from the amino acid changes disclosed in the sequences of Table 3. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, a CasX variant protein comprises a substitution of S794R and a substitution of Y797L of SEQ ID NO:2. In some embodiments, a CasX variant protein comprises a substitution of K416E and a substitution of A708K of SEQ ID NO:2. In some embodiments, a CasX variant protein comprises a substitution of A708K and a deletion of P793 of SEQ ID NO:2. In some embodiments, a CasX variant protein comprises a deletion of P793 and an insertion of AS at position 795 SEQ ID NO:2. In some embodiments, a CasX variant protein comprises a substitution of Q367K and a substitution of I425S of SEQ ID NO:2. In some embodiments, a CasX variant protein comprises a substitution of A708K, a deletion of P position 793 and a substitution A793V of SEQ ID NO:2. In some embodiments, a CasX variant protein comprises a substitution of Q338R and a substitution of A339E of SEQ ID NO:2. In some embodiments, a CasX variant protein comprises a substitution of Q338R and a substitution of A339K of SEQ ID NO:2. In some embodiments, a CasX variant protein comprises a substitution of S507G and a substitution of G508R of SEQ ID NO:2. In some embodiments, a CasX variant protein comprises a substitution of L379R, a substitution of A708K and a deletion of P at position 793 of SEQ ID NO:2. In some embodiments, a CasX variant protein comprises a substitution of C477K, a substitution of A708K and a deletion of P at position 793 of SEQ ID NO:2. In some embodiments, a CasX variant protein comprises a substitution of L379R, a substitution of C477K, a substitution of A708K and a deletion of P at position of 793 of SEQ ID NO:2. In some embodiments, a CasX variant protein comprises a substitution of L379R, a substitution of A708K, a deletion of P at position 793 and a substitution A739V of SEQ ID NO:2. In some embodiments, a CasX variant protein comprises a substitution of C477K, a substitution of A708K, a deletion of P at position 793 and a substitution of A739V of SEQ ID NO:2. In some embodiments, a CasX variant protein comprises a substitution of L379R, a substitution of C477K, a substitution of A708K, a deletion of P at position 793 and a substitution of A739V of SEQ ID NO:2. In some embodiments, a CasX variant protein comprises a substitution of L379R, a substitution of A708K, a deletion of P at position 793 and a substitution of M779N of SEQ ID NO:2. In some embodiments, a CasX variant protein comprises a substitution of L379R, a substitution of A708K, a deletion of P at position 793 and a substitution of M771N of SEQ ID NO:2. In some embodiments, a CasX variant protein comprises a substitution of L379R, a substitution of 708K, a deletion of P at position 793 and a substitution of D489S of SEQ ID NO:2. In some embodiments, a CasX variant protein comprises a substitution of L379R, a substitution of A708K, a deletion of P at position 793 and a substitution of A739T of SEQ ID NO:2. In some embodiments, a CasX variant protein comprises a substitution of L379R, a substitution of A708K, a deletion of P at position 793 and a substitution of D732N of SEQ ID NO:2. In some embodiments, a CasX variant protein comprises a substitution of L379R, a substitution of A708K, a deletion of P at position 793 and a substitution of G791M of SEQ ID NO:2. In some embodiments, a CasX variant protein comprises a substitution of L379R, a substitution of 708K, a deletion of P at position 793 and a substitution of Y797L of SEQ ID NO:2. In some embodiments, a CasX variant protein comprises a substitution of L379R, a substitution of C477K, a substitution of A708K, a deletion of P at position 793 and a substitution of M779N of SEQ ID NO:2. In some embodiments, a CasX variant protein comprises a substitution of L379R, a substitution of C477K, a substitution of A708K, a deletion of P at position 793 and a substitution of M771N of SEQ ID NO:2. In some embodiments, a CasX variant protein comprises a substitution of L379R, a substitution of C477K, a substitution of A708K, a deletion of P at position 793 and a substitution of D489S of SEQ ID NO:2. In some embodiments, a CasX variant protein comprises a substitution of L379R, a substitution of C477K, a substitution of A708K, a deletion of P at position 793 and a substitution of A739T of SEQ ID NO:2. In some embodiments, a CasX variant protein comprises a substitution of L379R, a substitution of C477K, a substitution of A708K, a deletion of P at position 793 and a substitution of D732N of SEQ ID NO:2. In some embodiments, a CasX variant protein comprises a substitution of L379R, a substitution of C477K, a substitution of A708K, a deletion of P at position 793 and a substitution of G791M of SEQ ID NO:2. In some embodiments, a CasX variant protein comprises a substitution of L379R, a substitution of C477K, a substitution of A708K, a deletion of P at position 793 and a substitution of Y797L of SEQ ID NO:2. In some embodiments, a CasX variant protein comprises a substitution of L379R, a substitution of C477K, a substitution of A708K, a deletion of P at position 793 and a substitution of T620P of SEQ ID NO:2. In some embodiments, a CasX variant protein comprises a substitution of A708K, a deletion of P at position 793 and a substitution of E386S of SEQ ID NO:2. In some embodiments, a CasX variant protein comprises a substitution of E386R, a substitution of F399L and a deletion of P at position 793 of SEQ ID NO:2. In some embodiments, a CasX variant protein comprises a substitution of R581I and A739V of SEQ ID NO:2. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, a CasX variant protein comprises a substitution of A708K, a deletion of P at position 793 and a substitution of A739V of SEQ ID NO:2. In some embodiments, a CasX variant protein comprises a substitution of L379R, a substitution of A708K and a deletion of P at position 793 of SEQ ID NO:2. In some embodiments, a CasX variant protein comprises a substitution of C477K, a substitution of A708K and a deletion of P at position 793 of SEQ ID NO:2. In some embodiments, a CasX variant protein comprises a substitution of L379R, a substitution of C477K, a substitution of A708K and a deletion of P at position 793 of SEQ ID NO:2. In some embodiments, a CasX variant protein comprises a substitution of L379R, a substitution of A708K, a deletion of P at position 793 and a substitution of A739V of SEQ ID NO:2. In some embodiments, a CasX variant protein comprises a substitution of C477K, a substitution of A708K, a deletion of P at position 793 and a substitution of A739 of SEQ ID NO:2. In some embodiments, a CasX variant protein comprises a substitution of L379R, a substitution of C477K, a substitution of A708K, a deletion of P at position 793 and a substitution of A739V of SEQ ID NO:2. In some embodiments, a CasX variant protein comprises a substitution of L379R, a substitution of C477K, a substitution of A708K, a deletion of P at position 793 and a substitution of T620P of SEQ ID NO:2. In some embodiments, a CasX variant protein comprises a substitution of M771 A of SEQ ID NO:2. In some embodiments, a CasX variant protein comprises a substitution of L379R, a substitution of A708K, a deletion of P at position 793 and a substitution of D732N of SEQ ID NO:2. In some embodiments, a CasX variant comprises any combination of the foregoing embodiments of this paragraph.

In some embodiments, a CasX variant protein comprises a substitution of W782Q of SEQ ID NO:2. In some embodiments, a CasX variant protein comprises a substitution of M771Q of SEQ ID NO:2. In some embodiments, a CasX variant protein comprises a substitution of R4581 and a substitution of A739V of SEQ ID NO:2. In some embodiments, a CasX variant protein comprises a substitution of L379R, a substitution of A708K, a deletion of P at position 793 and a substitution of M771N of SEQ ID NO:2. In some embodiments, a CasX variant protein comprises a substitution of L379R, a substitution of A708K, a deletion of P at position 793 and a substitution of A739T of SEQ ID NO:2. In some embodiments, a CasX variant protein comprises a substitution of L379R, a substitution of C477K, a substitution of A708K, a deletion of P at position 793 and a substitution of D489S of SEQ ID NO:2. In some embodiments, a CasX variant protein comprises a substitution of L379R, a substitution of C477K, a substitution of A708K, a deletion of P at position 793 and a substitution of D732N of SEQ ID NO:2. In some embodiments, a CasX variant protein comprises a substitution of V711K of SEQ ID NO:2. In some embodiments, a CasX variant protein comprises a substitution of L379R, a substitution of C477K, a substitution of A708K, a deletion of P at position 793 and a substitution of Y797L of SEQ ID NO:2. In some embodiments, a CasX variant protein comprises a substitution of L379R, a substitution of A708K and a deletion of P at position 793 of SEQ ID NO:2. In some embodiments, a CasX variant protein comprises a substitution of L379R, a substitution of C477K, a substitution of A708K, a deletion of P at position 793 and a substitution of M771N of SEQ ID NO:2. In some embodiments, a CasX variant protein comprises a substitution of A708K, a substitution of P at position 793 and a substitution of E386S of SEQ ID NO:2. In some embodiments, a CasX variant protein comprises a substitution of L379R, a substitution of C477K, a substitution of A708K and a deletion of P at position 793 of SEQ ID NO:2. In some embodiments, a CasX variant protein comprises a substitution of L792D of SEQ ID NO:2. In some embodiments, a CasX variant protein comprises a substitution of G791F of SEQ ID NO:2. In some embodiments, a CasX variant protein comprises a substitution of A708K, a deletion of P at position 793 and a substitution of A739V of SEQ ID NO:2. In some embodiments, a CasX variant protein comprises a substitution of L379R, a substitution of A708K, a deletion of P at position 793 and a substitution of A739V of SEQ ID NO:2. In some embodiments, a CasX variant protein comprises a substitution of C477K, a substitution of A708K and a substitution of P at position 793 of SEQ ID NO:2. In some embodiments, a CasX variant protein comprises a substitution of L2491 and a substitution of M771N of SEQ ID NO:2. In some embodiments, a CasX variant protein comprises a substitution of V747K of SEQ ID NO:2. In some embodiments, a CasX variant protein comprises a substitution of L379R, a substitution of C477, a substitution of A708K, a deletion of P at position 793 and a substitution of M779N of SEQ ID NO:2. In some embodiments, a CasX variant protein comprises a substitution of F755M. In some embodiments, a CasX variant comprises any combination of the foregoing embodiments of this paragraph.

In some embodiments, a CasX variant protein comprises at least one modification compared to the reference CasX sequence of SEQ ID NO:2, wherein the at least one modification is selected from one or more of; an amino acid substitution of L379R; an amino acid substitution of A708K; an amino acid substitution of T620P; an amino acid substitution of E385P; an amino acid substitution of Y857R; an amino acid substitution of 1658V; an amino acid substitution of F399L; an amino acid substitution of Q252K; and an amino acid deletion of 1P7931. In some embodiments, a CasX variant protein comprises at least one modification compared to the reference CasX sequence of SEQ ID NO:2, wherein the at least one modification is selected from one or more of: an amino acid substitution of L379R; an amino acid substitution of A708K; an amino acid substitution of T620P; an amino acid substitution of E385P; an amino acid substitution of Y857R; an amino acid substitution of 1658V; an amino acid substitution of F399L; an amino acid substitution of Q252K; an amino acid substitution of L404K; and an amino acid deletion of [P793]. In other embodiments, a CasX variant protein comprises any combination of the foregoing substitutions or deletions compared to the reference CasX sequence of SEQ ID NO:2. In other embodiments, the CasX variant protein can, in addition to the foregoing substitutions or deletions, further comprise a substitution of an NTSB and/or a helical 1b domain from the reference CasX of SEQ ID NO:1.

In some embodiments, the CasX variant protein comprises between 400 and 2000 amino acids, between 500 and 1500 amino acids, between 700 and 1200 amino acids, between 800 and 1100 amino acids, or between 900 and 1000 amino acids.

In some embodiments, the CasX variant protein comprises one or more modifications in a region of non-contiguous residues that form a channel in which gNA:target DNA complexing occurs. In some embodiments, the CasX variant protein comprises one or more modifications comprising a region of non-contiguous residues that form an interface which binds with the gNA. For example, in some embodiments of a reference CasX protein, the helical I, helical II and OBD domains all contact or are in proximity to the gNA:target DNA complex, and one or more modifications to non-contiguous residues within any of these domains may improve function of the CasX variant protein.

In some embodiments, the CasX variant protein comprises one or more modifications in a region of non-contiguous residues that form a channel which binds with the non-target strand DNA. For example, a CasX variant protein can comprise one or more modifications to non-contiguous residues of the NTSBD. In some embodiments, the CasX variant protein comprises one or more modifications in a region of non-contiguous residues that form an interface which binds with the PAM. For example, a CasX variant protein can comprise one or more modifications to non-contiguous residues of the helical I domain or OBD. In some embodiments, the CasX variant protein comprises one or more modifications comprising a region of non-contiguous surface-exposed residues. As used herein, "surface-exposed residues" refers to amino acids on the surface of the CasX protein, or amino acids in which at least a portion of the amino acid, such as the backbone or a part of the side chain is on the surface of the protein. Surface exposed residues of cellular proteins such as CasX, which are exposed to an aqueous intracellular environment, are frequently selected from positively charged hydrophilic amino acids, for example arginine, asparagine, aspartate, glutamine, glutamate, histidine, lysine, serine, and threonine. Thus, for example, in some embodiments of the variants provided herein, a region of surface exposed residues comprises one or more insertions, deletions, or substitutions compared to a reference CasX protein. In some embodiments, one or more positively charged residues are substituted for one or more other positively charged residues, or negatively charged residues, or uncharged residues, or any combinations thereof. In some embodiments, one or more amino acids residues for substitution are near bound nucleic acid, for example residues in the RuvC domain or helical I domain that contact target DNA, or residues in the OBD or helical II domain that bind the gNA, can be substituted for one or more positively charged or polar amino acids.

In some embodiments, the CasX variant protein comprises one or more modifications in a region of non-contiguous residues that form a core through hydrophobic packing in a domain of the reference CasX protein. Without wishing to be bound by any theory, regions that form cores through hydrophobic packing are rich in hydrophobic amino acids such as valine, isoleucine, leucine, methionine, phenylalanine, tryptophan, and cysteine. For example, in some reference CasX proteins, RuvC domains comprise a hydrophobic pocket adjacent to the active site. In some embodiments, between 2 to 15 residues of the region are charged, polar, or base-stacking. Charged amino acids (sometimes referred to herein as residues) may include, for example, arginine, lysine, aspartic acid, and glutamic acid, and the side chains of these amino acids may form salt bridges provided a bridge partner is also present. Polar amino acids may include, for example, glutamine, asparagine, histidine, serine, threonine, tyrosine, and cysteine. Polar amino acids can, in some embodiments, form hydrogen bonds as proton donors or acceptors, depending on the identity of their side chains. As used herein, "base-stacking" includes the interaction of aromatic side chains of an amino acid residue (such as tryptophan, tyrosine, phenylalanine, or histidine) with stacked nucleotide bases in a nucleic acid. Any modification to a region of non-contiguous amino acids that are in close spatial proximity to form a functional part of the CasX variant protein is envisaged as within the scope of the disclosure.

i. CasX Variant Proteins with Domains from Multiple Source Proteins

In certain embodiments, the disclosure provides a chimeric CasX protein comprising protein domains from two or more different CasX proteins, such as two or more reference CasX proteins, or two or more CasX variant protein sequences as described herein. As used herein, a "chimeric CasX protein" refers to a CasX containing at least two domains isolated or derived from different sources, such as two naturally occurring proteins, which may, in some embodiments, be isolated from different species. For example, in some embodiments, a chimeric CasX protein comprises a first domain from a first CasX protein and a second domain from a second, different CasX protein. In some embodiments, the first domain can be selected from the group consisting of the NTSB, TSL, Helical I, Helical II, OBD and RuvC domains. In some embodiments, the second domain is selected from the group consisting of the NTSB, TSL, Helical I, Helical II, OBD and RuvC domains with the second domain being different from the foregoing first domain. For example, a chimeric CasX protein may comprise an NTSB, TSL, Helical I, Helical II, OBD domains from a CasX protein of SEQ ID NO:2, and a RuvC domain from a CasX protein of SEQ ID NO:1, or vice versa. As a further example, a chimeric CasX protein may comprise an NTSB, TSL, Helical II, OBD and RuvC domain from CasX protein of SEQ ID NO:2, and a Helical I domain from a CasX protein of SEQ ID NO:1, or vice versa. Thus, in certain embodiments, a chimeric CasX protein may comprise an NTSB, TSL, Helical II, OBD and RuvC domain from a first CasX protein, and a Helical I domain from a second CasX protein. In some embodiments of the chimeric CasX proteins, the domains of the first CasX protein are derived from the sequences of SEQ ID NO:1, SEQ ID NO:2 or SEQ ID NO:3, and the domains of the second CasX protein are derived from the sequences of SEQ ID NO:1, SEQ ID NO:2 or SEQ ID NO:3, and the first and second CasX proteins are not the same. In some embodiments, domains of the first CasX protein comprise sequences derived from SEQ ID NO:1 and domains of the second CasX protein comprise sequences derived from SEQ ID NO:2. In some embodiments, domains of the first CasX protein comprise sequences derived from SEQ ID NO:1 and domains of the second CasX protein comprise sequences derived from SEQ ID NO:3. In some embodiments, domains of the first CasX protein comprise sequences derived from SEQ ID NO:2 and domains of the second CasX protein comprise sequences derived from SEQ ID NO:3. In some embodiments, the CasX variant is selected of group consisting of CasX variants comprising SEQ ID NOS: 49-160.

In some embodiments, a CasX variant protein comprises at least one chimeric domain comprising a first part from a first CasX protein and a second part from a second, different CasX protein. As used herein, a "chimeric domain" refers to a domain containing at least two parts isolated or derived from different sources, such as two naturally occurring proteins or portions of domains from two reference CasX proteins. The at least one chimeric domain can be any of the NTSB, TSL, helical I, helical II, OBD or RuvC domains as described herein. In some embodiments, the first portion of a CasX domain comprises a sequence of SEQ ID NO:1 and the second portion of a CasX domain comprises a sequence of SEQ ID NO:2. In some embodiments, the first portion of the CasX domain comprises a sequence of SEQ ID NO:1 and the second portion of the CasX domain comprises a sequence of SEQ ID NO:3. In some embodiments, the first portion of the CasX domain comprises a sequence of SEQ ID NO:2 and the second portion of the CasX domain comprises a sequence of SEQ ID NO:3. In some embodiments, the at least one chimeric domain comprises a chimeric RuvC domain. As an example of the foregoing, the chimeric RuvC domain comprises amino acids 661 to 824 of SEQ ID NO:1 and amino acids 922 to 978 of SEQ ID NO:2. As an alternative example of the foregoing, a chimeric RuvC domain comprises amino acids 648 to 812 of SEQ ID NO:2 and amino acids 935 to 986 of SEQ ID NO:1. In some embodiments, a CasX protein comprises a first domain from a first CasX protein and a second domain from a second CasX protein, and at least one chimeric domain comprising at least two parts isolated from different CasX proteins using the approach of the embodiments described in this paragraph. In the foregoing embodiments, the chimeric CasX proteins having domains or portions of domains derived from SEQ ID NOS:1, 2 and 3, can further comprise amino acid insertions, deletions, or substitutions of any of the embodiments disclosed herein.

In some embodiments, a CasX variant protein comprises a sequence of SEQ ID NOS: 49-160, 237-239, 243-246, 251-263 or 273-281 as set forth in Tables 3, 6, 7, 8, or 10. In some embodiments, a CasX variant protein consists of a sequence of SEQ ID NOS: 49-160 as set forth in Table 3. In other embodiments, a CasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 890% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence of SEQ ID NOS: 49-160, 237-239, 243-246, 251-263 or 273-281. In other embodiments, a CasX variant protein comprises a sequence of SEQ ID NOS: 49-160 as set forth in Table 3, and further comprises one or more NLS disclosed herein at or near either the N-terminus, the C-terminus, or both. It will be understood that in some cases, the N-terminal methionine of the CasX variants of the Tables is removed from the expressed CasX variant during post-translational modification.

TABLE 3

CasX Variant Sequences

| Description* | Amino Acid Sequence |
|---|---|
| TSL, Helical I, Helical II, OBD and RuvC domains from SEQ ID NO: 2 and an NTSB domain from SEQ ID NO: 1 | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPASKKI DQNKLKPEMDEKGNLTTAGFACSQCGQPLFVYKLEQVSEKGKAYTNYFGRCNVA EHEKLILLAQLKPEKDSDEAVTYSLGKFGQRALDFYSIHVTRESNHPVKPLEQI GGNSCASGPVGKALSDACMGAVASFLTKYQDIILEHQKVIKKNEKRLANLKDIA SANGLAFPKITLPPQPHTKEGIEAYNNVVAQIVIWVNLNLWQKLKIGRDEAKPL QRLKGFPSFPLVERQANEVDWWDMVCNVKKLINEKKEDGKVFWQNLAGYKRQEA LRPYLSSEEDRKKGKKFARYQFGDLLLHLEKKHGEDWGKVYDEAWERIDKKVEG LSKHIKLEEERRSEDAQSKAALTDWLRAKASFVIEGLKEADKDEFCRCELKLQK WYGDLRGKPFAIEAENSILDISGFSKQYNCAFIWQKDGVKKLNLYLIINYFKGG KLRFKKIKPEAFEANRFYTVINKKSGEIVPMEVNFNFDDPNLIILPLAFGKRQG REFIWNDLLSLETGSLKLANGRVIEKTLYNRRTRQDEPALFVALTFERREVLDS SNIKPMNLIGIDRGENIPAVIALTDPEGCPLSRFKDSLGNPTHILRIGESYKEK QRTIQAKKEVEQRRAGGYSRKYASKAKNLADDMVRNTARDLLYYAVTQDAMLIF ENLSRGFGRQGKRTFMAERQYTRMEDWLTAKLAYEGLSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THADEQAALNIARSWLFLRSQEYKKYQTNKTTGNTDKRAFVETWQSFYRKKLKE VWKPAV (SEQ ID NO: 49) |
| NTSB, Helical I, Helical II, OBD and RuvC domains from SEQ ID NO: 2 and a TSL domain from SEQ ID NO: 1 | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDGKGPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLITNYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITTADYDGMLVRLKKTSDGWATTLNNKELKAEGQITYYNRYKRQTVEKE LSAELDRLSEESGNNDISKWTKGRRDEALFLLKKRFSHRPVQEQFVCLDCGHEV HADEQAALNIARSWLFLRSQEYKKYQTNKTTGNTDKRAFVETWQSFYRKKLKEV WKPAV (SEQ ID NO: 50) |
| TSL, Helical I, Helical II, OBD and RuvC domains from SEQ ID NO: 1 and an NTSB domain from SEQ ID NO: 2 | MEKRINKIRKKLSADNATKPVSRSGPMKTLLVRVMTDDLKKRLEKRRKKPEVMP QVISNNAANNLRMLLDDYTKMKEAILQVYWQEFKDDHVGLMCKFAQPAPKNIDQ RKLIPVKDGNERLTSSGFACSQCCQPLYVYKLEQVNDGKGPHTNYFGRCNVSEH ERLILLSPHKPEANDELVTYSLGKFGQRALDFYSIHVTKESTHPVKPLAQIAGN RYASGPVGKALSDACMGTIASFLSKYQDIIIEHQKVVKGNQKRLESLRELAGKE NLEYPSVTLPPQPHTKEGVDAYNEVIARVRMWVNLNLWQKLKLSRDDAKPLLRL KGFPSFPVVERRENEVDWWNTINEVKKLIDAKRDMGRVFWSGVTAEKRNTILEG YNYLPNENDHKKREGSLENPKKPAKRQFGDLLLYLEKKYAGDWGKVFDEAWERI DKKIAGLTSHIEREEARNAEDAQSKAVLTDWLRAKASFVLERLKEMDEKEFYAC EIQLQKWYGDLRGNPFAVEAENRVVDISGFSIGSDGHSIQYRNLLAWKYLENGK REFYLLMNYGKKGRIRFTDGTDIKKSGKWQGLLYGGGKAKVIDLTFDPDDEQLI ILPLAFGTRQGREFIWNDLLSLETGLIKLANGRVIEKTIYNKKIGRDEPALFVA LTFERREVVDPSNIKPVNLIGVDRGENIPAVLALTDPEGCPLPEFKDSSGGPTD ILRIGEGYKEKQRAIQAAKEVEQRRAGGYSRKFASKSRNLADDMVRNSARDLFY HAVTHDAVLVFENLSRGFGRQGKRTFMTERQYTKMEDWLTAKLAYEGLTSKTYL SKTLAQYTSKTCSNCGFTITTADYDGMLVRLKKTSDGWATTLNNKELKAEGQIT |

TABLE 3-continued

CasX Variant Sequences

| Description* | Amino Acid Sequence |
|---|---|
| | YYNRYKRQTVEKELSAELDRLSEESGNNDISKWTKGRRDEALFLLKKRFSHRPV<br>QEQFVCLDCGHEVHADEQAALNIARSWLFLNSNSTEFKSYKSGKQPFVGAWQAF<br>YKRRLKEVWKPNA (SEQ ID NO: 51) |
| NTSB, Helical I, Helical II, OBD and RuvC domains from SEQ ID NO: 1 and an TSL domain from SEQ ID NO: 2 | MEKRINKIRKKLSADNATKPVSRSGPMKTLLVRVMTDDLKKRLEKRRKKPEVMP<br>QVISNNAANNLRMLLDDYTKMKEAILQVYWQEFKDDHVGLMCKFAQPASKKIDQ<br>NKLKPEMDEKGNLTTAGFACSQCGQPLFVYKLEQVSEKGKAYTNYFGRCNVAEH<br>EKLILLAQLKPEKDSDEAVTYSLGKFGQRALDFYSIHVTKESTHPVKPLAQIAG<br>NRYASGPVGKALSDACMGTIASFLSKYQDIIIEHQKVVKGNQKRLESLRELAGK<br>ENLEYPSVTLPPQPHTKEGVDAYNEVIARVRMWVNLNLWQKLKLSRDDAKPLLR<br>LKGFPSFPVVERRENEVDWWNTINEVKKLIDAKRDMGRVFWSGVTAEKRNTILE<br>GYNYLPNENDHKKREGSLENPKKPAKRQFGDLLLYLEKKYAGDWGKVFDEAWER<br>IDKKIAGLTSHIEREEARNAEDAQSKAVLTDWLRAKASFVLERLKEMDEKEFYA<br>CEIQLQKWYGDLRGNPFAVEAENRVVDISGFSIGSDGHSIQYRNLLAWKYLENG<br>KREFYLLMNYGKKGRIRFTDGTDIKKSGKWQGLLYGGGKAKVIDLTFDPDDEQL<br>IILPLAFGTRQGREFIWNDLLSLETGLTKLANGRVIEKTIYNKKTGRDEPALFV<br>ALTFERREVVDPSNIKPVNLIGVDRGENIPAVIALTDPEGCPLPEFKDSSGGPT<br>DILRIGEGYKEKQRAIQAAKEVEQRRAGGYSRKFASKSRNLADDMVRNSARDLF<br>YHAVTHDAVLVFENLSRGFGRQGKRTFMTERQYTKMEDWLTAKLAYEGLTSKTY<br>LSKTLAQYTSKTCSNCGFTITSADYDRVLEKLKKTATGWMTTINGKELKVEGQI<br>TYYNRYKRQNVVKDLSVELDRLSEESVNNDISSWTKGRSGEALSLLKKRFSHRP<br>VQEKFVCLNCGFETHADEQAALNIARSWLFLNSNSTEFKSYKSGKQPFVGAWQA<br>FYKRRLKEVWKPNA (SEQ ID NO: 52) |
| NTSB, TSL, Helical I, Helical II and OBD domains SEQ ID NO: 2 and an exogenous RuvC domain or a portion thereof from a second CasX protein. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPVNLIGVDRGENIPAVIALTDPEGCPLPEFKDSSGGPTDILRIGEGYKEKQ<br>RAIQAAKEVEQRRAGGYSRKFASKSRNLADDMVRNSARDLFYHAVTHDAVLVFE<br>NLSRGFGRQGKRTFMTERQYTKMEDWLTAKLAYEGLTSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THA (SEQ ID NO: 53) |
| | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HA (SEQ ID NO: 54) |
| NTSB, TSL, Helical II, OBD and RuvC domains from SEQ ID NO: 2 and a Helical I domain from SEQ ID NO: 1 | MQEIKRINKIRRRLVKDSNTKKAGKTGPMKTLLVRVMTPDLRERLENLRKKPEN<br>IPQPISNNAANNLRMLLDDYTKMKEAILQVYWQEFKDDHVGLMCKFAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVTEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE |

TABLE 3-continued

CasX Variant Sequences

| Description* | Amino Acid Sequence |
|---|---|
| | NLSRGFGRQGKRTFMAERQYTRMEDWLTAKLAYEGLSKTYLSKTLAQYTSKTCS
NCGFTITSADYDRVLEKLKKTATGWMTTINGKELKVEGQITYYNRYKRQNVVKD
LSVELDRLSEESVNNDISSWTKGRSGEALSLLKKRFSHRPVQEKFVCLNCGFET
HADEQAALNIARSWLFLRSQEYKKYQTNKTTGNTDKRAFVETWQSFYRKKLKEV
WKPAV (SEQ ID NO: 55) |
| NTSB, TSL, Helical I, OBD and RuvC domains from SEQ ID NO: 2 and a Helical II domain from SEQ ID NO: 1 | MQEIKRINKIRRRLVKDSNTKKAGKTGPMKTLLVRVMTPDLRERLENLRKKPEN
IPQPISNTSRANLNKLLTDYTEMKKAILHVYWEEFQKDPVGLMSRVAQPAPKNI
DQRKLIPVKDGNERLTSSGFACSQCCQPLYVYKLEQVNDKGKPHTNYFGRCNVS
EHERLILLSPHKPEANDELVTYSLGKFGQRALDFYSIHVTRESNHPVKPLEQIG
GNSCASGPVGKALSDACMGAVASFLTKYQDIILEHQKVIKKNEKRLANLKDIAS
ANGLAFPKITLPPQPHTKEGIEAYNNVVAQIVIWVNLNWQKLKIGRDEAKPLQ
RLKGFPSFPVVERRENEVDWWNTINEVKKLIDAKRDMGRVFWSGVTAEKRNTIL
EGYNYLPNENDHKKREGSLENPKKPAKRQFGDLLLYLEKKYAGDWGKVFDEAWE
RIDKKIAGLTSHIEREEARNAEDAQSKAVLTDWLRAKASFVLERLKEMDEKEFY
ACEIQLQKWYGDLRGNPFAVEAENSILDISGFSKQYNCAFIWQKDGVKKLNLYL
IINYFKGGKLRFKKIKPEAFEANRFYTVINKKSGEIVPMEVNFNFDDPNLIILP
LAFGKRQGREFIWNDLLSLETGSLKLANGRVIEKTLYNRRTRQDEPALFVALTF
ERREVLDSSNIKPMNLIGIDRGENIPAVIALTDPEGCPLSRFKDSLGNPTHILR
IGESYKEKQRTIQAKKEVEQRRAGGYSRKYASKAKNLADDMVRNTARDLLYYAV
TQDAMLIFENLSRGFGRQGKRTFMAERQYTRMEDWLTAKLAYEGLSKTYLSKTL
AQYTSKTCSNCGFTITSADYDRVLEKLKKTATGWMTTINGKELKVEGQITYYNR
YKRQNVVKDLSVELDRLSEESVNNDISSWTKGRSGEALSLLKKRFSHRPVQEKE
VCLNCGFETHADEQAALNIARSWLFLRSQEYKKYQTNKTTGNTDKRAFVETWQS
FYRKKLKEVWKPAV (SEQ ID NO: 56) |
| NTSB, TSL, Helical I, Helical II and RuvC domains from a first CasX protein and an exogenous OBD or a part thereof from a second CasX protein | MISNTSRANLNKLLTDYTEMKKAILEVYWEEFQKDPVGLMSRVAQPAPKNIDQR
KLIPVKDGNERLTSSGFACSQCCQPLYVYKLEQVNDKGKPHTNYFGRCNVSEHE
RLILLSPHKPEANDELVTYSLGKFGQRALDFYSIHVTRESNEPVKPLEQIGGNS
CASGPVGKALSDACMGAVASFLTKYQDIILEHQKVIKKNEKRLANLKDIASANG
LAFPKITLPPQPHTKEGIEAYNNVVAQIVIWVNLNWQKLKIGRDEAKPLQRLK
GFPSFPLVERQANEVDWWDMVCNVKKLINEKKEDGKVFWQNLAGYKRQEALRPY
LSSEEDRKKGKKFARYQFGDLLLELEKKHGEDWGKVYDEAWERIDKKVEGLSKH
IKLEEERRSEDAQSKAALTDWLRAKASFVIEGLKEADKDEFCRCELKLQKWYGD
LRGKPFAIEAENRVVDISGFSIGSDGHSIQYRNLLAWKYLENGKREFYLLMNYG
KKGRIRFTDGTDIKKSGKWQGLLYGGGKAKVIDLTFDPDDEQLIILPLAFGTRQ
GREFIWNDLLSLETGLIKLANGRVIEKTIYNKKIGRDEPALFVALTFERREVVD
PSNIKPMNLIGIDRGENIPAVIALTDPEGCPLSRFKDSLGNPTHILRIGESYKE
KQRTIQAKKEVEQRRAGGYSRKYASKAKNLADDMVRNTARDLLYYAVTQDAMLI
FENLSRGFGRQGKRTFMAERQYTRMEDWLTAKLAYEGLSKTYLSKTLAQYTSKT
CSNCGFTITSADYDRVLEKLKKTATGWMTTINGKELKVEGQITYYNRYKRQNVV
KDLSVELDRLSEESVNNDISSWTKGRSGEALSLLKKRFSHRPVQEKFVCLNCGF
ETHADEQAALNIARSWLFLRSQEYKKYQTNKTTGNTDKRAFVETWQSFYRKKLK
EVWKPAV (SEQ ID NO: 57)

MEKRINKIRKKLSADNATKPVSRSGPMKTLLVRVMTDDLKKRLEKRRKKPEVMP
QVISNTSRANLNKLLTDYTEMKKAILHVYWEEFQKDPVGLMSRVAQPAPKNIDQ
RKLIPVKDGNERLTSSGFACSQCCQPLYVYKLEQVNDKGKPHTNYFGRCNVSEH
ERLILLSPHKPEANDELVTYSLGKFGQRALDFYSIHVTRESNHPVKPLEQIGGN
SCASGPVGKALSDACMGAVASFLTKYQDIILEHQKVIKKNEKRLANLKDIASAN
GLAFPKITLPPQPHTKEGIEAYNNVVAQIVIWVNLNWQKLKIGRDEAKPLQRL
KGFPSFPLVERQANEVDWWDMVCNVKKLINEKKEDGKVFWQNLAGYKRQEALRP
YLSSEEDRKKGKKFARYQFGDLLLHLEKKHGEDWGKVYDEAWERIDKKVEGLSK
HIKLEEERRSEDAQSKAALTDWLRAKASFVIEGLKEADKDEFCRCELKLQKWYG
DLRGKPFAIEAENSILDISGFSKQYNCAFIWQKDGVKKLNLYLIINYFKGGKLR
FKKIKPEAFEANRFYTVINKKSGEIVPMEVNFNFDDPNLIILPLAFGKRQGREF
IWNDLLSLETGSLKLANGRVIEKTLYNRRTRQDEPALFVALTFERREVLDSSNI
KPMNLIGIDRGENIPAVIALTDPEGCPLSRFKDSLGNPTHILRIGESYKEKQRT
IQAKKEVEQRRAGGYSRKYASKAKNLADDMVRNTARDLLYYAVTQDAMLIFENL
SRGFGRQGKRTFMAERQYTRMEDWLTAKLAYEGLSKTYLSKTLAQYTSKTCSNC
GFTITSADYDRVLEKLKKTATGWMTTINGKELKVEGQITYYNRYKRQNVVKDLS
VELDRLSEESVNNDISSWTKGRSGEALSLLKKRFSHRPVQEKFVCLNCGFETHA
DEQAALNIARSWLFLRSQEYKKYQTNKTTGNTDKRAFVETWQSFYRKKLKEVWK
PAV (SEQ ID NO: 58)

MQEIKRINKIRRRLVKDSNTKKAGKTGPMKTLLVRVMTPDLRERLENLRKKPEN
IPQPISNTSRANLNKLLTDYTEMKKAILHVYWEEFQKDPVGLMSRVAQPAPKNI
DQRKLIPVKDGNERLTSSGFACSQCCQPLYVYKLEQVNDKGKPHTNYFGRCNVS
EHERLILLSPHKPEANDELVTYSLGKFGQRALDFYSIHVTRESNHPVKPLEQIG
GNSCASGPVGKALSDACMGAVASFLTKYQDIILEHQKVIKKNEKRLANLKDIAS
ANGLAFPKITLPPQPHTKEGIEAYNNVVAQIVIWVNLNWQKLKIGRDEAKPLQ
RLKGFPSFPLVERQANEVDWWDMVCNVKKLINEKKEDGKVFWQNLAGYKRQEAL
RPYLSSEEDRKKGKKFARYQFGDLLLHLEKKHGEDWGKVYDEAWERIDKKVEGL
SKHIKLEEERRSEDAQSKAALTDWLRAKASFVIEGLKEADKDEFCRCELKLQKW
YGDLRGKPFAIEAENRVVDISGFSIGSDGHSIQYRNLLAWKYLENGKREFYLLM
NYGKKGRIRFTDGTDIKKSGKWQGLLYGGGKAKVIDLTFDPDDEQLIILPLAFG |

TABLE 3-continued

CasX Variant Sequences

| Description* | Amino Acid Sequence |
|---|---|
| | TRQGREFIWNDLLSLETGLIKLANGRVIEKTIYNKKIGRDEPALFVALTFERRE<br>VVDPSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYYAVTQDA<br>MLIFENLSRGFGRQKRTFMAERQYTRMEDWLTAKLAYEGLSKTYLSKTLAQYT<br>SKTCSNCGFTITSADYDRVLEKLKKTATGWMTTINGKELKVEGQITYYNRYKRQ<br>NVVKDLSVELDRLSEESVNNDISSWTKGRSGEALSLLKKRFSHRPVQEKFVCLN<br>CGFETHADEQAALNIARSWLFLRSQEYKKYQTNKTTGNTDKRAFVETWQSFYRK<br>KLKEVWKPAV (SEQ ID NO: 59) |
| substitution of L379R, a substitution of C477K, a substitution of A708K, a deletion of P at position 793 and a substitution of T620P of SEQ ID NO: 2 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 60) |
| substitution of M771A of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFAAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPA (SEQ ID NO: 61) |
| substitution of L379R, a substitution of A708K, a deletion of P at position 793 and a substitution of D732N of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 62) |
| substitution of W782Q of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL |

TABLE 3-continued

CasX Variant Sequences

| Description* | Amino Acid Sequence |
|---|---|
| | LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFMAERQYTRMEDQLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>WKPAV (SEQ ID NO: 63) |
| substitution of M771Q of SEQ ID NO: 2 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFQAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 64) |
| substitution of R458I and a substitution of A739V of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWIIAKASFVIEGLKEADKDEFQRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTVRDLLYYAVTQDAMLIFE<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 65) |
| L379R, a substitution of A708K, a deletion of P at position 793 and a substitution of M771N of SEQ ID NO: 2 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFNAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 66) |
| substitution of L379R, a substitution | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS |

TABLE 3-continued

CasX Variant Sequences

| Description* | Amino Acid Sequence |
| --- | --- |
| of A708K, a deletion of P at position 793 and a substitution of A739T of SEQ ID NO: 2 | EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTTRDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 67) |
| substitution of L379R, a substitution of C477K, a substitution of A708K, a deletion of P at position 793 and a substitution of D489S of SEQ ID NO: 2. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLTPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGSLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNTARSWLFLRSQEYKKYQTNKTTGNTDKRAFVETWQSFYRKKLKEV WKPAV (SEQ ID NO: 68) |
| substitution of L379R, a substitution of C477K, a substitution of A708K, a deletion of P at position 793 and a substitution of D732N of SEQ ID NO: 2. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLANDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 69) |
| substitution of V711K of SEQ ID NO: 2. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKEKEQRRAGGYSRKYASKAKNLADDMVRNTARDLLYYAVTQDAMLIFE NLSRGFGRQGKRTFMAERQYTRMEDWLTAKLAYEGLPSKTYLSKTLAQYTSKTC SNCGFTITSADYDRVLEKLKKTATGWMTTINGKELKVEGQITYYNRYKRQNVVK DLSVELDRLSEESVNNDISSWTKGRSGEALSLLKKRFSHRPVQEKFVCLNCGFE THADEQAALNIARSWLFLRSQEYKKYQTNKTTGNTDKRAFVETWQSFYRKKLKE VWKPAV (SEQ ID NO: 70) |

TABLE 3-continued

CasX Variant Sequences

| Description* | Amino Acid Sequence |
|---|---|
| substitution of L379R, a substitution of C477K, a substitution of A708K, a deletion of P at position 793 and a substitution of Y797L of SEQ ID NO: 2. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASFVIEGLKEADKDEFKRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTLLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 71) |
| 119: substitution of L379R, a substitution of A708K and a deletion of P at position 793 of SEQ ID NO: 2. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASEVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENTPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 72) |
| substitution of L379R, a substitution of C477K, a substitution of A708K, a deletion of P at position 793 and a substitution of M771N of SEQ ID NO: 2. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL RPYLSSEEDRKKGKKFARYQFGDLLLHLEKKHGEDWGKVYDEAWERIDKKVEGL SKHIKLEEERRSEDAQSKAALTDWLRAKASEVIEGLKEADKDEFKRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFNAERQYTRMEDWLTAKLAYEGLSKTYLSKTLAQYTSKTCS NCGFTITSADYDRVLEKLKKTATGWMTTINGKELKVEGQITYYNRYKRQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 73) |
| substitution of A708K, a deletion of P at position 793 and a substitution of E386S of SEQ ID NO: 2. | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPLVERQANEVDWWDMVCNVKKLINEKKEDGKVFWQNLAGYKRQEAL LPYLSSESDRKKGKKFARYQFGDLLLHLEKKHGEDWGKVYDEAWERIDKKVEGL SKHIKLEEERRSEDAQSKAALTDWLRAKASFVIEGLKEADKDEFKRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS |

TABLE 3-continued

CasX Variant Sequences

| Description* | Amino Acid Sequence |
|---|---|
| | NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 74) |
| substitution of L379R, a substitution of C477K, a substitution of A708K and a deletion of P at position 793 of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 75) |
| substitution of L792D of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFQRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGDPSKTYLSKTLAQYTSKTC<br>SNCGETITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 76) |
| substitution of G791F of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEFLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 77) |
| substitution of A708K, a deletion of P at position 793 and a substitution of A739V of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR |

TABLE 3-continued

CasX Variant Sequences

| Description* | Amino Acid Sequence |
|---|---|
| | EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRPAGGYSRKYASKAKNLADDMVRNTVRDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 78) |
| substitution<br>of L379R, a<br>substitution<br>of A708K, a<br>deletion of P<br>at position<br>793 and a<br>substitution<br>of A739V of<br>SEQ ID<br>NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTVRDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 79) |
| substitution<br>of C477K, a<br>substitution<br>of A708K<br>and a<br>deletion of P<br>at position<br>793 of SEQ<br>ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 80) |
| substitution<br>of L249I and<br>a substitution<br>of M771N of<br>SEQ ID<br>NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIITEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQGKRTFNAERQYTRMEDWLTAKLAYEGLPSKTYLSKTLAQYTSKTC<br>SNCGFTITSADYDRVLEKLKKTATGWMTTINGKELKVEGQITYYNRYKQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 81) |
| substitution<br>of V747K of<br>SEQ ID<br>NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL |

TABLE 3-continued

CasX Variant Sequences

| Description* | Amino Acid Sequence |
|---|---|
| | LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAKTQDAMLIFE<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 82) |
| substitution of L379R, a substitution of C477K, a substitution of A708K, a deletion of P at position 793 and a substitution of M779N of SEQ ID NO: 2. | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFKRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRNEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSATKGRSGEALSLLKKRFSHRPVQEKFVCLNCGFET<br>HADEQAALNIARSWLFLRS2EYKKYQTNKTTGNTDKRAFVETWQSFYRKKLKEV<br>WKPAV (SEQ ID NO: 83) |
| L379R, F755M | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLTLLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIME<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 84) |
| 429: L379R, A708K, P793_, Y857R | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLITNYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 85) |
| 430: L379R, A708K, | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS |

TABLE 3-continued

CasX Variant Sequences

| Description* | Amino Acid Sequence |
|---|---|
| P793_,<br>Y857R,<br>I658V | EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASEVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 86) |
| 431:<br>L379R,<br>A708K,<br>P793_,<br>Y857R,<br>I658V,<br>E386N | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 87) |
| 432:<br>L379R,<br>A708K,<br>P793_,<br>Y857R,<br>I658V,<br>L404K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 88) |
| 433:<br>L379R,<br>A708K,<br>P793_,<br>Y857R,<br>I658V,<br>^V192 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQI<br>GGNSCASGPVGKALSDACMGAVASFLTKYQDIILEHQKVIKKNEKRLANLKDIA<br>SANGLAFPKITLPPQPHTKEGIEAYNNVVAQIVIWVNLNLWQKLKIGRDEAKPL<br>QRLKGFPSFPLVERQANEVDWWDMVCNVKKLINEKKEDGKVFWQNLAGYKRQEA<br>LRPYLSSEEDRKKGKKFARYQFGDLLLHLEKKHGEDWGKVYDEAWERIDKKVEG<br>LSKHIKLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYFKGG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGVDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLSKTYLSKTLAQYTSKTC<br>SNCGFTITSADYDRVLEKLKKTATGWMTTINGKELKVEGQITYYNRRKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>WKPAV (SEQ ID NO: 89) |

TABLE 3-continued

CasX Variant Sequences

| Description* | Amino Acid Sequence |
|---|---|
| 434:<br>L379R,<br>A708K,<br>P793_,<br>Y857R,<br>I658V,<br>L404K,<br>E386N | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLKHLEKKHGEDWGKVYDEAWERIDKKVEGL<br>SKHIKLEEERRSEDAQSKAALTDWLRAKASFVIEGLKEADKDEFQRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 90) |
| 435:<br>L379R,<br>A708K,<br>P793_,<br>Y857R,<br>I658V,<br>F399L | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 91) |
| 436:<br>L379R,<br>A708K,<br>P793_,<br>Y857R,<br>I658V,<br>F399L,<br>E386N | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 92) |
| 437:<br>L379R,<br>A708K,<br>P793_,<br>Y857R,<br>I658V,<br>F399L,<br>C477S | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASEVIEGLKEADKDEFSRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS |

TABLE 3-continued

CasX Variant Sequences

| Description* | Amino Acid Sequence |
|---|---|
| | NCGFTITSADYDRVLEKLKKTATGWMTTINGKELKVEGQITYYNRRKQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 93) |
| 438:<br>L379R,<br>A708K,<br>P793_,<br>Y857R,<br>I658V,<br>F399L,<br>L404K | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPPLVERQANEVDWWDMVCNVKKLINEKKEDGKVFWQNLAGYKRQEAL RPYLSSEEDRKKGKKFARYQLGDLLKHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGVDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRRKQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 94) |
| 439:<br>L379R,<br>A708K,<br>P793_,<br>Y857R,<br>I658V,<br>F399L,<br>E386N,<br>C477S,<br>L404K | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPPLVERQANEVDWWDMVCNVKKLINEKKEDGKVFWQNLAGYKRQEAL RPYLSSENDRKKGKKFARYQLGDLLKHLEKKHGEDWGKVYDEAWERIDKKVEGL SKHIKLEEERRSEDAQSKAALTDWLRAKASFVIEGLKEADKDEFSRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGVDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTYLSKTLAQYTSKTCS NCGFTITSADYDRVLEKLKKTATGWMTTINGKELKVEGQITYYNRRKQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 95) |
| 440:<br>L379R,<br>A708K,<br>P793_,<br>Y857R,<br>I658V,<br>F399L,<br>Y797L | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPPLVERQANEVDWWDMVCNVKKLINEKKEDGKVFWQNLAGYKRQEAL RPYLSSEEDRKKGKKFARYQLGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR EFIWNDLLSLETGSLKLANGRVIEKTLYNRRTRQDEPALFVALTFERREVLDSS NIKPMNLIGVDRGENIPAVIALTDPEGCPLSRFKDSLGNPTHILRIGESYKEKQ RTIQAKKEVEQRRAGGYSRKYASKAKNLADDMVRNTARDLLYYAVTQDAMLIFE NLSRGFGRQGKRTFMAERQYTRMEDWLTAKLAYEGLSKTLLSKTLAQYTSKTCS NCGFTITSADYDRVLEKLKKTATGWMTTINGKELKVEGQITYYNRRKQNVVKD LSVELDRLSEESVNNDISSWTKGRSGEALSLLKKRFSHRPVQEKFVCLNCGFET HADEQAALNIARSWLFLRSQEYKKYQTNKTTGNTDKRAFVETWQSFYRKKLKEV WKPAV (SEQ ID NO: 96) |
| 441:<br>L379R,<br>A708K,<br>P793_,<br>Y857R,<br>I658V,<br>F399L,<br>Y797L,<br>E386N | MQEIKRINKIRRRLVKDSNTKKAGKTGPMKTLLVRVMTPDLRERLENLRKKPEN IPQPISNTSRANLNKLLTDYTEMKKAILHVYWEEFQKDPVGLMSRVAQPAPKNI DQRKLIPVKDGNERLTSSGFACSQCCQPLYVYKLEQVNDKGKPHTNYFGRCNVS EHERLILLSPHKPEANDELVTYSLGKFGQRALDFYSIHVTRESNHPVKPLEQIG GNSCASGPVGKALSDACMGAVASFLTKYQDIILEHQKVIKKNEKRLANLKDIAS ANGLAFPKITLPPQPHTKEGIEAYNNVVAQIVIWVNLNLWQKLKIGRDEAKPLQ RLKGFPSFPPLVERQANEVDWWDMVCNVKKLINEKKEDGKVFWQNLAGYKRQEAL RPYLSSENDRKKGKKFARYQLGDLLLHLEKKHGEDWGKVYDEAWERIDKKVEGL SKHIKLEEERRSEDAQSKAALTDWLRAKASFVIEGLKEADKDEFCRCELKLQKW YGDLRGKPFAIEAENSILDISGFSKQYNCAFIWQKDGVKKLNLYLIINYFKGGK LRFKKIKPEAFEANRFYTVINKKSGEIVPMEVNFNFDDPNLIILPLAFGKRQGR |

TABLE 3-continued

CasX Variant Sequences

| Description* | Amino Acid Sequence |
|---|---|
| | EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTLLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 97) |
| 442:<br>L379R,<br>A708K,<br>P793_,<br>Y857R,<br>I658V,<br>F399L,<br>Y797L,<br>E386N,<br>C477S,<br>L404K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQLGDLLHLEKKHGEDWGKVYDEAWERIDKKVEGL<br>SKHIKLEEERRSEDAQSKAALTDWLRAKASFVIEGLKEADKDEFSRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTLLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 98) |
| 443:<br>L379R,<br>A708K,<br>P793_,<br>Y857R,<br>I658V,<br>Y797L | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTLLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 99) |
| 444:<br>L379R,<br>A708K,<br>P793_,<br>Y857R,<br>I658V,<br>Y797L,<br>L404K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLKHLEKKHGEDWGKVYDEAWERIDKKVEGL<br>SKHIKLEEERRSEDAQSKAALTDWLRAKASEVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTLLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 100) |
| 445:<br>L379R,<br>A708K,<br>P793_,<br>Y857R,<br>I658V,<br>Y797L, | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL |

TABLE 3-continued

CasX Variant Sequences

| Description* | Amino Acid Sequence |
|---|---|
| E386N | RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTLLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 101) |
| 446:<br>L379R,<br>A708K,<br>P793_,<br>Y857R,<br>I658V,<br>Y797L,<br>E386N,<br>C477S,<br>L404K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFSRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTLLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 102) |
| 447:<br>L379R,<br>A708K,<br>P793_,<br>Y857R,<br>E386N | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 103) |
| 448:<br>L379R,<br>A708K,<br>P793_,<br>Y857R,<br>E386N,<br>L404K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFQRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 104) |
| 449:<br>L379R,<br>A708K, | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS |

TABLE 3-continued

CasX Variant Sequences

| Description* | Amino Acid Sequence |
|---|---|
| P793_,<br>D732N,<br>E385P,<br>Y857R | EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 105) |
| 450:<br>L379R,<br>A708K,<br>P793_,<br>D732N,<br>E385P,<br>Y857R,<br>I658V | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRPAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 106) |
| 451:<br>L379R,<br>A708K,<br>P793_,<br>D732N,<br>E385P,<br>Y857R,<br>I658V,<br>F399L | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 107) |
| 452:<br>L379R,<br>A708K,<br>P793_,<br>D732N,<br>E385P,<br>Y857R,<br>I658V,<br>E386N | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPNDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 108) |

TABLE 3-continued

CasX Variant Sequences

| Description* | Amino Acid Sequence |
|---|---|
| 453:<br>L379R,<br>A708K,<br>P793_,<br>D732N,<br>E385P,<br>Y857R,<br>I658V,<br>L404K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLANDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 109) |
| 454:<br>L379R,<br>A708K,<br>P793_,<br>T620P,<br>E385P,<br>Y857R,<br>Q252K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 110) |
| 455:<br>L379R,<br>A708K,<br>P793_,<br>T620P,<br>E385P,<br>Y857R,<br>I658V,<br>Q252K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 111) |
| 456:<br>L379R,<br>A708K,<br>P793_,<br>T620P,<br>E385P,<br>Y857R,<br>I658V,<br>E386N,<br>Q252K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSPNDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENTPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS |

TABLE 3-continued

CasX Variant Sequences

| Description* | Amino Acid Sequence |
|---|---|
| | NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 112) |
| 457:<br>L379R,<br>A708K,<br>P793_,<br>T620P,<br>E385P,<br>Y857R,<br>I658V,<br>F399L,<br>Q252K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNWQKLKIGRDEAKPLQ<br>RLKGFPSFPPLVERQANEVDWWDMVCNVKKLINEKKEDGKVFWQNLAGYKRQEAL<br>RPYLSSPEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLITNYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRPAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 113) |
| 458:<br>L379R,<br>A708K,<br>P793_,<br>T620P,<br>E385P,<br>Y857R,<br>I658V,<br>L404K<br>Q252K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNWQKLKIGRDEAKPLQ<br>RLKGFPSFPPLVERQANEVDWWDMVCNVKKLINEKKEDGKVFWQNLAGYKRQEAL<br>RPYLSSPEDRKKGKKFARYQFGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 114) |
| 459:<br>L379R,<br>A708K,<br>P793_,<br>T620P,<br>Y857R,<br>I658V,<br>E386N | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPPLVERQANEVDWWDMVCNVKKLINEKKEDGKVFWQNLAGYKRQEAL<br>RPYLSSENDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKPLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 115) |
| 460:<br>L379R,<br>A708K,<br>P793_,<br>T620P,<br>E385P,<br>Q252K | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHKKVIKKNEKRLANLKDIAS<br>ANGLAFPKITLPPQPHTKEGIEAYNNVVAQIVIWVNLNWQKLKIGRDEAKPLQ<br>RLKGFPSFPPLVERQANEVDWWDMVCNVKKLINEKKEDGKVFWQNLAGYKRQEAL<br>RPYLSSPEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR |

TABLE 3-continued

CasX Variant Sequences

| Description* | Amino Acid Sequence |
|---|---|
| | EFIWNDLLSLETGSLKLANGRVIEKPLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKGRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 116) |
| 278 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNID<br>QRKLIPVKDGNERLTSSGFACSQCCQPLYVYKLEQVNDKGKPHTNYFGRCNVSE<br>HERLILLSPHKPEANDELVTYSLGKFGQRALDFYSIHVTRESNHPVKPLEQIGG<br>NSCASGPVGKALSDACMGAVASFLTKYQDIILEHQKVIKKNEKRLANLKDIASA<br>NGLAFPKITLPPQPHTKEGIEAYNNVVAQIVIWVNLNLWQKLKIGRDEAKPLQR<br>LKGFPSFPLVERQANEVDWWDMVCNVKKLINEKKEDGKVFWQNLAGYKRQEALR<br>PYLSSEEDRKKGKKFARYQFGDLLLHLEKKHGEDWGKVYDEAWERIDKKVEGLS<br>KHIKLEEERRSEDAQSKAALTDWLRAKASFVIEGLKEADKDEFCRCELKLQKWY<br>GDLRGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVLDSSN<br>IKPMNLIGIDRGENIPAVIALTDPEGCPLSRFKDSLGNPTHILRIGESYKEKQR<br>TIQAKKEVEQRRAGGYSRKYASKAKNLADDMVRNTARDLLYYAVTQDAMLIFEN<br>LSRGFGRQGKRTFMAERQYTRMEDWITAKLAYEGLSKTYLSKTLAQYTSKTCSN<br>CGFTITSADYDRVLEKLKKTATGWMTTINGKELKVEGQITYYNRYKRQNVVKDL<br>SVELDRLSEESVNNDISSWTKGRSGEALSLLKKRFSHRPVQEKFVCLNCGFETH<br>ADEQAALNIARSWLFLRSQEYKKYQTNKTTGNTDKRAFVETWQSFYRKKLKEVW<br>KPAV (SEQ ID NO: 117) |
| 279 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQFALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASEVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 118) |
| 280 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKGRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 119) |
| 285 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL |

TABLE 3-continued

CasX Variant Sequences

| Description* | Amino Acid Sequence |
|---|---|
| | RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRPAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 120) |
| 286 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 121) |
| 287 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 122) |
| 288 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTMSSGEACSQCCQPLYVYKLEQVNDKGKPHTNYFGRCNV<br>SEHERLILLSPHKPEANDELVTYSLGKFGQRALDFYSIHVTRESNHPVKPLEQI<br>GGNSCASGPVGKALSDACMGAVASFLTKYQDIILEHQKVIKKNEKRLANLKDIA<br>SANGLAFPKITLPPQPHTKEGIEAYNNVVAQIVIWVNLNLWQKLKIGRDEAKPL<br>QRLKGFPSFPLVERQANEVDWWDMVCNVKKLINEKKEDGKVFWQNLAGYKRQEA<br>LRPYLSSEEDRKKGKKFARYQFGDLLLHLEKKHGEDWGKVYDEAWERIDKKVEG<br>LSKHIKLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYFKGG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGIDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 123) |
| 290 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS |

TABLE 3-continued

CasX Variant Sequences

| Description* | Amino Acid Sequence |
|---|---|
| | EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFTWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 124) |
| 291 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 125) |
| 293 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 126) |
| 300 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 127) |

TABLE 3-continued

CasX Variant Sequences

| Description* | Amino Acid Sequence |
|---|---|
| 492 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 128) |
| 493 | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 129) |
| 387:<br>NTSB swap<br>from SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 130) |
| 395:<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNID<br>QRKLIPVKDGNERLTSSGFACSQCCQPLYVYKLEQVNDKGKPHTNYFGRCNVSE<br>HERLILLSPHKPEANDELVTYSLGKFGQRALDFYSIHVTKESTHPVKPLAQIAG<br>NRYASGPVGKALSDACMGTIASFLSKYQDIIIEHQKVVKGNQKRLESLRELAGK<br>ENLEYPSVTLPPQPHTKEGVDAYNEVIARVRMWVNLNLWQKLKLSRDDAKPLLR<br>LKGFPSFPLVERQANEVDWWDMVCNVKKLINEKKEDGKVFWQNLAGYKRQEALR<br>PYLSSEEDRKKGKKFARYQFGDLLLHLEKKHGEDWGKVYDEAWERIDKKVEGLS<br>KHIKLEEERRSEDAQSKAALTDWLRAKASFVIEGLKEADKDEFCRCELKLQKWY<br>GDLRGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQGRE<br>FIWNDLLSLETGSLKLANGRVIEKTLYNRRTRQDEPALEVALTFERREVIDSSN<br>IKPMNLIGIDRGENIPAVIALTDPEGCPLSRFKDSLGNPTHILRIGESYKEKQR<br>TIQAKKEVEQRRAGGYSRKYASKAKNLADDMVRNTARDLLYYAVTQDAMLIFEN<br>LSRGFGRQGKRTFMAERQYTRMEDWLTAKLAYEGLSKTYLSKTLAQYTSKTCSN |

TABLE 3-continued

CasX Variant Sequences

| Description* | Amino Acid Sequence |
|---|---|
| | CGFTITSADYDRVLEKLKKTATGWMTTINGKELKVEGQITYYNRYKRQNVVKDL<br>SVELDRLSEESVNNDISSWTKGRSGEALSLLKKRFSHRPVQEKFVCLNCGFETH<br>ADEQAALNIARSWLFLRSQEYKKYQTNKTTGNTDKRAFVETWQSFYRKKLKEVW<br>KPAV (SEQ ID NO: 131) |
| 485:<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNID<br>QRKLIPVKDGNERLTSSGFACSQCCQPLYVYKLEQVNDKGKPHTNYFGRCNVSE<br>HERLILLSPHKPEANDELVTYSLGKFGQRALDFYSIHVTKESTHPVKPLAQIAG<br>NRYASGPVGKALSDACMGTIASFLSKYQDIIIEHQKVVKGNQKRLESLRELAGK<br>ENLEYPSVTLPPQPHTKEGVDAYNEVIARVRMWVNLNLWQKLKLSRDDAKPLLR<br>LKGFPSFPLVERQANEVDWWDMVCNVKKLINEKKEDGKVFWQNLAGYKRQEALR<br>PYLSSEEDRKKGKKFARYQLGDLLLHLEKKHGEDWGKVYDEAWERIDKKVEGLS<br>KHIKLEEERRSEDAQSKAALTDWLRAKASFVIEGLKEADKDEFCRCELKLQKWY<br>GDLRGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVLDSSN<br>IKPMNLIGVDRGENIPAVIALTDPEGCPLSRFKDSLGNPTHILRIGESYKEKQR<br>TIQAKKEVEQRRAGGYSRKYASKAKNLADDMVRNTARDLLYYAVTQDAMLIFEN<br>LSRGFGRQGKRTFMAERQYTRMEDWLTAKLAYEGLSKTYLSKTLAQYTSKTCSN<br>CGFTITSADYDRVLEKLKKTATGWMTTINGKELKVEGQITYYNRRKRQNVVKDL<br>SVELDRLSEESVNNDISSWTKGRSGEALSLLKKRFSHRPVQEKFVCLNCGFETH<br>ADEQAALNIARSWLFLRSQEYKKYQTNKTTGNTDKRAFVETWQSFYRKKLKEVW<br>KPAV (SEQ ID NO: 132) |
| 486:<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNID<br>QRKLIPVKDGNERLTSSGFACSQCCQPLYVYKLEQVNDKGKPHTNYFGRCNVSE<br>HERLILLSPHKPEANDELVTYSLGKFGQRALDFYSIHVTKESTHPVKPLAQIAG<br>NRYASGPVGKALSDACMGTIASFLSKYQDIIIEHQKVVKGNQKRLESLRELAGK<br>ENLEYPSVTLPPQPHTKEGVDAYNEVIARVRMWVNLNLWQKLKLSRDDAKPLLR<br>LKGFPSFPLVERQANEVDWWDMVCNVKKLINEKKEDGKVFWQNLAGYKRQEALR<br>PYLSSEEDRKKGKKFARYQLGDLLKHLEKKHGEDWGKVYDEAWERIDKKVEGLS<br>KHIKLEEERRSEDAQSKAALTDWLRAKASFVIEGLKEADKDEFCRCELKLQKWY<br>GDLRGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVLDSSN<br>IKPMNLIGVDRGENIPAVIALTDPEGCPLSRFKDSLGNPTHILRIGESYKEKQR<br>TIQAKKEVEQRRAGGYSRKYASKAKNLADDMVRNTARDLLYYAVTQDAMLIFEN<br>LSRGFGRQGKRTFMAERQYTRMEDWLTAKLAYEGLSKTYLSKTLAQYTSKTCSN<br>CGFTITSADYDRVLEKLKKTATGWMTTINGKELKVEGQITYYNRRKRQNVVKDL<br>SVELDRLSEESVNNDISSWTKGRSGEALSLLKKRFSHRPVQEKFVCLNCGFETH<br>ADEQAALNIARSWLFLRSQEYKKYQTNKTTGNTDKRAFVETWQSFYRKKLKEVW<br>KPAV (SEQ ID NO: 133) |
| 487:<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPAPKNID<br>QRKLIPVKDGNERLTSSGFACSQCCQPLYVYKLEQVNDKGKPHTNYFGRCNVSE<br>HERLILLSPHKPEANDELVTYSLGKFGQRALDFYSIHVTKESTHPVKPLAQIAG<br>NRYASGPVGKALSDACMGTIASFLSKYQDIIIEHQKVVKGNQKRLESLRELAGK<br>ENLEYPSVTLPPQPHTKEGVDAYNEVIARVRMWVNLNLWQKLKLSRDDAKPLLR<br>LKGFPSFPLVERQANEVDWWDMVCNVKKLINEKKEDGKVFWQNLAGYKRQEALR<br>PYLSSEEDRKKGKKFARYQLGDLLLHLEKKHGEDWGKVYDEAWERIDKKVEGLS<br>KHIKLEEERRSEDAQSKAALTDWLRAKASFVIEGLKEADKDEFCRCELKLQKWY<br>GDLRGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVLDSSN<br>IKPMNLIGVDRGENIPAVIALTDPEGCPLSRFKDSLGNPTHILRIGESYKEKQR<br>TIQAKKEVEQRRAGGYSRKYASKAKNLADDMVRNTARDLLYYAVTQDAMLIFEN<br>LSRGFGRQGKRTFMAERQYTRMEDWLTAKLAYEGLSKTYLSKTLAQYTSKTCSN<br>CGFTITSADYDRVLEKLKKTATGWMTTINGKELKVEGQITYYNRYKRQNVVKDL<br>SVELDRLSEESVNNDISSWTKGRSGEALSLLKKRFSHRPVQEKFVCLNCGFETH<br>ADEQAALNIARSWLFLRSQEYKKYQTNKTTGNTDKRAFVETWQSFYRKKLKEVW<br>KPAV (SEQ ID NO: 134) |
| 488:<br>NTSB and<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFQRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR |

TABLE 3-continued

CasX Variant Sequences

| Description* | Amino Acid Sequence |
|---|---|
| | EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 135) |
| 489:<br>NTSB and<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 136) |
| 490:<br>NTSB and<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLKHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRRKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 137) |
| 491:<br>NTSB and<br>Helical 1B<br>swap from<br>SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 138) |
| 494:<br>NTSB swap<br>from SEQ ID<br>NO: 1 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTRESNHPVKPLEQIG<br>GNSCASGPVGKALSDACMGAVASFLTKYQDIIIEHQKVIKKNEKRLANLKDIAS<br>ANGLAFPKITLPPQPHTKEGIEAYNNVVAQIVIWVNLNLWQKLKIGRDEAKPLQ<br>RLKGFPSFPLVERQANEVDWWDMVCNVKKLINEKKEDGKVFWQNLAGYKRQEAL |

TABLE 3-continued

CasX Variant Sequences

| Description* | Amino Acid Sequence |
|---|---|
| | RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFQRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFERKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 139) |
| 328: S867G | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>LPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKEKQ<br>RTIQAAKKEVEQRRAGGYSRKYASKAKNLADDMVRNTARDLLYYAVTQDAMLIFE<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLGVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 140) |
| 388:<br>L379R + A708R +<br>[P793] +<br>X1<br>Helical2<br>swap | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQFALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPVVERRENEVDWWNTINEVKKLIDAKRDMGRVFWSGVTAEKRNTIL<br>EGYNYLPNENDHKKREGSLENPKKPAKRQFGDLLLYLEKKYAGDWGKVFDEAWE<br>RIDKKIAGLTSHIEREEARNAEDAQSKAVLTDWLRAKASFVLERLKEMDEKEFY<br>ACEIQLQKWYGDLRGNPFAVEAENSILDISGFSKQYNCAFIWQKDGVKKLNLYL<br>IINYFKGGKLRFKKIKPEAFEANRFYTVINKKSGEIVPMEVNFNFDDPNLIILP<br>LAFGKRQGREFIWNDLLSLETGSLKLANGRVIEKTLYNRRTRQDEPALFVALTF<br>ERREVLDSSNIKPMNLIGIDRGENIPAVIALTDPEGCPLSRFKDSLGNPTHILR<br>IGESYKEKQRTIQAKKEVEQRRAGGYSRKYASKAKNLADDMVRNTARDLLYYAV<br>TQDAMLIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQITYYNR<br>YKRQNVVKDLSVELDRLSEESVNNDISSWTKGRSGEALSLLKKRFSHRPVQEKF<br>VCLNCGFETHADEQAALNIARSWLFLRSQEYKKYQTNKTTGNTDKRAFVETWQS<br>FYRKKLKEVWKPAV (SEQ ID NO: 141) |
| 389:<br>L379R + A708K +<br>[P793] +<br>X1 RuvC1<br>swap | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS<br>EHERLILLSPHKPEANDELVTYSLGKFGQRALDFYSIHVTRESNHPVKPLEQIG<br>GNSCASGPVGKALSDACMGAVASFLTKYQDIILEHQKVIKKNEKRLANLKDIAS<br>ANGLAFPKITLPPQPHTKEGIEAYNNVVAQIVIWVNLNWQKLKIGRDEAKPLQ<br>RLKGFPSFPLVERQANEVDWWDMVCNVKKLINEKKEDGKVFWQNLAGYKRQEAL<br>RPYLSSEEDRKKGKKFARYQFGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPVNLIGVDRGENIPAVIALTDPEGCPLPEFKDSSGGPTDILRIGEGYKEKQ<br>RAIQAAKEVEQRRAGGYSRKFASKSRNLADDMVRNSARDLFYHAVTHDAVLVFE<br>NLSRGFGRQGKRTFMTERQYTKMEDWLTAKLAYEGLTSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 142) |
| 390:<br>L379R + A708K +<br>[P793] + | MQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPAPKNI<br>DQRKLIPVKDGNERLTSSGFACSQCCQPLYVYKLEQVNDKGKPHTNYFGRCNVS |

TABLE 3-continued

CasX Variant Sequences

| Description* | Amino Acid Sequence |
|---|---|
| X1 RuvC2 swap | EHERLILLSPHKPEANDELVTYSLGKFGQRALDFYSIHVTRESNHPVKPLEQIG
GNSCASGPVGKALSDACMGAVASFLTKYQDIILEHQKVIKKNEKRLANLKDIAS
ANGLAFPKITLPPQPHTKEGIEAYNNVVAQIVIWVNLNLWQKLKIGRDEAKPLQ
RLKGFPSFPLVERQANEVDWWDMVCNVKKLINEKKEDGKVFWQNLAGYKRQEAL
RPYLSSEEDRKKGKKFARYQFGDLLLHLEKKHGEDWGKVYDEAWERIDKKVEGL
SKHIKLEEERRSEDAQSKAALTDWLRAKASFVIEGLKEADKDEFCRCELKLQKW
YGDLRGKPFAIEAENSILDISGFSKQYNCAFIWQKDGVKKLNLYLIINYFKGGK
LRFKKIKPEAFEANRFYTVINKKSGEIVPMEVNFNFDDPNLIILPLAFGKRQGR
EFIWNDLLSLETGSLKLANGRVIEKTLYNRRTRQDEPALFVALTFERREVLDSS
NIKPMNLIGIDRGENIPAVIALTDPEGCPLSRFKDSLGNPTHILRIGESYKEKQ
RTIQAKKEVEQRRAGGYSRKYASKAKNLADDMVRNTARDLLYYAVTQDAMLIFE
NLSRGFGRQGKRTFMAERQYTRMEDWLTAKLAYEGLSKTYLSKTLAQYTSKTCS
NCGFTITSADYDRVLEKLKKTATGWMTTINGKELKVEGQITYYNRYKRQNVVKD
LSVELDRLSEESVNNDISSWTKGRSGEALSLLKKRFSHRPVQEKFVCLNCGFET
HADEQAALNIARSWLFLNSNSTEFKSYKSGKQPFVGAWQAFYKRRLKEVWKPNA
(SEQ ID NO: 143) |
| 514: ^H817 in 491 | QEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPASKKID
QNKLKPEMDEKGNLTTAGFACSQCGQPLFVYKLEQVSEKGKAYTNYFGRCNVAE
HEKLILLAQLKPEKDSDEAVTYSLGKFGQRALDFYSIHVTKESTHPVKPLAQIA
GNRYASGPVGKALSDACMGTIASFLSKYQDIIIEHQKVVKGNQKRLESLRELAG
KENLEYPSVTLPPQPHTKEGVDAYNEVIARVRMWVNLNLWQKLKLSRDDAKPLL
RLKGFPSFPLVERQANEVDWWDMVCNVKKLINEKKEDGKVFWQNLAGYKRQEAL
RPYLSSEEDRKKGKKFARYQLGDLLLHLEKKHGEDWGKVYDEAWERIDKKVEGL
SKHIKLEEERRSEDAQSKAALTDWLRAKASFVIEGLKEADKDEFCRCELKLQKW
YGDLRGKPFAIEAENSILDISGFSKQYNCAFIWQKDGVKKLNLYLIINYFKGGK
LRFKKIKPEAFEANRFYTVINKKSGEIVPMEVNFNFDDPNLIILPLAFGKRQGR
EFIWNDLLSLETGSLKLANGRVIEKTLYNRRTRQDEPALFVALTFERREVLDSS
NIKPMNLIGVDRGENIPAVIALTDPEGCPLSRFKDSLGNPTHILRIGESYKEKQ
RTIQAKKEVEQRRAGGYSRKYASKAKNLADDMVRNTARDLLYYAVTQDAMLIFE
NLSRGFGRQGKRTFMAERQYTRMEDWLTAKLAYEGLSKTYLSKTLAQYTSKTCS
NCGFTIHTSADYDRVLEKLKKTATGWMTTINGKELKVEGQITYYNRYKRQNVVK
DLSVELDRLSEESVNNDISSWTKGRSGEALSLLKKRFSHRPVQEKFVCLNCGFE
THADEQAALNIARSWLFLRSQEYKKYQTNKTTGNTDKRAFVETWQSFYRKKLKE
VWKPAV (SEQ ID NO: 143) |
| 515: ^P793 in 491 | QEIKRINKIRRRLVKDSNTKKAGKTGPMKTLLVRVMTP4)LRERLENLRKKPEN
IPQPISNTSRANLNKLLTDYTEMKKAILHVYWEEFQKDPVGLMSRVAQPASKKI
DQNKLKPEMDEKGNLTTAGFACSQCGQPLEVYKLEQVSEKGKAYTNYFGRCNVA
EHEKLILLAQLKPEKDSDEAVTYSLGKFGQRALDFYSIHVTKESTHPVKPLAQI
AGNRYASGPVGKALSDACMGTIASFLSKYQDIIIEHQKVVKGNQKRLESLRELA
GKENLEYPSVTLPPQPHTKEGVDAYNEVIARVRMWVNLNLWQKLKLSRDDAKPL
LRLKGFPSFPLVERQANEVDWWDMVCNVKKLINEKKEDGKVFWQNLAGYKRQEA
LRPYLSSEEDRKKGKKFARYQLGDLLLHLEKKHGEDWGKVYDEAWERIDKKVEG
LSKHIKLEEERRSEDAQSKAALTDWLRAKASFVIEGLKEADKDEFCRCELKLQK
WYGDLRGKPFAIEAENSILDISGFSKQYNCAFIWQKDGVKKLNLYLIINYFKGG
KLRFKKIKPEAFEANRFYTVINKKSGEIVPMEVNFNFDDPNLIILPLAFGKRQG
REFIWNDLLSLETGSLKLANGRVIEKTLYNRRTRQDEPALFVALTFERREVLDS
SNIKPMNLIGVDRGENIPAVIALTDPEGCPLSRFKDSLGNPTHILRIGESYKEK
QRTIQAKKEVEQRRAGGYSRKYASKAKNLADDMVRNTARDLLYYAVTQDAMLIF
ENLSRGFGRQGKRTFMAERQYTRMEDWLTAKLAYEGLSKTYLSKTLAQYTSKT
CSNCGFTITSADYDRVLEKLKKTATGWMTTINGKELKVEGQITYYNRYKRQNVV
KDLSVELDRLSEESVNNDISSWTKGRSGEALSLLKKRFSHRPVQEKFVCLNCGF
ETHADEQAALNIARSWLFLRSQEYKKYQTNKTTGNTDKRAFVETWQSFYRKKLK
EVWKPAV (SEQ ID NO: 145) |
| 516: L307H in 491 | QEIKRINKIRRRLVKDSNTKKAGKTGPMKTLLVRVMTPDLRERLENLRKKPENI
PQPISNTSRANLNKLLTDYTEMKKAILHVYWEEFQKDPVGLMSRVAQPASKKID
QNKLKPEMDEKGNLTTAGFACSQCGQPLFVYKLEQVSEKGKAYTNYFGRCNVAE
HEKLILLAQLKPEKDSDEAVTYSLGKFGQRALDFYSIHVTKESTHPVKPLAQIA
GNRYASGPVGKALSDACMGTIASFLSKYQDIIIEHQKVVKGNQKRLESLRELAG
KENLEYPSVTLPPQPHTKEGVDAYNEVIARVRMWVNHNLWQKLKLSRDDAKPLL
RLKGFPSFPLVERQANEVDWWDMVCNVKKLINEKKEDGKVFWQNLAGYKRQEAL
RPYLSSEEDRKKGKKFARYQLGDLLLHLEKKHGEDWGKVYDEAWERIDKKVEGL
SKHIKLEEERRSEDAQSKAALTDWLRAKASFVIEGLKEADKDEFCRCELKLQKW
YGDLRGKPFAIEAENSILDISGFSKQYNCAFIWQKDGVKKLNLYLIINYFKGGK
LRFKKIKPEAFEANRFYTVINKKSGEIVPMEVNFNFDDPNLIILPLAFGKRQGR
EFIWNDLLSLETGSLKLANGRVIEKTLYNRRTRQDEPALFVALTFERREVLDSS
NIKPMNLIGVDRGENIPAVIALTDPEGCPLSRFKDSLGNPTHILRIGESYKEKQ
RTIQAKKEVEQRRAGGYSRKYASKAKNLADDMVRNTARDLLYYAVTQDAMLIFE
NLSRGFGRQGKRTFMAERQYTRMEDWLTAKLAYEGLSKTYLSKTLAQYTSKTCS
NCGFTITSADYDRVLEKLKKTATGWMTTINGKELKVEGQITYYNRYKRQNVVKD
LSVELDRLSEESVNNDISSWTKGRSGEALSLLKKRFSHRPVQEKFVCLNCGFET
HADEQAALNIARSWLFLRSQEYKKYQTNKTTGNTDKRAFVETWQSFYRKKLKEV
WKPAV (SEQ ID NO: 146) |

TABLE 3-continued

CasX Variant Sequences

| Description* | Amino Acid Sequence |
|---|---|
| 517:<br>^A224 in<br>491 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGAPVGKALSDACMGTIASFLSKYQDIIIEHQKVVKGNQKRLESLRELA<br>GKENLEYPSVTLPPQPHTKEGVDAYNEVIARVRMWVNLNLWQKLKLSRDDAKPL<br>LRLKGFPSFPLVERQANEVDWWDMVCNVKKLINEKKEDGKVFWQNLAGYKRQEA<br>LRPYLSSEEDRKKGKKFARYQLGDLLLHLEKKHGEDWGKVYDEAWERIDKKVEG<br>LSKHIKLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYFKGG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGVDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 147) |
| 518:<br>^R1 in 491 | RQEIKRINKIRRRLVKDSNTKKAGKTGPMKTLLVRVMTPDLRERLENLRKKPEN<br>IPQPISNTSRANLNKLLTDYTEMKKAILHVYWEEFQKDPVGLMSRVAQPASKKI<br>DQNKLKPEMDEKGNLTTAGFACSQCGQPLFVYKLEQVSEKGKAYTNYFGRCNVA<br>EHEKLILLAQLKPEKDSDEAVTYSLGKFGQRALDFYSIHVTKESTHPVKPLAQI<br>AGNRYASGAPVGKALSDACMGTIASFLSKYQDIIIEHQKVVKGNQKRLESLREL<br>AGKENLEYPSVTLPPQPHTKEGVDAYNEVIARVRMWVNLNLWQKLKLSRDDAKP<br>LLRLKGFPSFPLVERQANEVDWWDMVCNVKKLINEKKEDGKVFWQNLAGYKRQE<br>ALRPYLSSEEDRKKGKKFARYQLGDLLLHLEKKHGEDWGKVYDEAWERIDKKVE<br>GLSKHIKLEEERRSEDAQSKAALTDWLRAKASFVIEGLKEADKDEFCRCELKLQ<br>KWYGDLRGKPFAIEAENSILDISGFSKQYNCAFIWQKDGVKKLNLYLIINYFKG<br>GKLRFKKIKPEAFEANRFYTVINKKSGEIVPMEVNFNFDDPNLIILPLAFGKRQ<br>GREFIWNDLLSLETGSLKLANGRVIEKTLYNRRTRQDEPALFVALTFERREVLD<br>SSNIKPMNLIGVDRGENIPAVIALTDPEGCPLSRFKDSLGNPTHILRIGESYKE<br>KQRTIQAKKEVEQRRAGGYSRKYASKAKNLADDMVRNTARDLLYYAVTQDAMLI<br>FENLSRGFGRQGKRTFMAERQYTRMEDWLTAKLAYEGLSKTYLSKTLAQYTSKT<br>CSNCGFTITSADYDRVLEKLKKTATGWMTTINGKELKVEGQITYYNRYKRQNVV<br>KDLSVELDRLSEESVNNDISSWTKGRSGEALSLLKKRFSHRPVQEKFVCLNCGF<br>ETHADEQAALNIARSWLFLRSQEYKKYQTNKTTGNTDKRAFVETWQSFYRKKLK<br>EVWKPAV (SEQ ID NO: 148) |
| 519:<br>^Q692 in<br>491 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHIQLRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 149) |
| 520:<br>I705T in 491 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTTQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS |

TABLE 3-continued

CasX Variant Sequences

| Description* | Amino Acid Sequence |
|---|---|
| | NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 150) |
| 522:<br>D683R in<br>491 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKRSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 151) |
| 523:<br>G26Y in 491 | QEIKRINKIRRRLVKDSNTKKAGKTYPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTITSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 152) |
| 524:<br>T817H in<br>491 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLSKTYLSKTLAQYTSKTCS<br>NCGFTIHSADYDRVLEKLKKTATGWMTTINGKELKVEGQITYYNRYKRQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 153) |
| 525;<br>V746A in<br>491 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR |

TABLE 3-continued

CasX Variant Sequences

| Description* | Amino Acid Sequence |
| --- | --- |
| | EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAATQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRYKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 154) |
| 526:<br>K708A in<br>491 | QEIKRINKIRRRLVKDSNTKKAGKTGPMKTLLVRVMTPDLRERLENLRKKPENI<br>PQPISNTSRANLNKLLTDYTEMKKAILEVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAAKEVEQRRAGGYSRKYASKAKNLADDMVRNTARDLLYYAVTQDAMLIFE<br>NLSRGFGRQKRTFMAERQYTRMEDWLTAKLAYEGLSKTYLSKTLAQYTSKTCS<br>NCGFTITSADYDRVLEKLKKTATGWMTTINGKELKVEGQITYYNRYKQNVVKD<br>LSVELDRLSEESVNNDISSWTKGRSGEALSLLKKRFSHRPVQEKFVCLNCGFET<br>HADEQAALNIARSWLFLRSQEYKKYQTNKTTGNTDKRAFVETWQSFYRKKLKEV<br>WKPAV (SEQ ID NO: 155) |
| 527:<br>^R26 in 491 | QEIKRINKIRRRLVKDSNTKKAGKTRGPMKTLLVRVMTPDLRERLENLRKKPEN<br>IPQPISNTSRANLNKLLTDYTEMKKAILHVYWEEFQKDPVGLMSRVAQPASKKI<br>DQNKLKPEMDEKGNLTTAGFACSQCGQPLFVYKLEQVSEKGKAYTNYFGRCNVA<br>EHEKLILLAQLKPEKDSDEAVTYSLGKFGQRALDFYSIHVTKESTHPVKPLAQI<br>AGNRYASGPVGKALSDACMGTIASFLSKYQDIIIEHQKVVKGNQKRLESLRELA<br>GKENLEYPSVTLPPQPHTKEGVDAYNEVIARVRMWVNLNWQKLKLSRDDAKPL<br>LRLKGFPSFPLVERQANEVDWWDMVCNVKKLINEKKEDGKVFWQNLAGYKRQEA<br>LRPYLSSEEDRKKGKKFARYQLGDLLLHLEKKHGEDWGKVYDEAWERIDKKVEG<br>LSKHIKLEEERRSEDAQSKAALTDWLRAKASFVIEGLKEADKDEFQRCELKLQK<br>WYGDLRGKPFAIEAENSILDISGFSKQYNCAFIWQKDGVKKLNLYLIINYFKGG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGVDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLSKTYLSKTLAQYTSKTC<br>SNCGFTITSADYDRVLEKLKKTATGWMTTINGKELKVEGQITYYNRYKQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 156) |
| 528:<br>G223Y in<br>515 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASYPVGKALSDACMGTIASFLSKYQDIIIEHQKVVKGNQKRLESLRELAG<br>KENLEYPSVTLPPQPHTKEGVDAYNEVIARVRMWVNLNWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQKRTFMAERQYTRMEDWLTAKLAYEGLPSKTYLSKTLAQYTSKTCS<br>NCGFTITSADYDRVLEKLKKTATGWMTTINGKELKVEGQITYYNRYKQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 157) |
| 529:<br>G223N in<br>515 | QEIKRINKIRRRLVKDSNTKKAGKTGPMKTLLVRWTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASNPVGKALSDACMGTIASFLSKYQDIIIEHQKVVKGNQKRLESLRELAG<br>KENLEYPSVTLPPQPHTKEGVDAYNEVIARVRMWVNLNWQKLKLSRDDAKPLL<br>RLKGFPSFPLVERQANEVDWWDMVCNVKKLINEKKEDGKVFWQNLAGYKRQEAL |

TABLE 3-continued

CasX Variant Sequences

| Description* | Amino Acid Sequence |
|---|---|
| | RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGGK<br>LRFKKIKPEAFEANRFYTVINKKSGEIVPMEVNFNFDDPNLIILPLAFGKRQGR<br>EFIWNDLLSLETGSLKLANGRVIEKTLYNRRTRQDEPALFVALTFERREVLDSS<br>NIKPMNLIGVDRGENIPAVIALTDPEGCPLSRFKDSLGNPTHILRIGESYKEKQ<br>RTIQAKKEVEQRRAGGYSRKYASKAKNLADDMVRNTARDLLYYAVTQDAMLIFE<br>NLSRGFGRQGKRTFMAERQYTRMEDWLTAKLAYEGLPSKTYLSKTLAQYTSKTC<br>SNCGFTITSADYDRVLEKLKKTATGWMTTINGKELKVEGQITYYNRYKRQNVVK<br>DLSVELDRLSEESVNNDISSWTKGRSGEALSLLKKRFSHRPVQEKFVCLNCGFE<br>THADEQAALNIARSWLFLRSQEYKKYQTNKTTGNTDKRAFVETWQSFYRKKLKE<br>VWKPAV (SEQ ID NO: 158) |
| 530:<br>^W539 in<br>515 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGWG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGVDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLPSKTYLSKTLAQYTSKT<br>CSNCGFTITSADYDRVLEKLKKTATGWMTTINGKELKVEGQITYYNRYKRQNVV<br>KDLSVELDRLSEESVNNDISSWTKGRSGEALSLLKKRFSHRPVQEKFVCLNCGF<br>ETHADEQAALNIARSWLFLRSQEYKKYQTNKTTGNTDKRAFVETWQSFYRKKLK<br>EVWKPAV (SEQ ID NO: 159) |
| 531:<br>^Y539 in<br>515 | QEIKRINKIRRRLVKDSNTKKAGKTGPMKTLLVRVMTPDLRERLENLRKKPENI<br>PQPISNTSRANLNKLLTDYTEMKKAILHVYWEEFQKDPVGLMSRVAQPASKKID<br>QNKLKPEMDEKGNLTTAGFACSQCGQPLFVYKLEQVSEKGKAYTNYFGRCNVAE<br>HEKLILLAQLKPEKDSDEAVTYSLGKFGQRALDFYSIHVTKESTHPVKPLAQIA<br>GNRYASGPVGKALSDACMGTIASFLSKYQDIIIEHQKVVKGNQKRLESLRELAG<br>KENLEYPSVTLPPQPHTKEGVDAYNEVIARVRMWVNLNLWQKLKLSRDDAKPLL<br>RLKGFPSFPLVERQANEVDWWDMVCNVKKLINEKKEDGKVFWQNLAGYKRQEAL<br>RPYLSSEEDRKKGKKFARYQLGDLLLHLEKKHGEDWGKVYDEAWERIDKKVEGL<br>SKHIKLEEERRSEDAQSKAALTDWLRAKASFVIEGLKEADKDEFCRCELKLQKW<br>YGDLRGKPFAIEAENSILDISGFSKQYNCAFIWQKDGVKKLNLYLIINYFKGYG<br>KLRFKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERREVLDS<br>SNIKPMNLIGVDRGENIPAVIALTDPEGCPLSRFKDSLGNPTHILRIGESYKEK<br>QRTIQAKKEVEQRRAGGYSRKYASKAKNLADDMVRNTARDLLYYAVTQDAMLIF<br>ENLSRGFGRQGKRTFMAERQYTRMEDWLTAKLAYEGLPSKTYLSKTLAQYTSKT<br>CSNCGFTITSADYDRVLEKLKKTATGWMTTINGKELKVEGQITYYNRYKRQNVV<br>KDLSVELDRLSEESVNNDISSWTKGRSGEALSLLKKRFSHRPVQEKFVCLNCGF<br>ETHADEQAALNIARSWLFLRSQEYKKYQTNKTTGNTDKRAFVETWQSFYRKKLK<br>EVWKPAV (SEQ ID NO: 160) |

In some embodiments, the CasX variant protein comprises a sequence selected from the group consisting of SEQ ID NOs: 49-160, 237-239, 243-246, 251-263 or 273-281, or a sequence having at least about 50%, at least about 60%, at least about 70%, at least about 80%, at least about 90%, or at least about 95%, or at least about 95%, or at least about 96%, or at least about 97%, or at least about 98%, or at least about 99% sequence identity thereto. In some embodiments, the CasX variant protein comprises a sequence selected from the group consisting of SEQ ID NOs: 49-160, 237-239, 243-246, 251-263 or 273-281.

In some embodiments, the CasX variant protein has one or more improved characteristic of the CasX protein when compared to a reference CasX protein, for example a reference protein of SEQ ID NO:1, SEQ ID NO:2 or SEQ ID NO:3. In some embodiments, the at least one improved characteristic of the CasX variant is at least about 1.1 to about 100,000-fold improved relative to the reference protein. In some embodiments, the at least one improved characteristic of the CasX variant is at least about 1.1 to about 10,000-fold improved, at least about 1.1 to about 1,000-fold improved, at least about 1.1 to about 500-fold improved, at least about 1.1 to about 400-fold improved, at least about 1.1 to about 300-fold improved, at least about 1.1 to about 200-fold improved, at least about 1.1 to about 100-fold improved, at least about 1.1 to about 50-fold improved, at least about 1.1 to about 40-fold improved, at least about 1.1 to about 30-fold improved, at least about 1.1 to about 20-fold improved, at least about 1.1 to about 10-fold improved, at least about 1.1 to about 9-fold improved, at least about 1.1 to about 8-fold improved, at least about 1.1 to about 7-fold improved, at least about 1.1 to about 6-fold improved, at least about 1.1 to about 5-fold improved, at least about 1.1 to about 4-fold improved, at least about 1.1 to about 3-fold improved, at least about 1.1 to about 2-fold improved, at least about 1.1 to about 1.5-fold improved, at least about 1.5 to about 3-fold improved, at least about 1.5 to about 4-fold improved, at least about 1.5 to about 5-fold improved, at least about 1.5 to about 10-fold improved, at least about 5 to about 10-fold improved, at least about 10 to about 20-fold improved, at least 10 to about 30-fold improved, at least 10 to about 50-fold improved or at least 10 to about 100-fold improved than the reference CasX protein. In some embodiments, the at least one improved characteristic of the CasX variant is at least about 10 to about 1000-fold improved relative to the reference CasX protein.

In some embodiments, the one or more improved characteristics of the CasX variant protein is at least about 1.1, at least about 5, at least about 10, at least about 20, at least about 30, at least about 40, at least about 50, at least about 60, at least about 70, at least about 80, at least about 90, at least about 100, at least about 250, at least about 500, or at least about 1000, at least about 5,000, at least about 10.000, or at least about 100.000-fold improved relative to a reference CasX protein of SEQ ID NO:1, SEQ ID NO:2 or SEQ ID NO:3. In other cases, the one or more improved characteristics of the CasX variant is about 1.1 to 100,000-fold, about 1.1 to 10,000-fold, about 1.1 to 1,000-fold, about 1.1 to 500-fold, about 1.1 to 100-fold, about 1.1 to 50-fold, about 1.1 to 20-fold, about 10 to 100,000-fold, about 10 to 10,000-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,000-fold, about 100 to 10,000-fold, about 100 to 1,000-fold, about 100 to 500-fold, about 500 to 100,000-fold, about 500 to 10,000-fold, about 500 to 1,000-fold, about 500 to 750-fold, about 1,000 to 100,000-fold, about 10,000 to 100,000-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference CasX of SEQ ID NO:1, SEQ ID NO:2 or SEQ ID NO:3. In other cases, the one or more improved characteristics of the CasX variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold or more improved relative to the reference CasX of SEQ ID NO: 1, SEQ ID NO: 2 or SEQ ID NO: 3. Exemplary characteristics that can be improved in CasX variant proteins relative to the same characteristics in reference CasX proteins include, but are not limited to, improved folding of the variant, improved binding affinity to the gNA, improved binding affinity to the target DNA, improved ability to utilize a greater spectrum of PAM sequences in the editing and/or binding of target DNA, improved unwinding of the target DNA, increased editing activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved CasX: gNA RNA complex stability, improved protein solubility, improved CasX:gNA RNP complex solubility, improved ability to form cleavage-competent RNP with a gNA, improved protein yield, improved protein expression, and improved fusion characteristics. In some embodiments, the variant comprises at least one improved characteristic. In other embodiments, the variant comprises at least two improved characteristics. In further embodiments, the variant comprises at least three improved characteristics. In some embodiments, the variant comprises at least four improved characteristics. In still further embodiments, the variant comprises at least five, at least six, at least seven, at least eight, at least nine, at least ten, at least eleven, at least twelve, at least thirteen, or more improved characteristics.

Exemplary improved characteristic include, as one example, improved editing efficiency. The CasX variants of the embodiments described herein have the ability to form an RNP complex with the gNA disclosed herein. In some embodiments, an RNP comprising the CasX variant protein and a gNA of the disclosure, at a concentration of 20 pM or less, is capable of cleaving a double stranded DNA target with an efficiency of at least 80%. In some embodiments, the RNP at a concentration of 20 pM or less, is capable of cleaving a double stranded DNA target with an efficiency of at least 40%, at least 50%, at least 60%, at least 70%, at least 80%, at least 85%, at least 90% or at least 95%. In some embodiments, the RNP at a concentration of 50 pM or less, 40 pM or less, 30 pM or less, 20 pM or less, 10 pM or less, or 5 pM or less, is capable of cleaving a double stranded DNA target with an efficiency of at least 40%, at least 50%, at least 60%, at least 70%, at least 80%, at least 85%, at least 9⁰% or at least 95%.

These improved characteristics are described in more detail below.

j. Protein Stability

In some embodiments, the disclosure provides a CasX variant protein with improved stability relative to a reference CasX protein. In some embodiments, improved stability of the CasX variant protein results in expression of a higher steady state of protein, which improves editing efficiency. In some embodiments, improved stability of the CasX variant protein results in a larger fraction of CasX protein that remains folded in a functional conformation and improves editing efficiency or improves purifiability for manufacturing purposes. As used herein, a "functional conformation" refers to a CasX protein that is in a conformation where the protein is capable of binding a gNA and target DNA. In embodiments wherein the CasX variant does not carry one or more mutations rendering it catalytically dead, the CasX variant is capable of cleaving, nicking, or otherwise modifying the target DNA. For example, a functional CasX variant can, in some embodiments, be used for gene-editing, and a functional conformation refers to an "editing-competent" conformation. In some exemplary embodiments, including those embodiments where the CasX variant protein results in a larger fraction of CasX protein that remains folded in a functional conformation, a lower concentration of CasX variant is needed for applications such as gene editing compared to a reference CasX protein. Thus, in some embodiments, the CasX variant with improved stability has improved efficiency compared to a reference CasX in one or more gene editing contexts. Improved stability and efficiency of nuclease activity may be evaluated through a variety of methods known to one of skill in the art.

In some embodiments, the disclosure provides a CasX variant protein having improved thermostability relative to a reference CasX protein. In some embodiments, the CasX variant protein has improved thermostability of the CasX variant protein at a particular temperature range. Without wishing to be bound by any theory, some reference CasX proteins natively function in organisms with niches in groundwater and sediment; thus, some reference CasX proteins may have evolved to exhibit optimal function at lower or higher temperatures that may be desirable for certain applications. For example, one application of CasX variant proteins is gene editing of mammalian cells, which is typically carried out at about 37° C. In some embodiments, a CasX variant protein as described herein has improved thermostability compared to a reference CasX protein at a temperature of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability and functionality compared to a reference CasX protein that results in improved gene editing functionality, such as mammalian gene editing applications, which may include human gene editing applications. Improved thermostability of the nuclease may be evaluated through a variety of methods known to one of skill in the art.

In some embodiments, the disclosure provides a CasX variant protein having improved stability of the CasX variant protein:gNA complex relative to the reference CasX protein:gNA complex such that the RNP remains in a functional form. Stability improvements can include increased thermostability, resistance to proteolytic degradation, enhanced pharmacokinetic properties, stability across a range of pH conditions, salt conditions, and tonicity. Improved stability of the complex may, in some embodiments, lead to improved editing efficiency. In some embodiments, the RNP of the CasX variant and gNA variant has at least a 5%, at least a 10%, at least a 15%, or at least a 20%, or at least a 5-20% higher percentage of cleavage-competent RNP compared to an RNP of the reference CasX of SEQ ID NOS: 1-3 and the gNA of any one of SEQ ID NOS:4-16 of Table 1. Exemplary data of increased cleavage-competent RNP are provided in the Examples.

In some embodiments, the disclosure provides a CasX variant protein having improved thermostability of the CasX variant protein:gNA complex relative to the reference CasX protein:gNA complex. In some embodiments, a CasX variant protein has improved thermostability relative to a reference CasX protein. In some embodiments, the CasX variant protein:gNA complex has improved thermostability relative to a complex comprising a reference CasX protein at temperatures of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability of the CasX variant protein:gNA complex compared to a reference CasX protein:gNA complex, which results in improved function for gene editing applications, such as mammalian gene editing applications, which may include human gene editing applications. Improved thermostability of the RNP may be evaluated through a variety of methods known to one of skill in the art.

In some embodiments, the improved stability and/or thermostability of the CasX variant protein comprises faster folding kinetics of the CasX variant protein relative to a reference CasX protein, slower unfolding kinetics of the CasX variant protein relative to a reference CasX protein, a larger free energy release upon folding of the CasX variant protein relative to a reference CasX protein, a higher temperature at which 50% of the CasX variant protein is unfolded (Tm) relative to a reference CasX protein, or any combination thereof. These characteristics may be improved by a wide range of values: for example, at least 1.1, at least 1.5, at least 10, at least 50, at least 100, at least 500, at least 1,000, at least 5,000, or at least a 10,000-fold improved, as compared to a reference CasX protein. In some embodiments, improved thermostability of the CasX variant protein comprises a higher Tm of the CasX variant protein relative to a reference CasX protein. In some embodiments, the Tm of the CasX variant protein is between about 20° C. to about 30° C., between about 30° C. to about 40° C., between about 40° C. to about 50° C., between about 50° C. to about 60° C., between about 60° C. to about 70° C., between about 70° C. to about 80° C., between about 80° C. to about 90° C. or between about 90° C. to about 100° C. Thermal stability is determined by measuring the "melting temperature" ($T_m$), which is defined as the temperature at which half of the molecules are denatured. Methods of measuring characteristics of protein stability such as Tm and the free energy of unfolding are known to persons of ordinary skill in the art, and can be measured using standard biochemical techniques in vitro. For example, Tm may be measured using Differential Scanning Calorimetry, a thermo-analytical technique in which the difference in the amount of heat required to increase the temperature of a sample and a reference is measured as a function of temperature (Chen et al (2003) Pharm Res 20:1952-60: Ghirlando et al (1999) Immunol Lett 68:47-52). Alternatively, or in addition, CasX variant protein Tm may be measured using commercially available methods such as the ThermoFisher Protein Thermal Shift system. Alternatively, or in addition, circular dichroism may be used to measure the kinetics of folding and unfolding, as well as the Tm (Murray et al. (2002) J. Chromatogr Sci 40:343-9). Circular dichroism (CD) relies on the unequal absorption of left-handed and right-handed circularly polarized light by asymmetric molecules such as proteins. Certain structures of proteins, for example alpha-helices and beta-sheets, have characteristic CD spectra. Accordingly, in some embodiments, CD may be used to determine the secondary structure of a CasX variant protein.

In some embodiments, improved stability and/or thermostability of the CasX variant protein comprises improved folding kinetics of the CasX variant protein relative to a reference CasX protein. In some embodiments, folding kinetics of the CasX variant protein are improved relative to a reference CasX protein by at least about 5, at least about 10, at least about 50, at least about 100, at least about 500, at least about 1,000, at least about 2,000, at least about 3,000, at least about 4,000, at least about 5,000, or at least about a 10,000-fold improvement. In some embodiments, folding kinetics of the CasX variant protein are improved relative to a reference CasX protein by at least about 1 kJ/mol, at least about 5 kJ/mol, at least about 10 kJ/mol, at least about 20 kJ/mol, at least about 30 kJ/mol, at least about 40 kJ/mol, at least about 50 kJ/mol, at least about 60 kJ/mol, at least about 70 k/mol, at least about 80 kJ/mol, at least about 90 kJ/mol, at least about 100 kJ/mol, at least about 150 kJ/mol, at least about 200 k/mol, at least about 250 kJ/mol, at least about 300 kJ/mol, at least about 350 kJ/mol, at least about 400 kJ/mol, at least about 450 kJ/mol, or at least about 500 kJ/mol.

Exemplary amino acid changes that can increase the stability of a CasX variant protein relative to a reference CasX protein may include, but are not limited to, amino acid changes that increase the number of hydrogen bonds within the CasX variant protein, increase the number of disulfide bridges within the CasX variant protein, increase the number of salt bridges within the CasX variant protein, strengthen interactions between parts of the CasX variant protein, increase the buried hydrophobic surface area of the CasX variant protein, or any combinations thereof.

k. Protein Yield

In some embodiments, the disclosure provides a CasX variant protein having improved yield during expression and purification relative to a reference CasX protein. In some embodiments, the yield of CasX variant proteins purified from bacterial or eukaryotic host cells is improved relative to a reference CasX protein. In some embodiments, the bacterial host cells are *Escherichia coli* cells. In some embodiments, the eukaryotic cells are yeast, plant (e.g. tobacco), insect (e.g. *Spodoptera frugiperda* sf9 cells), mouse, rat, hamster, guinea pig, monkey, or human cells. In some embodiments, the eukaryotic host cells are mammalian cells, including, but not limited to human embryonic kidney 293 (HEK293) cells, HEK292T cells, baby hamster kidney (BHK) cells, NS0 cells. SP2/0 cells, YO myeloma cells, P3X63 mouse myeloma cells. PER cells, PER.C6 cells, hybridoma cells, NIH3T3 cells, COS. HeLa, or Chinese hamster ovary (CHO) cells.

In some embodiments, improved yield of the CasX variant protein is achieved through codon optimization. Cells use 64 different codons, 61 of which encode the 20 standard amino acids, while another 3 function as stop codons. In some cases, a single amino acid is encoded by more than one codon. Different organisms exhibit bias towards use of different codons for the same naturally occurring amino acid. Therefore, the choice of codons in a protein, and matching codon choice to the organism in which the protein will be expressed, can, in some cases, significantly affect protein translation and therefore protein expression levels. In some embodiments, the CasX variant protein is encoded by a nucleic acid that has been codon optimized. In some embodiments, the nucleic acid encoding the CasX variant protein has been codon optimized for expression in a bacterial cell, a yeast cell, an insect cell, a plant cell, or a mammalian cell. In some embodiments, the mammal cell is a mouse, a rat, a hamster, a guinea pig, a monkey, or a human. In some embodiments, the CasX variant protein is encoded by a nucleic acid that has been codon optimized for expression in a human cell. In some embodiments, the CasX variant protein is encoded by a nucleic acid from which nucleotide sequences that reduce translation rates in prokaryotes and eukaryotes have been removed. For example, runs of greater than three thymine residues in a row can reduce translation rates in certain organisms or internal polyadenylation signals can reduce translation.

Improved protein yield during expression and purification can be evaluated by methods known in the art. For example, the amount of CasX variant protein can be determined by running the protein on an SDS-page gel, and comparing the CasX variant protein to a either a control whose amount or concentration is known in advance to determine an absolute level of protein. Alternatively. or in addition, a purified CasX variant protein can be run on an SDS-page gel next to a reference CasX protein undergoing the same purification process to determine relative improvements in CasX variant protein yield. Alternatively, or in addition, levels of protein can be measured using immunohistochemical methods such as Western blot or ELISA with an antibody to CasX, or by HPLC. For proteins in solution, concentration can be determined by measuring of the protein's intrinsic UV absorbance, or by methods which use protein-dependent color changes such as the Lowry assay, the Smith copper/bicinchoninic assay or the Bradford dye assay. Such methods can be used to calculate the total protein (such as, for example, total soluble protein) yield obtained by expression under certain conditions. This can be compared, for example, to the protein yield of a reference CasX protein under similar expression conditions.

l. Protein Solubility

In some embodiments, a CasX variant protein has improved solubility relative to a reference CasX protein. In some embodiments, a CasX variant protein has improved solubility of the CasX:gNA ribonucleoprotein complex variant relative to a ribonucleoprotein complex comprising a reference CasX protein.

In some embodiments, an improvement in protein solubility leads to higher yield of protein from protein purification techniques such as purification from *E. coli*. Improved solubility of CasX variant proteins may, in some embodiments, enable more efficient activity in cells, as a more soluble protein may be less likely to aggregate in cells. Protein aggregates can in certain embodiments be toxic or burdensome on cells, and, without wishing to be bound by any theory, increased solubility of a CasX variant protein may ameliorate this result of protein aggregation. Further, improved solubility of CasX variant proteins may allow for enhanced formulations permitting the delivery of a higher effective dose of functional protein, for example in a desired gene editing application. In some embodiments, improved solubility of a CasX variant protein relative to a reference CasX protein results in improved yield of the CasX variant protein during purification of at least about 5, at least about 10, at least about 20, at least about 30, at least about 40, at least about 50, at least about 60, at least about 70, at least about 80, at least about 90, at least about 100, at least about 250, at least about 500, or at least about 1000-fold greater yield. In some embodiments, improved solubility of a CasX variant protein relative to a reference CasX protein improves activity of the CasX variant protein in cells by at least about 1.1, at least about 1.2, at least about 1.3, at least about 1.4, at least about 1.5, at least about 1.6, at least about 1.7, at least about 1.8, at least about 1.9, at least about 2, at least about 2.1, at least about 2.2, at least about 2.3, at least about 2.4, at least about 2.5, at least about 2.6, at least about 2.7, at least about 2.8, at least about 2.9, at least about 3, at least about 3.5, at least about 4, at least about 4.5, at least about 5, at least about 5.5, at least about 6, at least about 6.5, at least about 7.0, at least about 7.5, at least about 8, at least about 8.5, at least about 9, at least about 9.5, at least about 10, at least about 11, at least about 12, at least about 13, at least about 14, or at least about 15-fold greater activity. Improved solubility of the nuclease may be evaluated through a variety of methods known to one of skill in the art, including by taking densitometry readings on a gel of the soluble fraction of lysed Ecoli. Alternatively, or addition, improvements in CasX variant protein solubility can be measured by measuring the maintenance of soluble protein product through the course of a full protein purification. For example, soluble protein product can be measured at one or more steps of gel affinity purification, tag cleavage, cation exchange purification, running the protein on a sizing column. In some embodiments, the densitometry of every band of protein on a gel is read after each step in the purification process. CasX variant proteins with improved solubility may, in some embodiments, maintain a higher concentration at one or more steps in the protein purification process when compared to the reference CasX protein, while an insoluble protein variant may be lost at one or more steps due to buffer exchanges, filtration steps, interactions with a purification column, and the like.

In some embodiments, improving the solubility of CasX variant proteins results in a higher yield in terms of mg/L of protein during protein purification when compared to a reference CasX protein.

In some embodiments, improving the solubility of CasX variant proteins enables a greater amount of editing events compared to a less soluble protein when assessed in editing assays such as the EGFP disruption assays described herein.

m. Protein Affinity for the gNA

In some embodiments, a CasX variant protein has improved affinity for the gNA relative to a reference CasX protein, leading to the formation of the ribonucleoprotein complex. Increased affinity of the CasX variant protein for the gNA may, for example, result in a lower Kn for the generation of a RNP complex, which can, in some cases, result in a more stable ribonucleoprotein complex formation. In some embodiments, increased affinity of the CasX variant protein for the gNA results in increased stability of the ribonucleoprotein complex when delivered to human cells. This increased stability can affect the function and utility of the complex in the cells of a subject, as well as result in improved pharmacokinetic properties in blood, when delivered to a subject. In some embodiments, increased affinity of the CasX variant protein, and the resulting increased stability of the ribonucleoprotein complex, allows for a lower dose of the CasX variant protein to be delivered to the subject or cells while still having the desired activity, for example in vivo or in vitro gene editing.

In some embodiments, a higher affinity (tighter binding) of a CasX variant protein to a gNA allows for a greater amount of editing events when both the CasX variant protein and the gNA remain in an RNP complex. Increased editing events can be assessed using editing assays such as the EGFP disruption assay described herein.

In some embodiments, the $K_d$ of a CasX variant protein for a gNA is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant has about 1.1 to about 10-fold increased binding affinity to the gNA compared to the reference CasX protein of SEQ ID NO:2.

Without wishing to be bound by theory, in some embodiments amino acid changes in the Helical I domain can increase the binding affinity of the CasX variant protein with the gNA targeting sequence, while changes in the Helical II domain can increase the binding affinity of the CasX variant protein with the gNA scaffold stem loop, and changes in the oligonucleotide binding domain (OBD) increase the binding affinity of the CasX variant protein with the gRNA triplex.

Methods of measuring CasX protein binding affinity for a gNA include in vitro methods using purified CasX protein and gNA. The binding affinity for reference CasX and variant proteins can be measured by fluorescence polarization if the gNA or CasX protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference CasX and variant proteins of the disclosure for specific gNAs such as reference gNAs and variants thereof include, but are not limited to, isothermal calorimetry (ITC), and surface plasmon resonance (SPR), as well as the methods of the Examples.

n. Affinity for Target DNA

In some embodiments, a CasX variant protein has improved binding affinity for a target nucleic acid relative to the affinity of a reference CasX protein for a target nucleic acid. In some embodiments, the improved affinity for the target nucleic acid comprises improved affinity for the target nucleic acid sequence, improved affinity for the PAM sequence, an improved ability to search DNA for the target nucleic acid sequence, or any combinations thereof. Without wishing to be bound by theory, it is thought that CRISPR/Cas system proteins such as CasX may find their target nucleic acid sequences by one-dimension diffusion along a DNA molecule. The process is thought to include (1) binding of the ribonucleoprotein to the DNA molecule followed by (2) stalling at the target nucleic acid sequence, either of which may be, in some embodiments, affected by improved affinity of CasX proteins for a target nucleic acid sequence, thereby improving function of the CasX variant protein compared to a reference CasX protein.

In some embodiments, a CasX variant protein with improved target nucleic acid affinity has increased overall affinity for DNA. In some embodiments, a CasX variant protein with improved target nucleic acid affinity has increased affinity for specific PAM sequences other than the canonical TTC PAM recognized by the reference CasX protein of SEQ ID NO:2, including binding affinity for PAM sequences selected from the group consisting of TTC, ATC, GTC, and CTC. Without wishing to be bound by theory, it is possible that these protein variants will interact more strongly with DNA overall and will have an increased ability to access and edit sequences within the target DNA due to the ability to bind additional PAM sequences beyond those of wild-type Cas X, thereby allowing for a more efficient search process of the CasX protein for the target sequence. A higher overall affinity for DNA also, in some embodiments, can increase the frequency at which a CasX protein can effectively start and finish a binding and unwinding step, thereby facilitating target strand invasion and R-loop formation, and ultimately the cleavage of a target nucleic acid sequence.

Without wishing to be bound by theory, it is possible that amino acid changes in the NTSBD that increase the efficiency of unwinding, or capture, of a non-target DNA strand in the unwound state, can increase the affinity of CasX variant proteins for target DNA. Alternatively, or in addition, amino acid changes in the NTSBD that increase the ability of the NTSBD to stabilize DNA during unwinding can increase the affinity of CasX variant proteins for target DNA. Alternatively, or in addition, amino acid changes in the OBD may increase the affinity of CasX variant protein binding to the protospacer adjacent motif (PAM), thereby increasing affinity of the CasX variant protein for target nucleic acid. Alternatively, or in addition, amino acid changes in the Helical I and/or II, RuvC and TSL domains that increase the affinity of the CasX variant protein for the target nucleic acid strand can increase the affinity of the CasX variant protein for target nucleic acid.

In some embodiments, the CasX variant protein has increased binding affinity to the target nucleic acid sequence compared to the reference protein of SEQ ID NO: 1. SEQ ID NO:2, or SEQ ID NO:3. In some embodiments, affinity of a CasX variant protein of the disclosure for a target nucleic acid molecule is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100.

In some embodiments, a CasX variant protein has improved binding affinity for the non-target strand of the target nucleic acid. As used herein, the term "non-target strand" refers to the strand of the DNA target nucleic acid sequence that does not form Watson and Crick base pairs with the targeting sequence in the gNA, and is complementary to the target strand.

Methods of measuring CasX protein (such as reference or variant) affinity for a target nucleic acid molecule may include electrophoretic mobility shift assays (EMSAs), filter binding, isothermal calorimetry (ITC), and surface plasmon resonance (SPR), fluorescence polarization and biolayer interferometry (BLI). Further methods of measuring CasX protein affinity for a target include in vitro biochemical assays that measure DNA cleavage events over time.

CasX variant proteins with higher affinity for their target nucleic acid may, in some embodiments, cleave the target nucleic acid sequence more rapidly than a reference CasX protein that does not have increased affinity for the target nucleic acid.

In some embodiments, the CasX variant protein is catalytically dead (dCasX). In some embodiments, the disclosure provides RNP comprising a catalytically-dead CasX protein that retains the ability to bind target DNA. An exemplary catalytically-dead CasX variant protein comprises one or more mutations in the active site of the RuvC domain of the CasX protein. In some embodiments, a catalytically-dead CasX variant protein comprises substitutions at residues 672, 769 and/or 935 of SEQ ID NO:1. In some embodiments, a catalytically-dead CasX variant protein comprises substitutions of D672A, E769A and/or D935A in the reference CasX protein of SEQ ID NO:1. In some embodiments, a catalytically-dead CasX protein comprises substitutions at amino acids 659, 765 and/or 922 of SEQ ID NO:2. In some embodiments, a catalytically-dead CasX protein comprises D659A, E756A and/or D922A substitutions in a reference CasX protein of SEQ ID NO:2. In further embodiments, a catalytically-dead CasX variant protein comprises deletions of all or part of the RuvC domain of the reference CasX protein.

In some embodiments, improved affinity for DNA of a CasX variant protein also improves the function of catalytically inactive versions of the CasX variant protein. In some embodiments, the catalytically inactive version of the CasX variant protein comprises one or mutations in the DED motif in the RuvC. Catalytically dead CasX variant proteins can, in some embodiments, be used for base editing or epigenetic modifications. With a higher affinity for DNA, in some embodiments, catalytically dead CasX variant proteins can, relative to catalytically active CasX, find their target DNA faster, remain bound to target DNA for longer periods of time, bind target DNA in a more stable fashion, or a combination thereof, thereby improving the function of the catalytically dead CasX variant protein.

o. Improved Specificity for a Target Site

In some embodiments, a CasX variant protein has improved specificity for a target DNA sequence relative to a reference CasX protein. As used herein, "specificity," sometimes referred to as "target specificity," refers to the degree to which a CRISPR/Cas system ribonucleoprotein complex cleaves off-target sequences that are similar, but not identical to the target DNA sequence; e.g., a CasX variant RNP with a higher degree of specificity would exhibit reduced off-target cleavage of sequences relative to a reference CasX protein. The specificity, and the reduction of potentially deleterious off-target effects, of CRISPR/Cas system proteins can be vitally important in order to achieve an acceptable therapeutic index for use in mammalian subjects.

In some embodiments, a CasX variant protein has improved specificity for a target site within the target sequence that is complementary to the targeting sequence of the gNA.

Without wishing to be bound by theory, it is possible that amino acid changes in the Helical I and II domains that increase the specificity of the CasX variant protein for the target DNA strand can increase the specificity of the CasX variant protein for the target DNA overall. In some embodiments, amino acid changes that increase specificity of CasX variant proteins for target DNA may also result in decreased affinity of CasX variant proteins for DNA.

Methods of testing CasX protein (such as variant or reference) target specificity may include guide and Circularization for In vitro Reporting of Cleavage Effects by Sequencing (CIRCLE-seq), or similar methods. In brief, in CIRCLE-seq techniques, genomic DNA is sheared and circularized by ligation of stem-loop adapters, which are nicked in the stem-loop regions to expose 4 nucleotide palindromic overhangs. This is followed by intramolecular ligation and degradation of remaining linear DNA. Circular DNA molecules containing a CasX cleavage site are subsequently linearized with CasX, and adapter adapters are ligated to the exposed ends followed by high-throughput sequencing to generate paired end reads that contain information about the off-target site. Additional assays that can be used to detect off-target events, and therefore CasX protein specificity include assays used to detect and quantify indels (insertions and deletions) formed at those selected off-target sites such as mismatch-detection nuclease assays and next generation sequencing (NGS). Exemplary mismatch-detection assays include nuclease assays, in which genomic DNA from cells treated with CasX and sgNA is PCR amplified, denatured and rehybridized to form hetero-duplex DNA, containing one wild type strand and one strand with an indel. Mismatches are recognized and cleaved by mismatch detection nucleases, such as Surveyor nuclease or T7 endonuclease I.

p. Unwinding of DNA

In some embodiments, a CasX variant protein has improved ability of unwinding DNA relative to a reference CasX protein. In some embodiments, a CasX variant protein has enhanced DNA unwinding characteristics. Poor dsDNA unwinding has been shown previously to impair or prevent the ability of CRISPR/Cas system proteins anaCas9 or Cas14s to cleave DNA. Therefore, without wishing to be bound by any theory, it is likely that increased DNA cleavage activity by some CasX variant proteins is due at least in part to an increased ability to find and unwind the dsDNA at a target site.

Without wishing to be bound by theory, it is thought that amino acid changes in the NTSB domain may produce CasX variant proteins with increased DNA unwinding characteristics. Alternatively, or in addition, amino acid changes in the OBD or the helical domain regions that interact with the PAM may also produce CasX variant proteins with increased DNA unwinding characteristics.

Methods of measuring the ability of CasX proteins (such as variant or reference) to unwind DNA include, but are not limited to, in vitro assays that observe increased on rates of dsDNA targets in fluorescence polarization or biolayer interferometry.

q. Catalytic Activity

The ribonucleoprotein complex of the CasX:gNA systems disclosed herein comprise a reference CasX protein or variant thereof that bind to a target nucleic acid sequence and cleaves the target nucleic acid sequence. In some embodiments, a CasX variant protein has improved catalytic activity relative to a reference CasX protein. Without wishing to be bound by theory, it is thought that in some cases cleavage of the target strand can be a limiting factor for Cas12-like molecules in creating a dsDNA break. In some embodiments, CasX variant proteins improve bending of the target strand of DNA and cleavage of this strand, resulting in an improvement in the overall efficiency of dsDNA cleavage by the CasX ribonucleoprotein complex.

In some embodiments, a CasX variant protein has increased nuclease activity compared to a reference CasX protein. Variants with increased nuclease activity can be generated, for example, through amino acid changes in the RuvC nuclease domain. In one embodiment, the CasX variant comprises a nuclease domain having nickase activity. In the foregoing embodiment, the CasX nickase of a CasX:gNA system generates a single-stranded break within 10-18 nucleotides 3' of a PAM site in the non-target strand. In another embodiment, the CasX variant comprises a nuclease domain having double-stranded cleavage activity. In the foregoing embodiment, the CasX of the CasX:gNA system generates a double-stranded break within 18-26 nucleotides 5' of a PAM site on the target strand and 10-18 nucleotides 3' on the non-target strand. Nuclease activity can be assayed by a variety of methods, including those of the Examples. In one embodiment, a CasX variant has a Kcleave constant that is at least 2-fold, or at least 3-fold, or at least 4-fold, or at least 5-fold, or at least 6-fold, or at least 7-fold, or at least 8-fold, or at least 9-fold, or at least 10-fold greater compared to a reference wild-type CasX.

In some embodiments, a CasX variant protein has the improved characteristic of forming RNP with gNA that result in a higher percentage of cleavage-competent RNP compared to an RNP of a reference CasX protein of SEQ ID NO: 1, SEQ ID NO: 2, or SEQ ID NO: 3 and the gNA, as described in the Examples. By cleavage competent, it is meant that the RNP that is formed has the ability to cleave the target nucleic acid. In some embodiments, the RNP of the CasX variant and the gNA exhibit at least a 2% to at least 30%, or at least a 5% to at least a 20%, or at least a 10% to at least a 15% higher percentage of cleavage-competent RNP compared to an RNP of the reference CasX of SEQ ID NO: 1, SEQ ID NO: 2, or SEQ ID NO: 3 and the gNA of Table 1.

In some embodiments, a CasX variant protein has increased target strand loading for double strand cleavage. Variants with increased target strand loading activity can be generated, for example, through amino acid changes in the TLS domain.

Without wishing to be bound by theory, amino acid changes in the TSL domain may result in CasX variant proteins with improved catalytic activity. Alternatively, or in addition, amino acid changes around the binding channel for the RNA:DNA duplex may also improve catalytic activity of the CasX variant protein.

In some embodiments, a CasX variant protein has increased collateral cleavage activity compared to a reference CasX protein. As used herein. "collateral cleavage activity" refers to additional, non-targeted cleavage of nucleic acids following recognition and cleavage of a target nucleic acid sequence. In some embodiments, a CasX variant protein has decreased collateral cleavage activity compared to a reference CasX protein.

In some embodiments, for example those embodiments encompassing applications where target DNA cleavage is not a desired outcome, improving the catalytic activity of a CasX variant protein comprises altering, reducing, or abolishing the catalytic activity of the CasX variant protein. In some embodiments, a ribonucleoprotein complex comprising a CasX variant protein binds to a target DNA and does not cleave the target DNA.

In some embodiments, the CasX ribonucleoprotein complex comprising a CasX variant protein binds a target DNA but generates a single stranded nick in the target DNA In some embodiments, particularly those embodiments wherein the CasX protein is a nickase, a CasX variant protein has decreased target strand loading for single strand nicking. Variants with decreased target strand loading may be generated, for example, through amino acid changes in the TSL domain.

Exemplary methods for characterizing the catalytic activity of CasX proteins may include, but are not limited to, in vitro cleavage assays. In some embodiments, electrophoresis of DNA products on agarose gels can interrogate the kinetics of strand cleavage.

r. Affinity for Target RNA

In some embodiments, variants of a reference CasX protein increase the specificity of the CasX variant protein for a target RHO RNA, and increase the activity of the CasX variant protein with respect to a target RNA when compared to the reference CasX protein. For example, CasX variant proteins can display increased binding affinity for target RNAs, or increased cleavage of target RNAs, when compared to reference CasX proteins. In some embodiments, a ribonucleoprotein complex comprising a CasX variant protein binds to a target RNA and/or cleaves the target RNA. In one embodiment, a CasX variant has at least about two-fold to about 10-fold increased binding affinity to the target nucleic acid sequence compared to the reference protein of SEQ ID NO:1, SEQ ID NO:2, or SEQ ID NO:3.

s. Combinations of Mutations

In some embodiments, the present disclosure provides variants that are a combination of mutations from separate CasX variant proteins. In some embodiments, any variant to any domain described herein can be combined with other variants described herein. In some embodiments, any variant within any domain described herein can be combined with other variants described herein, in the same domain. Combinations of different amino acid changes may in some embodiments produce new optimized variants whose function is further improved by the combination of amino acid changes. In some embodiments, the effect of combining amino acid changes on CasX protein function is linear. As used herein, a combination that is linear refers to a combination whose effect on function is equal to the sum of the effects of each individual amino acid change when assayed in isolation. In some embodiments, the effect of combining amino acid changes on CasX protein function is synergistic. As used herein, a combination of variants that is synergistic refers to a combination whose effect on function is greater than the sum of the effects of each individual amino acid change when assayed in isolation. In some embodiments, combining amino acid changes produces CasX variant proteins in which more than one function of the CasX protein has been improved relative to the reference CasX protein.

t. CasX Fusion Proteins

In some embodiments, the disclosure provides CasX proteins comprising a heterologous protein fused to the CasX. In some cases, the CasX is a reference CasX protein. In other cases, the CasX is a CasX variant of any of the embodiments described herein.

In some embodiments, the CasX variant protein is fused to one or more proteins or domains thereof that has a different activity of interest (i.e., is part of a fusion protein). For example, in some embodiments, the CasX variant protein is fused to a protein (or domain thereof) that inhibits transcription, modifies a target nucleic acid sequence, or modifies a polypeptide associated with a nucleic acid (e.g., histone modification).

In some embodiments, a heterologous polypeptide (or heterologous amino acid such as a cysteine residue or a non-natural amino acid) can be inserted at one or more positions within a CasX protein to generate a CasX fusion protein. In other embodiments, a cysteine residue can be inserted at one or more positions within a CasX protein followed by conjugation of a heterologous polypeptide described below. In some alternative embodiments, a heterologous polypeptide or heterologous amino acid can be added at the N- or C-terminus of the reference or CasX variant protein. In other embodiments, a heterologous polypeptide or heterologous amino acid can be inserted internally within the sequence of the CasX protein.

In some embodiments, the reference CasX or variant fusion protein retains RNA-guided sequence specific target nucleic acid binding and cleavage activity. In some cases, the reference CasX or variant fusion protein has (retains) 50% or more of the activity (e.g., cleavage and/or binding activity) of the corresponding reference CasX or variant protein that does not have the insertion of the heterologous protein. In some cases, the reference CasX or variant fusion protein retains at least about 60%, or at least about 70% or more, at least about 80%, or at least about 90%, or at least about 92%, or at least about 95%, or at least about 98%, or at least about 100% of the activity (e.g., cleavage and/or binding activity) of the corresponding CasX protein that does not have the insertion of the heterologous protein.

In some cases, the reference CasX or variant fusion polypeptide retains (has) target nucleic acid binding activity relative to the activity of the CasX protein without the inserted heterologous amino acid or heterologous polypeptide. For example, in some cases, the reference CasX or variant fusion polypeptide has (retains) 50% or more of the binding activity of the corresponding CasX protein (the CasX protein that does not have the insertion). For example, in some cases, the reference CasX or variant fusion polypeptide has (retains) 60Y % or more (70% or more, 80% or more, 90% or more, 92% or more, 95% or more, 98% or more, or 100%) of the binding activity of the corresponding parent CasX protein (the CasX protein that does not have the insertion).

In some cases, the reference CasX or variant fusion polypeptide retains (has) target nucleic acid binding and/or cleavage activity relative to the activity of the parent CasX protein without the inserted heterologous amino acid or heterologous polypeptide. For example, in some cases, the reference CasX or variant fusion polypeptide has (retains) 50% or more of the binding and/or cleavage activity of the corresponding parent CasX protein (the CasX protein that does not have the insertion). For example, in some cases, the reference CasX or variant fusion polypeptide has (retains) 60% or more (70% or more, 80% or more, 90% or more, 92% or more, 95% or more, 98% or more, or 100%) of the binding and/or cleavage activity of the corresponding CasX parent polypeptide (the CasX protein that does not have the insertion). Methods of measuring cleaving and/or binding activity of a CasX protein and/or a CasX fusion polypeptide will be known to one of ordinary skill in the art and any convenient method can be used.

A variety of heterologous polypeptides are suitable for inclusion in a reference CasX or CasX variant fusion protein of the disclosure. In some cases, the fusion partner can modulate transcription (e.g., inhibit transcription, increase transcription) of a target DNA. For example, in some cases the fusion partner is a protein (or a domain from a protein) that inhibits transcription (e.g., a transcriptional repressor, a protein that functions via recruitment of transcription inhibitor proteins, modification of target DNA such as methylation, recruitment of a DNA modifier, modulation of histones associated with target DNA, recruitment of a histone modifier such as those that modify acetylation and/or methylation of histones, and the like). In some cases the fusion partner is a protein (or a domain from a protein) that increases transcription (e.g., a transcription activator, a protein that acts via recruitment of transcription activator proteins, modification of target DNA such as demethylation, recruitment of a DNA modifier, modulation of histones associated with target DNA, recruitment of a histone modifier such as those that modify acetylation and/or methylation of histones, and the like).

In some cases, a fusion partner has enzymatic activity that modifies a target nucleic acid sequence (e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity).

In some cases, a fusion partner has enzymatic activity that modifies a polypeptide (e.g., a histone) associated with a target nucleic acid (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity).

Examples of proteins (or fragments thereof) that can be used as a fusion partner to increase transcription include but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET domain containing 1A, histone lysine methyltransferase (SET1A), SET domain containing 1B, histone lysine methyltransferase (SET1B), lysine methyltransferase 2A (MLL1 to 5, ASCL1 (ASH1) achaete-scute family bHLH transcription factor 1 (ASH1), SET and MYND domain containing 2 (SYMD2), nuclear receptor binding SET domain protein 1 (NSD1), and the like; histone lysine demethylases such as lysine demethylase 3A (JHDM2a)/Lysine-specific demethylase 3B (JHDM2b), lysine demethylase 6A (UTX), lysine demethylase 6B (JMJD3), and the like; histone acetyltransferases such as lysine acetyltransferase 2A (GCN5), lysine acetyltransferase 2B (PCAF), CREB binding protein (CBP), E1A binding protein p300 (p300), TATA-box binding protein associated factor 1 (TAF1), lysine acetyltransferase 5 (TIP60/PLIP), lysine acetyltransferase 6A (MOZ/MYST3), lysine acetyltransferase 6B (MORF/MYST4), SRC proto-oncogene, non-receptor tyrosine kinase (SRC1), nuclear receptor coactivator 3 (ACTR), MYB binding protein 1a (P160), clock circadian regulator (CLOCK), and the like; and DNA demethylases such as Ten-Eleven Translocation (TET) dioxygenase 1 (TET1CD), tet methylcytosine dioxygenase 1 (TET1), demeter (DME), demeter-like 1 (DML1), demeter-like 2 (DML2), protein ROS1 (ROS1), and the like.

Examples of proteins (or fragments thereof) that can be used as a fusion partner to decrease transcription include but are not limited to: transcriptional repressors such as the Kruppel associated box (KRAB or SKD); KOX1 repression domain: the Mad mSIN3 interaction domain (SID); the ERF repressor domain (ERD), the SRDX repression domain (e.g., for repression in plants), and the like; histone lysine methyltransferases such as PR/SET domain containing protein (Pr-SET7/8), lysine methyltransferase 5B (SUV4-20H1), PR/SET domain 2 (RIZ1), and the like; histone lysine demethylases such as lysine demethylase 4A (JMJD2A/JHDM3A), lysine demethylase 4B (JMJD2B), lysine demethylase 4C (JMJD2C/GASC1), lysine demethylase 4D (JMJD2D), lysine demethylase 5A (JARID1A/RBP2), lysine demethylase 5B (JARID1B/PLU-1), lysine demethylase 5C (JARID 1C/SMCX), lysine demethylase 5D (JARID1D/SMCY), and the like; histone lysine deacetylases such as histone deacetylase 1 (HDAC1), HDAC2, HDAC3, HDAC8, HDAC4, HDAC5, HDAC7, HDAC9, sirtuin 1 (SIRT1). SIRT2, HDAC11, and the like: DNA methylases such as HhaI DNA m5c-methyltransferase (M.HhaI). DNA methyltransferase 1 (DNMT1). DNA methyltransferase 3a (DNMT3a), DNA methyltransferase 3b (DNMT3b), methyltransferase 1 (MET1), S-adenosyl-L-methionine-dependent methyltransferases superfamily protein (DRM3) (plants), DNA cytosine methyltransferase MET2a (ZMET2), chromomethylase 1 (CMT1), chromomethylase 2 (CMT2) (plants), and the like; and periphery recruitment elements such as Lamin A, Lamin B, and the like.

In some cases the fusion partner has enzymatic activity that modifies the target nucleic acid sequence (e.g., ssRNA, dsRNA, ssDNA, dsDNA). Examples of enzymatic activity that can be provided by the fusion partner include but are not limited to: nuclease activity such as that provided by a restriction enzyme (e.g., FokI nuclease), methyltransferase activity such as that provided by a methyltransferase (e.g., HhaI DNA m5c-methyltransferase (M.HhaI), DNA methyltransferase 1 (DNMT1), DNA methyltransferase 3a (DNMT3a), DNA methyltransferase 3b (DNMT3b), MET1, DRM3 (plants). ZMET2, CMT1, CMT2 (plants), and the like); demethylase activity such as that provided by a demethylase (e.g., Ten-Eleven Translocation (TET) dioxygenase 1 (TET 1 CD). TET1, DME, DML1, DML2, ROS1, and the like), DNA repair activity, DNA damage activity, deamination activity such as that provided by a deaminase (e.g., a cytosine deaminase enzyme, e.g., an APOBEC protein such as rat APOBEC1), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y: human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

In some cases, a reference CasX or Cas X variant protein of the present disclosure is fused to a poly peptide selected from: a domain for increasing transcription (e.g., a VP16 domain, a VP64 domain), a domain for decreasing transcription (e.g., a KRAB domain, e.g., from the Kox1 protein), a core catalytic domain of a histone acetyltransferase (e.g., histone acetyltransferase p300), a protein/domain that provides a detectable signal (e.g., a fluorescent protein such as GFP), a nuclease domain (e.g., a Fok1 nuclease), and a base editor (e.g., cytidine deaminase such as APOBEC1).

In some cases, the fusion partner has enzymatic activity that modifies a protein associated with the target nucleic acid sequence (e.g., ssRNA, dsRNA, ssDNA, dsDNA) (e.g., a histone, an RNA binding protein, a DNA binding protein, and the like). Examples of enzymatic activity (that modifies a protein associated with a target nucleic acid) that can be provided by the fusion partner include but are not limited to: methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB 1, and the like, SET1A. SET1B, MLL1 to 5, ASH1, SYMD2, NSD1, DOT1L, Pr-SET7/8, SUV4-20H1, EZH2, RIZ1), demethylase activity such as that provided by a histone demethylase (e.g., Lysine Demethylase 1A (KDMI A also known as LSD1), JHDM2a/b, JMJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HB01/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

Additional examples of suitable fusion partners are (i) a dihydrofolate reductase (DHFR) destabilization domain to generate a chemically controllable subject RNA-guided polypeptide or a conditionally active RNA-guided polypeptide, and (ii) a chloroplast transit peptide.

Suitable chloroplast transit peptides include, but are not limited to:

(SEQ ID NO: 161)
MASMISSSAVTTVSRASRGQSAAMAPFGGLKSMTGFPVRKVNTDIT

SITSNGGRVKCMQVWPPIGKKKFETLSYLPPLTRDSRA;

(SEQ ID NO: 162)
MASMISSSAVTIVSRASRGQSAAMAPFGGLKSMTGFPVRKVNTDIT

SITSNGGRVKS;

(SEQ ID NO: 163)
MASSMLSSATMVASPAQATMVAPFNGLKSSAAFPATRKANNDITSIT

SNGGRVNCMQVWPPIEKKKEETLSYLPDLTDSGGRVNC;

(SEQ ID NO: 164)
MAQVSRICNGVQNPSLISNLSKSSQRKSPLSVSLKTQQHPRAYPISS

WGLKKSGMTLIGSELRPLKVMSSVSTAC;

(SEQ ID NO: 165)
MAQVSRICNGVWNPSLISNLSKSSQRKSPLSVSLKTQQHPRAYPISS

SWGLKKSGMTLIGSELRPLKVMSSVSTAC;

(SEQ ID NO: 166)
MAQINNMAQGIQTLNPNSNFHKPQVPKSSSFLVFGSKKLKNSANSML

VLKKDSITMQLFCSFRISASVATAC;

(SEQ ID NO: 167)
MAALVTSQLATSGTVLSVTDRFRRPGFQGLRPRNPADAALGMRTVGAS

AAPKQSRKPHRFDRRCLSMVV;

(SEQ ID NO: 168)
MAALTTSQLATSATGFGIADRSAPSSLLRHGFQGLKPRSPAGGDATSL

SVTTSARATPKQQRSVQRGSRRFPSVVVC;

(SEQ ID NO: 169)
MASSVLSSAAVATRSNVAQANMVAPFTGLKSAASFPVSRKQNLDITSI

ASNGGRVQC;

(SEQ ID NO: 170)
MESLAATSVFAPSRVAVPAARALVRAGTVVPTRRTSSTSGTSGVKCSA

AVTPQASPVISRSAAAA; and (SEQ ID NO: 171)
MGAAATSMQSLKFSNRLVPPSRRLSPVPNNVTCNNLPKSAAPVRTVKC

CASSWNSTINGAAATTNGASAASS.

In some cases, a reference CasX or variant polypeptide of the present disclosure can include an endosomal escape peptide. In some cases, an endosomal escape polypeptide comprises the amino acid sequence GLFX-ALLXLLXSLWXLLLXA (SEQ ID NO: 172), wherein each X is independently selected from lysine, histidine, and arginine. In some cases, an endosomal escape polypeptide comprises the amino acid sequence GLF-HALLHLLHSLWHLLLHA (SEQ ID NO: 173), or HHHHHHHHH (SEQ ID NO: 174).

Non-limiting examples of fusion partners for use when targeting ssRNA target nucleic acid sequences include (but are not limited to): splicing factors (e.g., RS domains); protein translation components (e.g., translation initiation, elongation, and/or release factors: e.g., eIF4G); RNA methylases: RNA editing enzymes (e.g., RNA deaminases, e.g., adenosine deaminase acting on RNA (ADAR), including A to I and/or C to U editing enzymes); helicases; RNA-binding proteins; and the like. It is understood that a heterologous polypeptide can include the entire protein or in some cases can include a fragment of the protein (e.g., a functional domain).

A fusion partner can be any domain capable of interacting with ssRNA (which, for the purposes of this disclosure, includes intramolecular and/or intermolecular secondary structures, e.g., double-stranded RNA duplexes such as hairpins, stem-loops, etc.), whether transiently or irreversibly, directly or indirectly, including but not limited to an effector domain selected from the group comprising; Endonucleases (for example RNase III, the CRR22 DYW domain, Dicer, and PIN (PIT N-terminus) domains from proteins such as SMG5 and SMG6); proteins and protein domains responsible for stimulating RNA cleavage (for example CPSF, CstF, CFIm and CFIIm); Exonucleases (for example XRN-1 or Exonuclease T); Deadenylases (for example HNT3): proteins and protein domains responsible for nonsense mediated RNA decay (for example UPF1, UPF2, UPF3, UPF3b, RNP S1, Y14, DEK, REF2, and SRm160); proteins and protein domains responsible for stabilizing RNA (for example PABP); proteins and protein domains responsible for repressing translation (for example Ago2 and Ago4); proteins and protein domains responsible for stimulating translation (for example Staufen): proteins and protein domains responsible for (e.g., capable of) modulating translation (e.g., translation factors such as initiation factors, elongation factors, release factors, etc., e.g., eIF4G); proteins and protein domains responsible for polyadenylation of RNA (for example PAP1, GLD-2, and Star-PAP); proteins and protein domains responsible for polyuridinylation of RNA (for example CI DI and terminal uridylate transferase); proteins and protein domains responsible for RNA localization (for example from IMP1. ZBP1, She2p, She3p, and Bicaudal-D): proteins and protein domains responsible for nuclear retention of RNA (for example Rrp6): proteins and protein domains responsible for nuclear export of RNA (for example TAP, NXF1, THO, TREX, REF, and Aly): proteins and protein domains responsible for repression of RNA splicing (for example PTB, Sam68, and hnRNP A1): proteins and protein domains responsible for stimulation of RNA splicing (for example Serine/Arginine-rich (SR) domains); proteins and protein domains responsible for reducing the efficiency of transcription (for example FUS (TLS)); and proteins and protein domains responsible for stimulating transcription (for example CDK7 and HIV Tat). Alternatively, the effector domain may be selected from the group comprising Endonucleases: proteins and protein domains capable of stimulating RNA cleavage; Exonucleases: Deadenylases; proteins and protein domains having nonsense mediated RNA decay activity: proteins and protein domains capable of stabilizing RNA: proteins and protein domains capable of repressing translation: proteins and protein domains capable of stimulating translation; proteins and protein domains capable of modulating translation (e.g., translation factors such as initiation factors, elongation factors, release factors, etc., e.g., eIF4G): proteins and protein domains capable of polyadenylation of RNA: proteins and protein domains capable of polyuridinylation of RNA: proteins and protein domains having RNA localization activity; proteins and protein domains capable of nuclear retention of RNA; proteins and protein domains having RNA nuclear export activity; proteins and protein domains capable of repression of RNA splicing: proteins and protein domains capable of stimulation of RNA splicing; proteins and protein domains capable of reducing the efficiency of transcription: and proteins and protein domains capable of stimulating transcription. Another suitable heterologous polypeptide is a PUF RNA-binding domain, which is described in more detail in WO2012068627, which is hereby incorporated by reference in its entirety.

Some RNA splicing factors that can be used (in whole or as fragments thereof) as a fusion partner have modular organization, with separate sequence-specific RNA binding modules and splicing effector domains. For example, members of the serine/arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP A1 binds to exonic splicing silencers (ESSs) through its RRM domains and inhibits exon inclusion through a C-terminal Glycine-rich domain. Some splicing factors can regulate alternative use of splice site (ss) by binding to regulatory sequences between the two alternative sites. For example, ASF/SF2 can recognize ESEs and promote the use of intron proximal sites, whereas hnRNP A1 can bind to ESSs and shift splicing towards the use of intron distal sites. One application for such factors is to generate ESFs that modulate alternative splicing of endogenous genes, particularly disease associated genes. For example, Bcl-x pre-mRNA produces two splicing isoforms with two alternative 5' splice sites to encode proteins of opposite functions. The long splicing isoform Bcl-xL is a potent apoptosis inhibitor expressed in long-lived post mitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple cc-elements that are located in either the core exon region or the exon extension region (i.e., between the two alternative 5' splice sites). For more examples, see WO2010075303, which is hereby incorporated by reference in its entirety.

Further suitable fusion partners include, but are not limited to proteins (or fragments thereof) that are boundary elements (e.g., CTCF), proteins and fragments thereof that provide periphery recruitment (e.g., Lamin A, Lamin B, etc.), protein docking elements (e.g., FKBP/FRB, Pill/Aby1, etc.).

In some cases, a heterologous polypeptide (a fusion partner) provides for subcellular localization, i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like). In some embodiments, a subject RNA-guided polypeptide or a conditionally active RNA-guided polypeptide and/or subject CasX fusion polypeptide does not include a NLS so that the protein is not targeted to the nucleus (which can be advantageous, e.g., when the target nucleic acid sequence is an RNA that is present in the cytosol). In some embodiments, a fusion partner can provide a tag (i.e., the heterologous polypeptide is a detectable label) for ease of tracking and/or purification (e.g., a fluorescent protein, e.g., green fluorescent protein (GFP), yellow fluorescent protein (YFP), red fluorescent protein (RFP), cyan fluorescent protein (CFP), mcherry, tdTomato, and the like, a histidine tag, e.g., a 6xHis tag; a hemagglutinin (HA) tag; a FLAG tag; a Myc tag; and the like).

In some cases a reference or CasX variant polypeptide includes (is fused to) a nuclear localization signal (NLS) (e.g., in some cases 2 or more, 3 or more, 4 or more, or 5 or more 6 or more, 7 or more, 8 or more NLSs). Thus, in some cases, a reference or CasX variant polypeptide includes one or more NLSs (e.g., 2 or more, 3 or more, 4 or more, or 5 or more NLSs). In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus. In some cases a reference or CasX variant polypeptide includes (is fused to) between 1 and 10 NLSs (e.g., 1-9, 1-8, 1-7, 1-6, 1-5, 2-10, 2-9, 2-8, 2-7, 2-6, or 2-5 NLSs). In some cases a reference or CasX variant polypeptide includes (is fused to) between 2 and 5 NLSs (e.g., 2-4, or 2-3 NLSs).

Non-limiting examples of NLSs include sequences derived from: the NLS of the SV40 virus large T-antigen, having the amino acid sequence PKKKRKV (SEQ ID NO: 176); the NLS from nucleoplasmin (e.g., the nucleoplasmin bipartite NLS with the sequence KRPAATKKAGQAKKKK (SEQ ID NO: 177); the c-myc NLS having the amino acid sequence PAAKRVKLD (SEQ ID NO: 178) or RQRR-NELKRSP (SEQ ID NO: 179); the hRNPA1 M9 NLS having the sequence NQSSNFGPMKGGNFG-GRSSGPYGGGGQYFAKPRNQGGY (SEQ ID NO: 180); the sequence RMRIZFKNKGKDTAELRRRRVEVS-VELRKAKKDEQILKRRNV (SEQ ID NO: 181) of the IBB domain from importin-alpha; the sequences VSRKRPRP (SEQ ID NO: 182) and PPKKARED (SEQ ID No: 183) of the myoma T protein; the sequence PQPKKKPL (SEQ ID NO: 184) of human p53; the sequence SALIKKKKKMAP (SEQ ID NO: 185) of mouse c-abl IV; the sequences DRLRR (SEQ ID NO: 186) and PKQKKRK (SEQ ID NO: 187) of the influenza virus NS1; the sequence RKLKK-KIKKL (SEQ ID NO: 188) of the Hepatitis virus delta antigen; the sequence REKKKFLKRR (SEQ ID NO: 189) of the mouse Mx1 protein; the sequence KRKGDEVDGVDEVAKKKSKK (SEQ ID NO: 190) of the human poly(ADP-ribose) polymerase; the sequence RKCLQAGMNLEARKTKK (SEQ ID NO: 191) of the steroid hormone receptors (human) glucocorticoid: the sequence PRPRKIPR (SEQ ID NO: 192) of Borna disease virus P protein (BDV-P1): the sequence PPRKKRTVV (SEQ ID NO: 193) of hepatitis C virus nonstructural protein (HCV-NS5A); the sequence NLSKKKKRKREK (SEQ ID NO: 194) of LEF1; the sequence RRPSRPFRKP (SEQ ID NO: 195) of ORF57 simirae; the sequence KRPRSPSS (SEQ ID NO: 196) of EBV LANA; the sequence KRGIN-DRNFWRGENERKTR (SEQ ID NO: 197) of Influenza A protein; the sequence PRPPKMARYDN (SEQ ID NO: 198) of human RNA helicase A (RHA); the sequence KRSFSKAF (SEQ ID NO: 199) of nucleolar RNA helicase II; the sequence KLKIKRPVK (SEQ ID NO: 200) of TUS-protein; the sequence PKKKRKVPPPPAAKRVKLD (SEQ ID NO: 201) associated with importin-alpha; the sequence PKTRRRPRRSQRKRPPT (SEQ ID NO: 202) from the Rex protein in HTLV-1; the sequence MSRRR-KANPTKLSENAKKLAKEVEN (SEQ ID NO: 203) from the EGL-13 protein of Caenorhabditis elegans; and the sequences KTRRRPRRSQRKRPPT (SEQ ID NO: 204), RRKKRRPRRKKRR (SEQ ID NO: 205), PKKKSRKPKKKSRK (SEQ ID NO: 206), HKKKHP-DASVNFSEFSK (SEQ ID NO: 207), QRPGPY-DRPQRPGPYDRP (SEQ ID NO: 208), LSPSLSPLLSPSL-SPL (SEQ ID NO: 209), RGKGGKGLGKGGAKRHRK (SEQ ID NO: 210), PKRGRGRPKRGRGR (SEQ ID NO: 211), PKKKRKVPPPPAAKRVKLD (SEQ ID NO: 212) and PKKKRKVPPPPKKKRKV (SEQ ID NO: 213). In general, NLS or (multiple NLSs) are of sufficient strength to drive accumulation of a reference or CasX variant fusion protein in the nucleus of a eukaryotic cell. Detection of accumulation in the nucleus may be performed by any suitable technique. For example, a detectable marker may be fused to a reference or CasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined.

In some cases, a reference or CasX variant fusion protein includes a "Protein Transduction Domain" or PTD (also known as a CPP—cell penetrating peptide), which refers to a protein, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from an extracellular space to an intracellular space, or from the cytosol to within an organelle. In some embodiments, a PTD is covalently linked to the amino terminus of a reference or CasX variant fusion protein. In some embodiments, a PTD is covalently linked to the carboxyl terminus of a reference or CasX variant fusion protein. In some cases, the PTD is inserted internally in the sequence of a reference or CasX variant fusion protein at a suitable insertion site. In some cases, a reference or CasX variant fusion protein includes (is conjugated to, is fused to) one or more PTDs (e.g., two or more, three or more, four or more PTDs). In some cases, a PTD includes one or more nuclear localization signals (NLS). Examples of PTDs include but are not limited to peptide transduction domain of HIV TAT comprising YGRKKRRQRRR (SEQ ID NO: 214), RKKRRQRR (SEQ ID NO: 215); YARAAARQARA (SEQ ID NO: 216); THRLPRRRRRR (SEQ ID NO: 217); and GGRRARRRRRR (SEQ ID NO: 218); a polyarginine sequence comprising a number of arginines sufficient to direct entry into a cell (e.g., 3, 4, 5, 6, 7, 8, 9, 10, or 10-50 arginines (SEQ ID NO: 219)); a VP22 domain (Zender et al. (2002) Cancer Gene Ther. 9(6):489-96); an *Drosophila* Antennapedia protein transduction domain (Noguchi et al. (2003) Diabetes 52(7): 1732-1737); a truncated human calcitonin peptide (Trehin et al. (2004) Pharm. Research 21:1248-1256); polylysine (Wender et al. (2000) Proc. Natl. Acad. Sci. USA 97: 13003-13008); RRQRRTSKLMKR (SEQ ID NO: 220); Transportan GWTLNSAGYLLGKINL-KALAALAKKIL (SEQ ID NO: 221); KALAWEAK-LAKALAKALAKHLAKALAKALKCEA (SEQ ID NO: 222); and RQIKIWFQNRRMKWKK (SEQ ID NO: 223). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

In some embodiments, a reference or CasX variant fusion protein can include a CasX protein that is linked to an internally inserted heterologous amino acid or heterologous polypeptide (a heterologous amino acid sequence) via a linker polypeptide (e.g., one or more linker polypeptides). In some embodiments, a reference or CasX variant fusion protein can be linked at the C-terminal and/or N-terminal end to a heterologous polypeptide (fusion partner) via a linker polypeptide (e.g., one or more linker polypeptides) The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers are generally produced by using synthetic, linker-encoding oligonucleotides to couple the proteins. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use. Example linker polypeptides include glycine polymers (G)n, glycine-serine polymer (including, for example, (GS)n, GSGGSn (SEQ ID NO: 224), GGSGGSn (SEQ ID NO: 225), and GGGSn (SEQ ID NO: 226), where n is an integer of at least one), glycine-alanine polymers, alanine-serine polymers, glycine-proline polymers, proline polymers and proline-alanine polymers. Example linkers can comprise amino acid sequences including, but not limited to, GGSG (SEQ ID NO: 227), GGSGG (SEQ ID NO: 228), GSGSG (SEQ ID NO: 229), GSGGG (SEQ ID NO: 230), GGGSG (SEQ ID NO: 231), GSSSG (SEQ ID NO: 232), GPGP (SEQ ID NO: 233), GGP, PPP, PPAPPA (SEQ ID NO: 234), PPPGPPP (SEQ ID NO: 235) and the like. The ordinarily skilled artisan will recognize that design of a peptide conjugated to any elements described above can include linkers that are all or partially flexible, such that the linker can include a flexible linker as well as one or more portions that confer less flexible structure.

V. Systems and Methods for Modification of RHO Nucleic Acids

The CRISPR proteins, guide nucleic acids, and variants thereof provided herein are useful for various applications, including as therapeutics, diagnostics, and for research. To effect the methods of the disclosure for gene editing, resulting in modification of the RHO gene, provided herein are programmable Class 2, Type V CRISPR systems. The programmable nature of the systems provided herein allows for the precise targeting to achieve the desired effect at one or more regions of predetermined interest in the target nucleic acid sequence of the RHO gene. A variety of strategies and methods can be employed to modify the target nucleic acid sequence in a cell using the systems provided herein. As used herein "modifying" includes, but is not limited to, cleaving, nicking, editing, deleting, knocking out, knocking down, mutating, correcting, exon-skipping and the like. Depending on the system components utilized, the editing event may be a cleavage event followed by introducing random insertions or deletions (indels) or other mutations (e.g., a substitution, duplication, or inversion of one or more nucleotides), for example by utilizing the imprecise non-homologous DNA end joining (NHEJ) repair pathway, which may generate, for example, a frame shift mutation. Alternatively, the editing event may be a cleavage event followed by homology-directed repair (HDR), homology-independent targeted integration (HITI), micro-homology mediated end joining (MMEJ), single strand annealing (SSA) or base excision repair (BER), resulting in modification of the target nucleic acid sequence.

In some embodiments, the present disclosure provides methods for the modification of RHO target nucleic acid in a cell having one or more mutations wherein the target nucleic acid is modified to correct or compensate for the one or more mutations such that wild-type rhodopsin (SEQ ID NO:33 or 34) or a functional rhodopsin protein is expressed. In other embodiments, the present disclosure provides methods for the modification of RHO target nucleic acid in a cell having one or more mutations wherein the target nucleic acid is modified to knock-down or knock-out the RHO gene such that expression of the mutant rhodopsin is reduced or eliminated. Non-limiting examples of known mutations of rhodopsin (SEQ ID NO:33) contemplated for modification using the methods and systems of the disclosure are presented in Table 4A.

TABLE 4A

Mutations of rhodopsin relative to SEQ ID NO: 33

| Amino Acid Mutations | Functional Features |
|---|---|
| L328P, T342M, Q344R/P/ter, V345L/M, A346P, P347A/R/Q/L/S/T, Ter349/Q/E | Post-Golgi trafficking and OS targeting |
| N15S, T17M, V20G, P23A/H/L, Q28H, G51R/V, P53R, T58R/M, V87D, G89D, G106R/W, C110F/R/S/Y, E113K, L125R, W161R, A164E/V, C167R/W, P171Q/L/S, Y178N/D/C, E181K, G182S/V, C185R, C187G/Y, G188R/E, D190N/G/Y, H211R/P, C222R, P267R/L, S270R, K296N/E/M | Misfolding, ER retention and instability |
| R135G/L/P/W | Disrupted vesicular traffic and endocytosis |
| T4K, T17M, M39R, N55K, G90V | Altered post-translational modifications and reduced stability |
| M44T, V137M | Altered transducin activation |
| G90D, T94I, A292E, A295V | Constitutive activation |
| F45L, V209M, F220C | Dimerization deficiency |
| P12R, R21C, Q28H, L40R, L46R, L47R, F52Y, F56Y, L57R, Y60ter, Q64ter, R69H, N78I, L79P, V87L, L88P, T92I, T97I, V104F, G109R, G114D/V, E122G, W126L/ter, S127F, L131P, Y136ter, C140S, T160T, M163T, A169P, P170H/R, S176F, P180A/S, Q184P, S186P/W, Y191C, T193M, M207R/K, V210F, I214N, P215L/T, M216R/L/K, R252P, T289P, S297R, A298D, K311E, N315ter, E341K, S343C | No observed biochemical or cellular defect or not studied in detail |

Table 4B sets forth targeting sequences specific to Rho mutants. The ClinVar designation (www.ncbi.nlm.nih.gov/clinvar/) is shown in the left hand column.

TABLE 4B

Targeting sequences directed to RHO mutants

| Clin Var Designation | Sequence | SEQ ID NO: |
|---|---|---|
| VCV000013013 | AAGUGGCUGCGUACCACACC | 382 |
| VCV000013014 | UAGGCAGGUCUUAGGCCAGG | 383 |
| VCV000013014 | UAGGCCAGGGCCACCUGGCU | 384 |
| VCV000013015 | UAGGCCGAGGCCACCUGGCU | 385 |
| VCV000013015 | GCCUAAGACCUGCCUAGGAC | 386 |
| VCV000013016 | ACUUCCUCAGGCUCUACGUC | 387 |
| VCV000013016 | GGCUCUACGUCACCGUCCAG | 388 |
| VCV000013016 | CCAUCAACUUCCUCAGGCUC | 389 |
| VCV000013016 | UCAGGCUCUACGUCACCGUC | 390 |
| VCV000013018 | CCAAUGCGAUGGGUGUGGUA | 391 |
| VCV000013018 | AAUGCGAUGGGUGUGGUACG | 392 |
| VCV000013019 | GCAGAAGCAUGUAGGCGGCC | 393 |
| VCV000013020 | UGGACCUAGGUGGCUUCACC | 394 |
| VCV000013020 | UCAUGGACCUAGGUGGCUUC | 395 |
| VCV000013020 | AUGAAGAGGUCAGCCACGGC | 396 |
| VCV000013021 | UCAUGGUCCUAGAUGGCUUC | 397 |
| VCV000013021 | UAGAUGGCUUCACCAGCACC | 398 |
| VCV000013021 | UGGUCCUAGAUGGCUUCACC | 399 |
| VCV000013021 | AGGACCAUGAAGAGGUCAGC | 400 |
| VCV000013022 | UCUUCUGGCCCACAGGAUGC | 401 |
| VCV000013022 | UGUGGGCCAGAAGACGAAGU | 402 |
| VCV000013022 | UCUGGCCCACAGGAUGCAAU | 403 |
| VCV000013023 | UGUGGAAUCAACUACUACAC | 404 |
| VCV000013024 | UGGCCAUCGAGCUGUACGUG | 405 |
| VCV000013024 | AGCUGUACGUGGUGGUGUGU | 406 |
| VCV000013025 | GGGAUGCACCUGAGGACAGG | 407 |
| VCV000013025 | UCAGGUGCAUCCCCGAGGGC | 408 |
| VCV000013025 | GGUGCAUCCCCGAGGGCCUG | 409 |
| VCV000013026 | UGUGGAAUCGGCUACUACAC | 410 |
| VCV000013026 | GCUACUACACGCUCAAGCCG | 411 |
| VCV000013027 | CCUUCACCAUCCCCAUGAUU | 412 |
| VCV000013027 | ACAUGUUCGUGGUCCCCUUC | 413 |
| VCV000013027 | UGGUCCCCUUCACCAUCCCC | 414 |
| VCV000013027 | UGGGGAUGGUGAAGGGGACC | 415 |
| VCV000013028 | UGGCCAUCGAGUGGUACGUG | 416 |
| VCV000013028 | AGUGGUACGUGGUGGUGUGU | 417 |
| VCV000013029 | AAGACGGAGACGAGCUAGGU | 418 |
| VCV000013029 | UAGGCCGGGGCCACCUAGCU | 419 |
| VCV000013030 | CAGCGUUCUUUGCCGAGAGC | 420 |
| VCV000013030 | GCAAAGAACGCUGGGAUGGU | 421 |

TABLE 4B-continued

Targeting sequences directed to RHO mutants

| Clin Var Designation | Sequence | SEQ ID NO: |
|---|---|---|
| VCV000013030 | CGGCAAAGAACGCUGGGAUG | 422 |
| VCV000013030 | UUGCCGAGAGCGCCGCCAUC | 423 |
| VCV000013032 | UAGGCCCGGGCCACCUGGCU | 424 |
| VCV000013032 | UAGGCAGGUCUUAGGCCCGG | 425 |
| VCV000013033 | CCGAGAGCCUGCAGUGCUCG | 426 |
| VCV000013033 | ACACGAGCACUGCAGGCUCU | 427 |
| VCV000013033 | UCAGGUACAUCCCCGAGAGC | 428 |
| VCV000013033 | CGGGGAUGUACCUGAGGACA | 429 |
| VCV000013033 | GGUACAUCCCCGAGAGCCUG | 430 |
| VCV000013034 | GCUGGGUGCUCUACGCCAGC | 431 |
| VCV000013034 | UGAUCUGCUGGGUGCUCUAC | 432 |
| VCV000013034 | ACGCCAGCGUGGCAUUCUAC | 433 |
| VCV000013035 | AAAUUGUAUCCUGUGGGCCC | 434 |
| VCV000013035 | UCGGGCCCACAGGAUACAAU | 435 |
| VCV000013035 | GGCCCACAGGAUACAAUUUG | 436 |
| VCV000013037 | UGCUGGGCUUCCGCAUCAAC | 437 |
| VCV000013037 | GCAUCAACUUCCUCACGCUC | 438 |
| VCV000013038 | UCAGGCCCACAGGAUGCAAU | 439 |
| VCV000013038 | UCUUCAGGCCCACAGGAUGC | 440 |
| VCV000013038 | UGUGGGCCUGAAGACGAAGU | 441 |
| VCV000013040 | UGUGGAAUCUACUACUACAC | 442 |
| VCV000013042 | ACGUGCCCUUCUCCAGUGCG | 443 |
| VCV000013042 | CACUGGAGAAGGGCACGUAG | 444 |
| VCV000013042 | CCAGUGCGACGGGUGUGGUA | 445 |
| VCV000013042 | AGUGCGACGGGUGUGGUACG | 446 |
| VCV000013043 | ACAGGUUCGUGGUCCACUUC | 447 |
| VCV000013043 | UCUACAGGUUCGUGGUCCAC | 448 |
| VCV000013043 | UUUGUCAUCUACAGGUUCGU | 449 |
| VCV000013044 | UGACCAUCCCAGAGUUCUUU | 450 |
| VCV000013044 | GGGAUGGUCAUGAAGAUGGG | 451 |
| VCV000013044 | UGGCAAAGAACUCUGGGAUG | 452 |
| VCV000013044 | CAGAGUUCUUUGCCAAGAGC | 453 |
| VCV000013044 | UCAUGACCAUCCCAGAGUUC | 454 |
| VCV000013045 | CCUAGGACCAUGAAGAGGUC | 455 |
| VCV000013045 | UAGGUGACUUCACCAGCACC | 456 |
| VCV000013045 | UCAUGGUCCUAGGUGACUUC | 457 |
| VCV000013045 | UGGUCCUAGGUGACUUCACC | 458 |
| VCV000013046 | GCUUCGGGAAGAACCAUGCC | 459 |
| VCV000013046 | CGAAGCGGAAGUUGCUCAUG | 460 |
| VCV000013046 | UCCCGAAGCGGAAGUUGCUC | 461 |
| VCV000013046 | GGAAGAACCAUGCCAUCAUG | 462 |
| VCV000013047 | UGCUGCGCUUCCCCAUCAAC | 463 |
| VCV000013047 | GCUGAUCGUGCUGCGCUUCC | 464 |
| VCV000013048 | UCCAAAUUGCAUCCUGUGGG | 465 |
| VCV000013049 | AUGACCCAGGUGAAGGCAAC | 466 |
| VCV000013049 | UGGAGCUGGCCUGCGCCGCA | 467 |
| VCV000013049 | CCUGGGUCAUGGAGCUGGCC | 468 |
| VCV000013050 | CUCGCCGGCUGGUCCAGGUA | 469 |
| VCV000013051 | UGAUCUGGGGUGCCCUACGCC | 470 |
| VCV000013051 | CUUUCCUGAUCUGGGUGCCC | 471 |
| VCV000013051 | UCGCUUUCCUGAUCUGGGUG | 472 |
| VCV000013051 | GGGUGCCCUACGCCAGCGUG | 473 |
| VCV000013052 | UAGGCCGGGGCCAGCUGGCU | 474 |
| VCV000013053 | UAGGCCUGGGCCACCUGGCU | 475 |
| VCV000013053 | UAGGCAGGUCUUAGGCCUGG | 476 |
| VCV000013054 | CCAGCAUCCUCUACACCUCU | 477 |
| VCV000013054 | UCUACACCUCUCUGCAUGGA | 478 |
| VCV000013055 | AAGGCGCUGCGUACCACACC | 479 |
| VCV000013056 | GGCUCGUCUCCGUCUUGGAC | 480 |
| VCV000013056 | UAGGCCGGGGCCAUCUGGCU | 481 |
| VCV000029875 | CCUAGGUCAUGGCGCUGGCC | 482 |
| VCV000143079 | ACUUCCUCACGCUCUAAGUC | 483 |
| VCV000143079 | CGCUCUAAGUCACCGUCCAG | 484 |
| VCV000143079 | AAGUCACCGUCCAGCACAAG | 485 |
| VCV000143079 | UGUGCUGGACGGUGACUUAG | 486 |
| VCV000143079 | UCACGCUCUAAGUCACCGUC | 487 |
| VCV000143080 | CCAGCUGGUCCAGGUAAUGG | 488 |
| VCV000143081 | AUUCUACACGAGCACUGCAG | 489 |
| VCV000143081 | UGUAGAAUCGACUACUACAC | 490 |
| VCV000143083 | UCACCCAGUUCUUGCCGCAG | 491 |
| VCV000143083 | GCUGCGGCAAGAACUGGGUG | 492 |
| VCV000143083 | CCCAGUUCUUGCCGCAGCAG | 493 |
| VCV000143083 | UCGUCACCCAGUUCUUGCCG | 494 |

TABLE 4B-continued

Targeting sequences directed to RHO mutants

| Clin Var Designation | Sequence | SEQ ID NO: |
|---|---|---|
| VCV000196282 | GGUACAUCCCCAAGGGCCUG | 495 |
| VCV000196282 | UCAGGUACAUCCCCAAGGGC | 496 |
| VCV000196282 | CCAAGGGCCUGCAGUGCUCG | 497 |
| VCV000279882 | AGCUUUACGUGGUGGUGUGU | 498 |
| VCV000279882 | UGGCCAUCGAGCUUUACGUG | 499 |
| VCV000373094 | UUGCCACCCUGGCGGUAUGA | 500 |
| VCV000373094 | UACCGCCAGGGUGGCAAAGA | 501 |
| VCV000381626 | UGGUCCCAGGUGGCUUCACC | 502 |
| VCV000381626 | UCAUGGUCCCAGGUGGCUUC | 503 |
| VCV000381626 | CAGGUGGCUUCACCAGCACC | 504 |
| VCV000417867 | CCUGGGUCAUGGUGCUGGCC | 505 |
| VCV000417867 | UGGUGCUGGCCUGCGCCGCA | 506 |
| VCV000419250 | GGAACGCAUGCUCACCACCA | 507 |
| VCV000419250 | AGUUCCGGAACGCAUGCUCA | 508 |
| VCV000437998 | GCCAGGUAGUACCGUGGGUA | 509 |
| VCV000437998 | AGUACCCACGGUACUACCUG | 510 |
| VCV000493373 | CGGCCAUCGAGCGGUACGUG | 511 |
| VCV000493373 | AUGGCCGGGACCACCAAGGA | 512 |
| VCV000493373 | UUGGUGGUCCCGGCCAUCGA | 513 |
| VCV000523376 | UUGCCAAGAGGGCCGCCAUC | 514 |
| VCV000590911 | ACACGAGCACUGCCAGGCCC | 515 |
| VCV000590911 | CCGAGGGCCUGGCAGUGCUC | 516 |
| VCV000625297 | AAUGCGACGGAUGUGGUACG | 517 |
| VCV000625297 | CCAAUGCGACGGAUGUGGUA | 518 |
| VCV000625297 | GUCGCAUUGGAGAAGGGCAC | 519 |
| VCV000625301 | ACACCUCUCUGCAUGUAUAC | 520 |
| VCV000625301 | CUGCAUGUAUACUUCGUCUU | 521 |
| VCV000625301 | GCAUGUAUACUUCGUCUUCG | 522 |
| VCV000625303 | GUGAUGUACCUGAGGACAGG | 523 |
| VCV000625303 | GGUACAUCACCGAGGGCCUG | 524 |
| VCV000625303 | UCAGGUACAUCACCGAGGGC | 525 |
| VCV000635082 | UGGCCAUCGAGCGGUAAGUG | 526 |
| VCV000635082 | AGCGGUAAGUGGUGGUGUGU | 527 |
| VCV000635416 | UCGGGCCCACAGGAGGCAAU | 528 |
| VCV000635416 | AAAUUGCCUCCUGUGGGCCC | 529 |
| VCV000635416 | UCUUCGGGCCCACAGGAGGC | 530 |
| VCV000635416 | GGCCCACAGGAGGCAAUUUG | 531 |
| VCV000636081 | UAGGCCGGGGCCAACUGGCU | 532 |
| VCV000636082 | AGCACAAGAAGCGGCGCACG | 533 |
| VCV000636083 | UGGUCCUACGUGGCUUCACC | 534 |
| VCV000636083 | UCAUGGUCCUACGUGGCUUC | 535 |
| VCV000636083 | UACGUGGCUUCACCAGCACC | 536 |
| VCV000636084 | GGCGUAGGGCACCCAGCAGA | 537 |
| VCV000636085 | ACAACCGUGUCAUCUAUAUC | 538 |
| VCV000636085 | UCAUGAUAUAGAUGACACGG | 539 |
| VCV000636085 | UGAUAUAGAUGACACGGUUG | 540 |
| VCV000636086 | AUAUCAUGAUGAACAAGUAG | 541 |
| VCV000636086 | UGAUGAACAAGUAGGUGCCU | 542 |
| VCV000802004 | AAGGCGACGGGUGUGGUACG | 543 |
| VCV000802004 | CCAAGGCGACGGGUGUGGUA | 544 |
| VCV000802004 | CCUUGGAGAAGGGCACGUAG | 545 |
| VCV000802004 | ACGUGCCCUUCUCCAAGGCG | 546 |
| VCV000802005 | UGCCCACAGGAUGCAAUUUG | 547 |
| VCV000802005 | UCUUCGUGCCCACAGGAUGC | 548 |
| VCV000802005 | UCGUGCCCACAGGAUGCAAU | 549 |
| VCV000802005 | UGUGGGCACGAAGACGAAGU | 550 |
| VCV000802006 | ACACCAGCACUGCAGGCCCU | 551 |
| VCV000802006 | AUUCCACACCAGCACUGCAG | 552 |
| VCV000802007 | AGCCUCUUGCCUUCCUGUUC | 553 |
| VCV000802007 | GGAACAGGAAGGCAAGAGGC | 554 |
| VCV000802007 | UGUUCCGGAACUGCAUGCUC | 555 |
| VCV000802007 | UGCCUUCCUGUUCCGGAACU | 556 |
| VCV000802008 | UAGGCCGGGGCCGCCUGGCU | 557 |
| VCV000810718 | CCCAGUGUUCUUGCCGCAGC | 558 |
| VCV000810718 | GCUGCGGCAAGAACACUGGG | 559 |
| VCV000810718 | UCGUCACCCAGUGUUCUUGC | 560 |
| VCV000810718 | UCACCCAGUGUUCUUGCCGC | 561 |
| VCV000811432 | UGUGAAAUCGACUACUACAC | 562 |
| VCV000811432 | AUUUCACACGAGCACUGCAG | 563 |
| VCV000811432 | CACGAGCACUGCAGGCCCUC | 564 |
| VCV000812395 | UGGCGCUGGUCUGCGCCGCA | 565 |
| VCV000812395 | GCGCCGCACCCCCACUCGCC | 566 |
| VCV000812396 | GGCUUGAGCGUGUAGUAGUC | 567 |

TABLE 4B-continued

Targeting sequences directed to RHO mutants

| Clin Var Designation | Sequence | SEQ ID NO: |
|---|---|---|
| VCV000812396 | CUGCAGUGCUCGUGUGGAAU | 568 |
| VCV000812396 | UUGUUGACCUCCGGCUUGAG | 569 |
| VCV000812396 | ACACGAGCACUGCAGUGAAG | 570 |
| VCV000812396 | ACUUCACUGCAGUGCUCGUG | 571 |
| VCV000812396 | ACUACUACACGCUCAAGCCG | 572 |
| VCV000812396 | UGGUCCACUUCACUGCAGUG | 573 |
| VCV000812396 | AGCCGGAGGUCAACAACGAG | 574 |
| VCV000812396 | UCUACAUGUUCGUGGUCCAC | 575 |
| VCV000812396 | ACAACGAGUCUUUUGUCAUC | 576 |
| VCV000812396 | ACAUGUUCGUGGUCCACUUC | 577 |
| VCV000812396 | UGUGGAAUCGACUACUACAC | 578 |
| VCV000812396 | UUUGUCAUCUACAUGUUCGU | 579 |
| VCV000812397 | UAUGGAAUCGACUACUACAC | 580 |
| VCV000812397 | AUUCCAUACGAGCACUGCAG | 581 |
| VCV000812397 | AUACGAGCACUGCAGGCCCU | 582 |

Additional targeting sequences to the RHO locus are set forth in Table 4C. Targeting sequences in Table 4C are specific to ATC, TTC, CTC and GTC PAM sites, as indicated in the Table.

TABLE 4C

Additional Rho targeting sequences

| PAM Sequence | Targeting Sequence SEQ ID NO |
|---|---|
| ATCN | 583-2100, 2286-5554 |
| TTCN | 370-371, 373-376, 19918-27274 |
| CTCN | 367-369, 372, 10487-19917 |
| GTCN | 5555-10486 |

In some embodiments, the disclosure provides methods of modifying a RHO target nucleic acid in a cell, the method comprising introducing into the cell a Class 2, Type V CRISPR system. In some embodiments, the disclosure provides methods of modifying a RHO target nucleic acid in a cell, the method comprising introducing into the cell: i) a CasX:gNA system comprising a CasX and a gNA of any one of the embodiments described herein; ii) a CasX:gNA system comprising a CasX, a gNA, and a donor template of any one of the embodiments described herein; iii) one or more nucleic acids encoding the CasX and the gNA, and optionally comprising the donor template; iv) a vector comprising the nucleic acid of (iii), above; v) a VLP comprising the CasX:gNA system of any one of the embodiments described herein; or vi) combinations of two or more of (i) to (v), wherein the target nucleic acid sequence of the cells is modified by the CasX protein and, optionally, the donor template. In some embodiments, the disclosure provides CasX:gNA systems for use in the methods of modifying the RHO gene in a cell, wherein the system comprises a CasX variant of SEQ ID NOs: 49-160, 237-239, 243-246, 251-263 or 273-281 as set forth in Tables 3, 6, 7, 8, or 10, or a variant sequence at least 60% identical, at least 70% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, or at least 99.5% identical thereto, the gNA scaffold comprises a sequence of SEQ ID NOS: 2101-2285 as set forth in Table 2 or a sequence at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 990% identical, at least 99.5% identical thereto, and the gNA comprises a targeting sequence selected from the group consisting of SEQ ID NOS: 328-346, 367-376, 382-2100 and 2286-27274 or a sequence at least 65% identical, at least 70% identical, at least 75% identical, at least 80% identical, at least 85% identical, at least 90% identical, or at least 95% identical thereto, and having between 15 and 30 amino acids. In some embodiments, the disclosure provides CasX: gNA systems for use in the methods of modifying the RHO gene in a cell, wherein the system comprises a CasX variant of SEQ ID NOs: 49-160, 237-239, 243-246, 251-263 or 273-281 as set forth in Tables 3, 6, 7, 8, or 10, or a variant sequence at least 60% identical, at least 70% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, or at least 99.5% identical thereto, the gNA scaffold comprises a sequence of SEQ ID NOS: 2101-2285 as set forth in Table 2 or a sequence at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical thereto, and the gNA comprises a targeting sequence selected from the group consisting of SEQ ID NOS: 382-582, or a sequence at least 65% identical, at least 70% identical, at least 75% identical, at least 80% identical, at least 85% identical, at least 90% identical, or at least 95% identical thereto, and having between 15 and 30 amino acids.

In those cases where the CasX is delivered to the cell in the protein form and the gNA is delivered in the RNA form, the CasX and gNA can be pre-complexed and delivered as an RNP. Upon hybridization with the target nucleic acid by the CasX and the gNA, the CasX introduces one or more single-strand breaks or double-strand breaks within or near the RHO gene that result in a modification of the target nucleic acid such as a permanent indel (deletion or insertion) or other mutation (a base change, inversion or rearrangement with respect to the genomic sequence) in the target nucleic acid, as described herein. In some embodiments of the method, the RHO target nucleic acid of at least 10% of the cells of the population is modified. In some cases of the foregoing, the modification results in a correction or compensation of the mutation occurs, thereby creating an edited cell such that expression of functional rhodopsin can occur. In other embodiments of the method, the modification comprises altering or suppressing expression of the rhodopsin protein comprising the mutation(s) by a knock-down or knock-out of the gene. In some embodiments, the mutation is a gain of function mutation. In other embodiments, the mutation is a loss of function mutation.

In other embodiments, the method comprises contacting the target nucleic acid sequence with a plurality of gNAs targeted to different or overlapping portions of the RHO gene wherein the CasX protein introduces multiple breaks in the target nucleic acid sequence that result in a permanent indel (deletion or insertion) or other mutation in the target nucleic acid, as described herein. In some cases for the foregoing, the method results in correction of the mutation, thereby creating an edited cell such that expression of wvild-type rhodopsin can occur. In other cases of the foregoing, the method results in the knock-down or knock-out the RHO gene such that the expression of the non-functional rhodopsin is reduced or eliminated. In some embodiments of the methods, the RNP are delivered to the in vitro cell directly by electroporation, injection, nucleofection, delivery via liposomes, delivery by nanoparticles, by encapsidation in a VLP (embodiments of which are described herein), or using a protein transduction domain (PTD) conjugated to one or more components of the CasX:gNA In some cases, the CasX:gNA system for use in the methods of modifying the RHO gene further comprises a donor template nucleic acid of any of the embodiments disclosed herein, wherein the donor template can be inserted by the homology-directed repair (HDR) or homology-independent targeted integration (HITI) repair mechanisms of the host cell. The donor template can be a short single-stranded or double-stranded oligonucleotide, or a long single-stranded or double-stranded oligonucleotide. The donor template may contain one or more single base changes, insertions, deletions, inversions or rearrangements with respect to the genomic sequence, provided that there is sufficient homology with the target nucleic acid sequence to support its integration into the target nucleic acid, which can result in a frame-shift or other mutation, or a replacement of the mutated sequence with wild-type sequence, with a corresponding correction of the mutation such that expression of wild-type or functional rhodopsin can occur. In some embodiments, the donor template sequence comprises a non-homologous sequence flanked by two regions of homology 5' and 3' to the break sites of the target nucleic acid (i.e., homologous arms), facilitating insertion of the non-homologous sequence at the target region which can be mediated by HDR or HITI. The exogenous donor template inserted by HITI can be any length, for example, a relatively short sequence of between 1 and 50 nucleotides in length, or a longer sequence of about 50-1000 nucleotides in length. The lack of homology can be, for example, having no more than 20-50% sequence identity and/or lacking in specific hybridization at low stringency. In other cases, the lack of homology can further include a criterion of having no more than 5, 6, 7, 8, or 9 bp identity. In such cases, the use of homologous arms facilitates the insertion of the non-homologous sequence at the break site(s) introduced by the nuclease. In some embodiments, the donor template polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000 nucleotides. In other embodiments, the donor template comprises at least about 10 to about 15,000 nucleotides, or at least about 100 to about 10,000 nucleotides, or at least about 400 to about 8,000 nucleotides, or at least about 600 to about 5000 nucleotides, or at least about 1000) to about 2000 nucleotides. The donor template sequence may comprise certain sequence differences as compared to the genomic sequence; e.g., restriction sites, nucleotide polymorphisms, selectable markers (e.g., drug resistance genes, fluorescent proteins, enzymes etc.), etc., which may be used to assess for successful insertion of the donor nucleic acid at the cleavage site or in some cases may be used for other purposes (e.g., to signify expression at the targeted genomic locus). Alternatively, these sequence differences may include flanking recombination sequences such as FLPs, loxP sequences, or the like, that can be activated at a later time for removal of the marker sequence.

In some embodiments, the method of the disclosure provides CasX protein and gNA pairs that generate site-specific double strand breaks (DSBs) or single strand breaks (SSBs) (e.g., when the CasX protein is a nickase that can cleave only one strand of a target nucleic acid) within double-stranded DNA (dsDNA) target nucleic acids, which can then be repaired either by non-homologous end joining (NHEJ), homology-directed repair (HDR), homology-independent targeted integration (HITI), micro-homology mediated end joining (MMEJ), single strand annealing (SSA) or base excision repair (BER). In some cases, contacting a RHO gene with a gene editing pair occurs under conditions that are permissive for non-homologous end joining or homology-directed repair. Thus, in some cases, the methods provided herein include contacting the RHO gene with a donor template by introducing the donor template (either in vitro outside of a cell, in vitro inside a cell, in vivo inside a cell, or ex vivo), wherein the donor template, a portion of the donor template, a copy of the donor template, or a portion of a copy of the donor template integrates into the RHO gene to replace a portion of the RHO gene such that either the gene is knocked-down/knocked-out, or corrective or compensating sequence is knocked-in such that a functional rhodopsin protein can be expressed.

In some embodiments of the method of modifying a RHO target nucleic acid of a cell in vitro or ex vivo, to induce cleavage or any desired modification to a target nucleic acid, the gNA and/or the CasX protein of the present disclosure and, optionally, the donor template sequence, whether they be introduced as nucleic acids or polypeptides, vectors or VLP, are provided to the cells for about 30 minutes to about 24 hours, or at least about 1 hour, 1.5 hours, 2 hours, 2.5 hours, 3 hours, 3.5 hours 4 hours, 5 hours, 6 hours, 7 hours, 8 hours, 12 hours, 16 hours, 18 hours, 20 hours, or any other period from about 30 minutes to about 24 hours, which may be repeated with a frequency of about every day to about every 4 days; e.g., every 1.5 days, every 2 days, every 3 days, or any other frequency from about every day to about every four days. The agent(s) may be provided to the subject cells one or more times: e.g., one time, twice, three times, or more than three times, and the cells allowed to incubate with the agent(s) for some amount of time following each contacting event; e.g., 30 minutes to about 24 hours. In the case of in vitro-based methods, after the incubation period with the CasX and gNA (and optionally the donor template), the media is replaced with fresh media and the cells are cultured further. In some embodiments of the method, the cells to be modified by the methods of the disclosure are eukaryotic, which can include rodent cells, mouse cells, rat cells, primate cells, non-human primate cells, and human cells. In some embodiments, the cells are selected from the group consisting of a rod photoreceptor cell, a retinal progenitor cell, a pluripotent stem cell (iPSC), fibroblasts, and Miller glial cells. In some embodiments, the cells are autologous with respect to the subject. In other embodiments, the cells are allogenic with respect to the subject. In some embodiments of the in vitro or ex vivo method, the RHO target nucleic acid of at least 10% of the cells of the population is modified.

In some embodiments of the method of modifying a RHO target nucleic acid in a cell, the method further comprises contacting the target nucleic acid sequence of the cell with: a) an additional CRISPR nuclease and a gNA targeting a different or overlapping portion of the RHO target nucleic acid compared to the first gNA; b) a polynucleotide encoding the additional CRISPR nuclease and the gNA of (a); c) a vector comprising the polynucleotide of (b); or d) a VLP comprising the additional CRISPR nuclease and the gNA of (a), wherein the contacting results in modification of the RHO target nucleic acid at a different location in the sequence compared to the first gNA. In some cases, the additional CRISPR nuclease is a CasX protein having a sequence different from the CasX protein of any of the preceding claims. In other cases, the additional CRISPR nuclease is not a CasX protein. In other cases, the additional CRISPR nuclease is selected from the group consisting of Cas9, Cas12a, Cas12b, Cas12c, Cas12d (CasY), Cas12J, Cas13a, Cas13b, Cas13c, Cas13d, CasX, CasY, Cas14, Cpf1, C2cl, Csn2, and sequence variants thereof.

In those cases where the modification results in a knock-down of the RHO gene, expression of the non-functional rhodopsin protein is reduced by at least about 10%, at least about 20%, at least about 30%, at least about 40%, at least about 50%, at least about 60%, at least about 70%, at least about 80%, or at least about 90% in comparison to cells that have not been modified. In other cases, wherein the modification results in a knock-out of the RHO gene, the target nucleic acid of the cells of the population is modified such that at least about 10%, at least about 20%, at least about 30%, at least about 40%, at least about 50%, at least about 60%, at least about 70%, at least about 80%, or at least about 90% of the cells do not express a detectable level of non-functional rhodopsin protein. Expression of rhodopsin protein can be measured by flow cytometry, ELISA, cell-based assays. Western blot or other methods know in the art or as described in the Examples.

In other embodiments of the method of modifying a target nucleic acid sequence, modifying the RHO gene comprises binding of a CasX to the target nucleic acid sequence without cleavage. In some embodiments, the CasX is a catalytically inactive CasX (dCasX) protein that retains the ability to bind to the gNA and to the RHO target nucleic acid sequence but lacks the ability to cleave the nucleic acid sequence, thereby interfering with transcription of the RHO allele. In some embodiments, the dCasX comprises a mutation at residues D672, E769, and/or D935 corresponding to the CasX protein of SEQ ID NO:1 or D659, E756 and/or D922 corresponding to the CasX protein of SEQ ID NO: 2. In some embodiments, the mutation is a substitution of alanine or glycine for the residue.

In some embodiments, the disclosure provides methods of modifying a RHO target nucleic acid in a population of cells in vivo in a subject. In some embodiments of the method, the modified cells of the population are eukaryotic, which can include rodent cells, mouse cells, rat cells, primate cells, non-human primate cells, and human cells. In some embodiments, the cells are selected from the group consisting of a rod photoreceptor cell or a retinal progenitor cell.

Introducing recombinant expression vectors comprising the components or the nucleic acids encoding the components of the system embodiments into a target cell can be carried out in vivo, in vitro or ex vivo. In some embodiments of the method, vectors may be provided directly to a target host cell. Methods of introducing a nucleic acid (e.g., a nucleic acid comprising a donor polynucleotide sequence, one or more nucleic acids (DNA or RNA) encoding a CasX protein and/or gNA, or a vector comprising same) into a cell are known in the art, and any convenient method can be used to introduce a nucleic acid (e.g., an expression construct) into a cell. Suitable methods include e.g., viral infection, transfection, lipofection, electroporation, calcium phosphate precipitation, polyethyleneimine (PEI)-mediated transfection, DEAE-dextran mediated transfection, liposome-mediated transfection, particle gun technology, nucleofection, electroporation, direct addition by cell penetrating CasX proteins that are fused to or recruit donor DNA, cell squeezing, calcium phosphate precipitation, direct microinjection, nanoparticle-mediated nucleic acid delivery, and the like. Nucleic acids may be introduced into the cells using well-developed commercially-available transfection techniques such as use of TransMessenger reagents from Qiagen, Stemfect RNA Transfection Kit from Stemgent, and TransIT-mRNA Transfection Kit from Mirus Bio LLC. Lonza nucleofection, Maxagen electroporation and the like. Introducing recombinant expression vectors comprising sequences encoding the CasX:gNA systems (and, optionally, the donor sequences) of the disclosure into cells under in vitro conditions can occur in any suitable culture media and under any suitable culture conditions that promote the survival of the cells. For example, cells may be contacted with vectors comprising the subject nucleic acids (e.g., recombinant expression vectors having the donor template sequence and nucleic acids encoding the CasX and gNA) such that the vectors are taken up by the cells. Vectors used for providing the nucleic acids encoding gNAs and/or CasX proteins to a target host cell can include suitable promoters for driving the expression, that is, transcriptional activation of the nucleic acid of interest. In some cases, the encoding nucleic acid of interest will be operably linked to a promoter. This may include ubiquitously acting promoters, for example, the CMV-beta-actin promoter, or inducible promoters, such as promoters that are active in particular cell populations or that respond to the presence of drugs such as tetracycline or kanamycin. By transcriptional activation, it is intended that transcription will be increased above basal levels in the target host cell comprising the vector by at least about 10-fold, by at least about 100-fold, more usually by at least about 1000-fold. In addition, vectors used for providing a nucleic acid encoding a gNA and/or a CasX protein to a cell may include nucleic acid sequences that encode for selectable markers in the target cells, so as to identify cells that have taken up the CasX protein and/or the gNA.

For viral vector delivery, cells can be contacted with viral particles comprising the subject viral expression vectors and the nucleic acids encoding the CasX and gNA and, optionally, the donor template. In some embodiments, the vector is an Adeno-Associated Viral (AAV) vector, wherein the AAV is selected from AAV1, AAV2, AAV3, AAV4, AAV5, AAV6, AAV7, AAV8, AAV9, AAV10, AAV11, AAV12, AAV 44.9. AAV-Rh74, AAVRh10, or a hybrid, a derivative or variant thereof. In other embodiments, the vector is a retroviral vector, described more fully, below. In other embodiments, the vector is a lentiviral vector. Retroviruses, for example, lentiviruses, may be suitable for use in methods of the present disclosure. Commonly used retroviral vectors are "defective": e.g., are unable to produce viral proteins required for productive infection. Rather, replication of the vector requires growth in a packaging cell line. To generate viral particles comprising nucleic acids of interest, the retroviral nucleic acids comprising the nucleic acid are packaged into viral capsids by a packaging cell line. Different packaging cell lines provide a different envelope protein (ecotropic, amphotropic or xenotropic) to be incorporated into the capsid, and this envelope protein determines the specificity or tropisms of the viral particle for the cells (ecotropic for murine and rat: amphotropic for most mammalian cell types including human, dog and mouse; and xenotropic for most mammalian cell types except murine cells). The appropriate packaging cell line may be used to ensure that the cells are targeted by the packaged viral particles. Methods of introducing subject vector expression vectors into packaging cell lines and of collecting the viral particles that are generated by the packaging lines are well known in the art, including U.S. Pat. No. 5,173,414; Tratschin et al., Mol. Cell. Biol. 5:3251-3260 (1985): Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989). Nucleic acids can also be introduced by direct microinjection (e.g., injection of RNA).

VI. Polynucleotides and Vectors

In another aspect, the present disclosure relates to polynucleotides encoding the Class 2, Type V nucleases and gNA that have utility in the editing of the RHO gene comprising one or more mutations. In some embodiments, the disclosure provides polynucleotides encoding the CasX proteins and the polynucleotides of the gNAs (e.g., the gDNAs and gRNAs) of any of the CasX:gNA system embodiments described herein. In some embodiments, the disclosure provides donor template polynucleotides for use with the CasX:gNA systems in modifying the target nucleic acid in the cells having a RHO gene comprising one or more mutations. In yet further embodiments, the disclosure provides vectors comprising polynucleotides encoding the CasX proteins and the gNAs described herein, as well as the donor templates of the embodiments.

In some embodiments, the disclosure provides polynucleotide sequences encoding the reference CasX of SEQ ID NOS: 1-3. In other embodiments, the disclosure provides polynucleotide sequences encoding the CasX variants of any of the embodiments described herein, including the CasX protein variants of SEQ ID NOS: 49-160, 237-239, 243-246, 251-263 or 273-281, or sequences having at least about 50%, at least about 60%, at least about 70%, at least about 80%, or at least about 90%, or at least about 95%, or at least about 96%, or at least about 97%, or at least about 98%, or at least about 99% sequence identity thereto.

In some embodiments, the polynucleotide encodes a gNA scaffold sequence set forth in Table 1 or Table 2, any one of SEQ ID NOS: 2101-2285, or a sequence having at least about 50%, at least about 60%, at least about 70%, at least about 80%, at least about 90%, at least about 95%, at least about 96%, at least about 97%, at least about 98%, at least about 99% sequence identity thereto. In other embodiments, the disclosure provides a targeting sequence polynucleotide selected from the group consisting of SEQ ID NOS: 328-346, 367-376, 382-2100 and 2286-27274, or a sequence having at least about 65%, at least about 75%, at least about 85%, or at least about 95% identity to a sequence selected from the group consisting of SEQ ID NOS: 328-346, 367-376, 382-2100 and 2286-27274. In other embodiments, the disclosure provides a targeting sequence polynucleotide selected from the group consisting of SEQ ID NOS: 382-582, or a sequence having at least about 65%, at least about 75%, at least about 85%, or at least about 95% identity to a sequence selected from the group consisting of SEQ ID NOS: 382-582. In some embodiments, the targeting sequence polynucleotide is, in turn, linked to the gNA scaffold sequence; either as a sgNA or a dgNA, at the 3' end of the scaffold sequence. In other embodiments, the disclosure provides gNAs comprising targeting sequence polynucleotides having one or more single nucleotide polymorphisms (SNP) relative to a sequence selected from the group consisting of SEQ ID NOS: 328-346, 367-376, 382-2100 and 2286-27274, or SEQ ID NOS: 382-582.

The present disclosure provides isolated polynucleotide sequences encoding gNA comprising a targeting sequence that is complementary to, and therefore hybridizes with the RHO gene. In some embodiments, the polynucleotide sequence encodes a gNA comprising a targeting sequence that hybridizes with a RHO exon: e.g., any one of exons 1 to 5. In a particular embodiment, the polynucleotide sequence encodes a gNA comprising a targeting sequence that hybridizes with exon 1 of the RHO gene. In other embodiments, the polynucleotide sequence encodes a gNA comprising a targeting sequence that hybridizes with a RHO intron. In other embodiments, the polynucleotide sequence encodes a gNA comprising a targeting sequence that hybridizes with a RHO intron-exon junction. In other embodiments, the polynucleotide sequence encodes a gNA comprising a targeting sequence that hybridizes with an intergenic region of the RHO gene. In other embodiments, the polynucleotide sequence encodes a gNA comprising a targeting sequence that hybridizes with a RHO regulatory element. In some cases, the RHO regulatory element is 5' of the RHO gene. In other cases, the RHO regulatory element is 3' of the RHO gene. In some cases, the RHO regulatory element is in an intron of the RHO gene. In other cases, the RHO regulatory element comprises the 5' UTR of the RHO gene. In still other cases, the RHO regulatory element comprises the 3'UTR of the RHO gene.

In other embodiments, the disclosure provides donor template nucleic acids, wherein the donor template comprises a nucleotide sequence having homology to a RHO target nucleic acid sequence. In some embodiments, the RHO donor template is intended for gene editing and comprises at least a portion of a RHO gene. In some embodiments, the RHO donor template comprises a sequence that hybridizes with the RHO gene. In other embodiments, the donor template sequence is not identical to the genomic sequence that it replaces and may contain one or more single base changes, insertions, deletions, inversions or rearrangements with respect to the genomic sequence. In some cases of the foregoing embodiment, as the donor template sequence comprises a sequence that is non-homologous relative to the target nucleic acid sequence, the donor template is flanked by two homologous arms such that homology-directed repair between the target DNA region and the two flanking arm sequences results in insertion of the donor template at the target region, resulting in the knock-in of the sequence, such that expression of functional rhodopsin can occur. In some embodiments, the RHO donor sequence comprises a sequence that encodes at least a portion of a RHO exon selected from the group consisting of RHO exons 1-5. In some embodiments, the RHO donor sequence comprises a sequence to correct a mutation of Table 4A. In a particular embodiment, the RHO donor sequence comprises a sequence to correct the P23H mutation. In other embodiments, the RHO donor sequence has a sequence that encodes at least a portion of a RHO intron. In other embodiments, the RHO donor sequence has a sequence that encodes at least a portion of with a RHO intron-exon junction. In other embodiments, the RHO donor sequence has a sequence that encodes at least a portion of an intergenic region of the RHO gene. In other embodiments, the RHO donor sequence has a sequence that encodes at least a portion of a RHO regulatory element. In some cases of the foregoing donor template embodiments, the sequence comprises one or more mutations relative to the wild-type RHO gene such that the gene is knocked-down or knocked out. In some embodiments, the donor polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000, or at least about 30.000 nucleotides. In other embodiments, the donor polynucleotide comprises at least about 10 to about 30,000 nucleotides, or at least about 100 to about 15,000 nucleotides, or at least about 400 to about 10,000 nucleotides, or at least about 600 to about 5000 nucleotides, or at least about 1000 to about 2000 nucleotides. In some embodiments, the donor template is a single stranded DNA template or a single stranded RNA template. In other embodiments, the donor template is a double stranded DNA template.

In some embodiments, the disclosure relates to methods to produce polynucleotide sequences encoding the reference CasX, the CasX variants, or the gNA of any of the embodiments described herein, including variants thereof, as well as methods to express the proteins expressed or RNA transcribed by the polynucleotide sequences. In general, the methods include producing a polynucleotide sequence coding for the reference CasX, the CasX variants, or the gNA of any of the embodiments described herein and incorporating the encoding gene into an expression vector appropriate for a host cell. For production of the encoded reference CasX, the CasX variants, or the gNA of any of the embodiments described herein, the method includes transforming an appropriate host cell with an expression vector comprising the encoding polynucleotide, and culturing the host cell under conditions causing or permitting the resulting reference CasX, the CasX variants, or the gNA of any of the embodiments described herein to be expressed or transcribed in the transformed host cell, thereby producing the reference CasX, the CasX variants, or the gNA, which is recovered by methods described herein or by standard purification methods known in the art, including the methods of the Examples. Standard recombinant techniques in molecular biology are used to make the polynucleotides and expression vectors of the present disclosure.

In accordance with the disclosure, polynucleotide sequences that encode the reference CasX, the CasX variants, or the gNA of any of the embodiments described herein are used to generate recombinant DNA molecules that direct the expression in appropriate host cells. Several cloning strategies are suitable for performing the present disclosure, many of which are used to generate a construct that comprises a gene coding for a composition of the present disclosure, or its complement. In some embodiments, the cloning strategy is used to create a gene that encodes a construct that comprises nucleotides encoding the reference CasX, the CasX variants, or the gNA that is used to transform a host cell for expression of the composition.

In one approach, a construct is first prepared containing the DNA sequence encoding a reference CasX, a CasX variant, or a gNA. Exemplary methods for the preparation of such constructs are described in the Examples. The construct is then used to create an expression vector suitable for transforming a host cell, such as a prokaryotic or eukaryotic host cell for the expression and recovery of the polypeptide construct. Where desired, the host cell is an *E. coli* cell. In other embodiments, the host cell is selected from Baby Hamster Kidney fibroblast (BHK) cells, human embryonic kidney 293 (HEK293), human embryonic kidney 293T (HEK293T), NS0 cells, SP2/0 cells, YO myeloma cells, P3X63 mouse myeloma cells, PER cells, PER.C6 cells, hybridoma cells, NIH3T3 cells, CV-1 (simian) in Origin with SV40 genetic material (COS), HeLa. Chinese hamster ovary (CHO), or yeast cells, or other eukaryotic cells known in the art suitable for the production of recombinant products. Exemplary methods for the creation of expression vectors, the transformation of host cells and the expression and recovery of reference CasX, the CasX variants, or the gNA are described in the Examples.

The gene or genes encoding for the reference CasX, the CasX variants, or the gNA constructs can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate sequences of polynucleotides encoding the various components (e.g., CasX and gNA) genes of a desired sequence. Genes encoding polypeptide compositions are assembled from oligonucleotides using standard techniques of gene synthesis.

In some embodiments, the nucleotide sequence encoding a CasX protein is codon optimized. This type of optimization can entail a mutation of an encoding nucleotide sequence to mimic the codon preferences of the intended host organism or cell while encoding the same CasX protein. Thus, the codons can be changed, but the encoded protein remains unchanged. For example, if the intended target cell of the CasX protein was a human cell, a human codon-optimized CasX-encoding nucleotide sequence could be used. As another non-limiting example, if the intended host cell were a mouse cell, then a mouse codon-optimized CasX-encoding nucleotide sequence could be generated. As another non-limiting example, if the intended host cell were a plant cell, then a plant codon-optimized CasX protein variant-encoding nucleotide sequence could be generated. As another non-limiting example, if the intended host cell were an insect cell, then an insect codon-optimized CasX protein-encoding nucleotide sequence could be generated. The gene design can be performed using algorithms that optimize codon usage and amino acid composition appropriate for the host cell utilized in the production of the reference CasX or the CasX variants. In one method of the disclosure, a library of polynucleotides encoding the components of the constructs is created and then assembled, as described above. The resulting genes are then assembled and the resulting genes used to transform a host cell and produce and recover the reference CasX, the CasX variants, or the gNA compositions for evaluation of its properties, as described herein.

In some embodiments, a nucleotide sequence encoding a gNA is operably linked to a control element; e.g., a transcriptional control element, such as a promoter. In some embodiments, a nucleotide sequence encoding a CasX protein is operably linked to a control element; e.g., a transcriptional control element, such as a promoter. In other cases, the nucleotide encoding the CasX and gNA are linked and are operably linked to a single control element. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells; e.g., neurons, spinal motor neurons, medium spiny neurons, cortical neurons, striatal neurons, oligodendrocytes, or glial cells.

Non-limiting examples of eukaryotic promoters (promoters functional in a eukaryotic cell) include EF1alpha, EF1alpha core promoter, those from cytomegalovirus (CMV) immediate early, herpes simplex virus (HSV) thymidine kinase, early and late SV40, long terminal repeats (LTRs) from retrovirus, and mouse metallothionein-I. Further non-limiting examples of eukaryotic promoters include the CMV promoter full-length promoter, the minimal CMV promoter, the chicken β-actin promoter, the hPGK promoter, the HSV TK promoter, the Mini-TK promoter, the human synapsin I promoter which confers neuron-specific expression, the Mecp2 promoter for selective expression in neurons, the minimal IL-2 promoter, the Rous sarcoma virus enhancer/promoter (single), the spleen focus-forming virus long terminal repeat (LTR) promoter, the SV40 promoter, the SV40 enhancer and early promoter, the TBG promoter; promoter from the human thyroxine-binding globulin gene (Liver specific), the PGK promoter, the human ubiquitin C promoter, the UCOE promoter (Promoter of HNRPA2B1-CBX3), the Histone H2 promoter, the Histone H3 promoter, the U1a1 small nuclear RNA promoter (226 nt), the U1b2 small nuclear RNA promoter (246 nt) 26, the TTR minimal enhancer/promoter, the b-kinesin promoter, the human elF4A1 promoter, the ROSA26 promoter and the glyceraldehyde 3-phosphate dehydrogenase (GAPDH) promoter.

Selection of the appropriate vector and promoter is well within the level of ordinary skill in the art, as it related to controlling expression, e.g., for modifying a protein involved in antigen processing, antigen presentation, antigen recognition, and/or antigen response and/or its regulatory element. The expression vector may also contain a ribosome binding site for translation initiation and a transcription terminator. The expression vector may also include appropriate sequences for amplifying expression. The expression vector may also include nucleotide sequences encoding protein tags (e.g., 6×His tag, hemagglutinin tag, FLAG tag, fluorescent protein, etc.) that can be fused to the CasX protein, thus resulting in a chimeric CasX protein that are used for purification or detection.

In some embodiments, a nucleotide sequence encoding each of a gNA variant or a CasX protein is operably linked to an inducible promoter, a constitutively active promoter, a spatially restricted promoter (i.e., transcriptional control element, enhancer, tissue specific promoter, cell type specific promoter, etc.), or a temporally restricted promoter. In other embodiments, individual nucleotide sequences encoding the gNA or the CasX are linked to one of the foregoing categories of promoters, which are then introduced into the cells to be modified by conventional methods, described below.

In certain embodiments, suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6), an enhanced U6 promoter, a human HI promoter (HI), a POL1 promoter, a 7SK promoter, tRNA promoters and the like.

In some embodiments, a nucleotide sequence encoding a CasX and gNA and, optionally, a donor template, is operably linked to (under the control of) an inducible promoter operable in a eukaryotic cell. Examples of inducible promoters may include, but are not limited to, T7 RNA polymerase promoter, T3 RNA polymerase promoter, isopropyl-beta-D-thiogalactopyranoside (IPTG)-regulated promoter, lactose induced promoter, heat shock promoter, tetracycline-regulated promoter, kanamycin-regulated promoter, steroid-regulated promoter, metal-regulated promoter, estrogen receptor-regulated promoter, etc. Inducible promoters can therefore, in some embodiments, be regulated by molecules including, but not limited to, doxycycline; estrogen and/or an estrogen analog; IPTG; etc. Additional examples of inducible promoters include, without limitation, chemically/biochemically-regulated and physically-regulated promoters such as alcohol-regulated promoters, kanamycin-regulated promoters, tetracycline-regulated promoters (e.g., anhydro-tetracycline (aTc)-responsive promoters and other tetracycline-responsive promoter systems, which include a tetracycline repressor protein (tetR), a tetracycline operator sequence (tetO) and a tetracycline transactivator fusion protein (tTA), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some cases, the promoter is a spatially restricted promoter (i.e., cell type specific promoter, tissue specific promoter, etc.) such that in a multi-cellular organism, the promoter is active (i.e., "ON") in a subset of specific cells. Spatially restricted promoters may also be referred to as enhancers, transcriptional control elements, control sequences, etc. Any convenient spatially restricted promoter may be used as long as the promoter is functional in the targeted host cell (e.g., eukaryotic cell; prokaryotic cell).

In some cases, the promoter is a reversible promoter. Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR, etc.), tetracycline regulated promoters, (e.g., promoter systems including Tet Activators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Recombinant expression vectors of the disclosure can also comprise elements that facilitate robust expression of CasX proteins and the gNAs of the disclosure. For example, recombinant expression vectors can include one or more of a polyadenylation signal (PolyA), an intronic sequence or a post-transcriptional regulatory element such as a woodchuck hepatitis post-transcriptional regulatory element (WPRE). Exemplary polyA sequences include hGH poly(A) signal (short), HSV TK poly(A) signal, synthetic polyadenylation signals, SV40 poly(A) signal. D-globin poly(A) signal and the like. A person of ordinary skill in the art will be able to select suitable elements to include in the recombinant expression vectors described herein.

The polynucleotides encoding the reference CasX, the CasX variants, and the gNA sequences can then be individually cloned into one or more expression vectors. In some embodiments, the present disclosure provides vectors comprising the polynucleotides selected from the group consisting of a retroviral vector, a lentiviral vector, an adenoviral vector, an adeno-associated viral (AAV) vector, a virus-like particle (VLP), a herpes simplex virus (HSV) vector, a plasmid, a minicircle, a nanoplasmid, a DNA vector, and an RNA vector. In some embodiments, the vector is a recombinant expression vector that comprises a nucleotide sequence encoding a CasX protein. In other embodiments, the disclosure provides a recombinant expression vector comprising a nucleotide sequence encoding a CasX protein and a nucleotide sequence encoding a gNA. In some cases, the nucleotide sequence encoding the CasX protein variant and/or the nucleotide sequence encoding the gNA are operably linked to a promoter that is operable in a cell type of choice. In other embodiments, the nucleotide sequence encoding the CasX protein variant and the nucleotide sequence encoding the gNA are provided in separate vectors operably linked to a promoter. In other embodiments, the vector can comprise a donor template or a polynucleotide encoding one or more CAR, engineered TCR, one or more engineered TCR subunits, or a separate vector can be utilized to introduce the donor template or the one or more CAR or engineered TCR subunits into the target cell to be modified.

In some embodiments, provided herein are one or more recombinant expression vectors comprising one or more of: (i) a nucleotide sequence of a donor template nucleic acid where the donor template comprises a nucleotide sequence having homology to a target sequence of a target nucleic acid (e.g., a target genome); (ii) a nucleotide sequence that encodes a gNA that hybridizes to a target sequence of the locus of the targeted genome (e.g., configured as a single or dual guide RNA) operably linked to a promoter that is operable in a target cell such as a eukaryotic cell; and (iii) a nucleotide sequence encoding a CasX protein operably linked to a promoter that is operable in a target cell such as a eukaryotic cell. In some embodiments, the sequences encoding the donor template, the gNA and the CasX protein are in different recombinant expression vectors, and in other embodiments one or more polynucleotide sequences (for the donor template, CasX, and the gNA) are in the same recombinant expression vector.

The polynucleotide sequence(s) are inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated. Once introduced into a suitable host cell, expression of the protein involved in antigen processing, antigen presentation, antigen recognition, and/or antigen response can be determined using any nucleic acid or protein assay known in the art. For example, the presence of transcribed mRNA of reference CasX or the CasX variants can be detected and/or quantified by conventional hybridization assays (e.g., Northern blot analysis), amplification procedures (e.g. RT-PCR), SAGE (U.S. Pat. No. 5,695,937), and array-based technologies (see e.g., U.S. Pat. Nos. 5,405, 783, 5,412,087 and 5,445,934), using probes complementary to any region of the polynucleotide.

The disclosure provides for the use of plasmid expression vectors containing replication and control sequences that are compatible with and recognized by the host cell and are operably linked to the gene encoding the polypeptide for controlled expression of the polypeptide or transcription of the RNA. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the polypeptide in a suitable host. The requirements are that the vectors are replicable and viable in the host cell of choice. Low- or high-copy number vectors may be used as desired. The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell.

The polynucleotides and recombinant expression vectors can be delivered to the target host cells by a variety of methods. Such methods include, but are not limited to, viral infection, transfection, lipofection, electroporation, calcium phosphate precipitation, polyethyleneimine (PEI)-mediated transfection, DEAE-dextran mediated transfection, microinjection, liposome-mediated transfection, particle gun technology, nucleofection, direct addition by cell penetrating CasX proteins that are fused to or recruit donor DNA, cell squeezing, calcium phosphate precipitation, direct microinjection, nanoparticle-mediated nucleic acid delivery, and using the commercially available TransMessenger® reagents from Qiagen, Stemfect™ RNA Transfection Kit from Stemgent, and TransIT®-mRNA Transfection Kit from Mirus Bio LLC, Lonza nucleofection, Maxagen electroporation and the like.

A recombinant expression vector sequence can be packaged into a virus or virus-like particle (also referred to herein as a "VLP" or "virion") for subsequent infection and transformation of a cell, ex vivo, in vitro or in vivo. Such VLP or virions will typically include proteins that encapsidate or package the vector genome. Suitable expression vectors may include viral expression vectors based on vaccinia virus; poliovirus; adenovirus; a retroviral vector (e.g., Murine Leukemia Virus), spleen necrosis virus, and vectors derived from retroviruses such as Rous Sarcoma Virus, Harvey Sarcoma Virus, avian leukosis virus, retrovirus, a lentivirus, human immunodeficiency virus, myeloproliferative sarcoma virus, and mammary tumor virus; and the like.

In some embodiments, a recombinant expression vector of the present disclosure is a recombinant adeno-associated virus (AAV) vector. In a particular embodiment, a recombinant expression vector of the present disclosure is a recombinant retrovirus vector. In another particular embodiment, a recombinant expression vector of the present disclosure is a recombinant lentivirus vector.

AAV is a small (20 nm), nonpathogenic virus that is useful in treating human diseases in situations that employ a viral vector for delivery to a cell such as a eukaryotic cell, either in vivo or ex vivo for cells to be prepared for administration to a subject. A construct is generated, for example, encoding any of the CasX proteins and gNA embodiments as described herein, and optionally a donor template, and can be flanked with AAV inverted terminal repeat (ITR) sequences, thereby enabling packaging of the AAV vector into an AAV viral particle.

An "AAV" vector may refer to the naturally occurring wild-type virus itself or derivatives thereof. The term covers all subtypes, serotypes and pseudotypes, and both naturally occurring and recombinant forms, except where required otherwise. As used herein, the term "serotype" refers to an AAV which is identified by and distinguished from other AAVs based on capsid protein reactivity with defined antisera, e.g., there are many known serotypes of primate AAVs. In some embodiments, the AAV vector is selected from AAV1, AAV2, AAV3, AAV4, AAV5. AAV6, AAV7, AAV8. AAV9, AAV 10, AAV 44.9. AAV-Rh74 (Rhesus macaque-derived AAV), and AAVRh10, and modified capsids of these serotypes. For example, serotype AAV-2 is used to refer to an AAV which contains capsid proteins encoded from the cap gene of AAV-2 and a genome containing 5' and 3' ITR sequences from the same AAV-2 serotype. Pseudotyped AAV refers to an AAV that contains capsid proteins from one serotype and a viral genome including 5'-3' ITRs of a second serotype. Pseudotyped rAAV would be expected to have cell surface binding properties of the capsid serotype and genetic properties consistent with the ITR serotype. Pseudotyped recombinant AAV (rAAV) are produced using standard techniques described in the art. As used herein, for example, rAAV1 may be used to refer an AAV having both capsid proteins and 5'-3' ITRs from the same serotype or it may refer to an AAV having capsid proteins from serotype 1 and 5'-3' ITRs from a different AAV serotype, e.g., AAV serotype 2. For each example illustrated herein the description of the vector design and production describes the serotype of the capsid and 5'-3' ITR sequences.

An "AAV virus" or "AAV viral particle" refers to a viral particle composed of at least one AAV capsid protein (preferably by all of the capsid proteins of a wild-type AAV) and an encapsidated polynucleotide. If the particle additionally comprises a heterologous polynucleotide (i.e., a polynucleotide other than a wild-type AAV genome to be delivered to a mammalian cell), it is typically referred to as "rAAV". An exemplary heterologous polynucleotide is a polynucleotide comprising a CasX protein and/or sgNA and, optionally, a donor template of any of the embodiments described herein.

By "adeno-associated virus inverted terminal repeats" or "AAV ITRs" is meant the art recognized regions found at each end of the AAV genome which function together in cis as origins of DNA replication and as packaging signals for the virus. AAV ITRs, together with the AAV rep coding region, provide for the efficient excision and rescue from, and integration of a nucleotide sequence interposed between two flanking ITRs into a mammalian cell genome.

The nucleotide sequences of AAV ITR regions are known. See, for example Kotin, R. M. (1994) Human Gene Therapy 5:793-801; Bems, K. I. "Parvoviridae and their Replication" in Fundamental Virology, 2nd Edition, (B. N. Fields and D. M. Knipe, eds.). As used herein, an AAV ITR need not have the wild-type nucleotide sequence depicted, but may be altered, e.g., by the insertion, deletion or substitution of nucleotides. Additionally, the AAV ITR may be derived from any of several AAV serotypes, including without limitation, AAV1, AAV2, AAV3, AAV4, AAV5, AAV6, AAV7, AAV8, AAV9, AAV10, AAV-Rh74, and AAVRh10, and modified capsids of these serotypes. Furthermore, 5' and 3' ITRs which flank a selected nucleotide sequence in an AAV vector need not necessarily be identical or derived from the same AAV serotype or isolate, so long as they function as intended, i.e., to allow for excision and rescue of the sequence of interest from a host cell genome or vector, and to allow integration of the heterologous sequence into the recipient cell genome when AAV Rep gene products are present in the cell. Use of AAV serotypes for integration of heterologous sequences into a host cell is known in the art (see, e.g., WO2018195555A1 and US20180258424A1, incorporated by reference herein.)

By "AAV rep coding region" is meant the region of the AAV genome which encodes the replication proteins Rep 78, Rep 68, Rep 52 and Rep 40. These Rep expression products have been shown to possess many functions, including recognition, binding and nicking of the AAV origin of DNA replication, DNA helicase activity and modulation of transcription from AAV (or other heterologous) promoters. The Rep expression products are collectively required for replicating the AAV genome.

By "AAV cap coding region" is meant the region of the AAV genome which encodes the capsid proteins VP1, VP2, and VP3, or functional homologues thereof. These Cap expression products supply the packaging functions which are collectively required for packaging the viral genome.

In some embodiments, AAV capsids utilized for delivery of the CasX, gNA, and, optionally, donor template nucleotides, to a host cell can be derived from any of several AAV serotypes, including without limitation, AAV1, AAV2. AAV3, AAV4, AAV5. AAV6, AAV7, AAV8, AAV9, AAV10, AAV11, AAV12, AAV 44.9, AAV-Rh74 (Rhesus macaque-derived AAV), and AAVRh10, and the AAV ITRs are derived from AAV serotype 1 or serotype 2. In some embodiments, the AAV vector and the regulatory sequences are selected so that the total size of the vector is below 5 kb, permitting packaging within the AAV capsid. While the AAV vector may be of any AAV serotype, nervous cell tropism varies among AAV capsid serotypes. Thus, use of AAV serotypes compatible with widespread transgene delivery to astrocytes and motoneurons is preferred. In some embodiments, the AAV vector is of serotype 9 or of serotype 6, which have been demonstrated to effectively deliver polynucleotides to motor neurons and glia throughout the spinal cord in preclinical models of ALS (Foust, K D. et al. Therapeutic AAV9-mediated suppression of mutant RHO slows disease progression and extends survival in models of inherited ALS. Mol Ther. 21(12):2148 (2013)). In some embodiments, the methods provide use of AAV9 or AAV6 for targeting of neurons via intraparenchymal brain injection. In some embodiments, the methods provide use of AAV9 for intravenous administering of the vector wherein the AAV9 has the ability to penetrate the blood-brain barrier and drive gene expression in the nervous system via both neuronal and glial tropism of the vector. In order to produce rAAV viral particles, an AAV expression vector is introduced into a suitable host cell using known techniques, such as by transfection. Packaging cells are typically used to form virus particles; such cells include HEK293 or HEK293T cells (and other cells described herein or known in the art), which package adenovirus. A number of transfection techniques are generally known in the art; see, e.g., Sambrook et al. (1989) Molecular Cloning, a laboratory manual, Cold Spring Harbor Laboratories, New York. Particularly suitable transfection methods include calcium phosphate co-precipitation, direct microinjection into cultured cells, electroporation, liposome mediated gene transfer, lipid-mediated transduction, and nucleic acid delivery using high-velocity microprojectiles.

In some embodiments, host cells transfected with the above-described AAV expression vectors are rendered capable of providing AAV helper functions in order to replicate and encapsidate the nucleotide sequences flanked by the AAV ITRs to produce rAAV viral particles. AAV helper functions are generally AAV-derived coding sequences which can be expressed to provide AAV gene products that, in turn, function in trans for productive AAV replication. AAV helper functions are used herein to complement necessary AAV functions that are missing from the AAV expression vectors. Thus, AAV helper functions include one, or both of the major AAV ORFs (open reading frames), encoding the rep and cap coding regions, or functional homologues thereof. Accessory functions can be introduced into and then expressed in host cells using methods known to those of skill in the art. Commonly, accessory functions are provided by infection of the host cells with an unrelated helper virus. In some embodiments, accessory functions are provided using an accessory function vector. Depending on the host/vector system utilized, any of a number of suitable transcription and translation control elements, including constitutive and inducible promoters, transcription enhancer elements, transcription terminators, etc., may be used in the expression vector.

In other embodiments, suitable vectors may include virus-like particles (VLP). Virus-like particles (VLPs) are particles that closely resemble viruses, but do not contain viral genetic material and are therefore non-infectious. In some embodiments, VLPs comprise a polynucleotide encoding a transgene of interest, for example any of the CasX protein and/or a gNA embodiments, and, optionally, donor template polynucleotides described herein, packaged with one or more viral structural proteins.

In other embodiments, the disclosure provides VLPs produced in vitro that comprise a CasX:gNA RNP complex and, optionally, a donor template. Combinations of structural proteins from different viruses can be used to create VLPs, including components from virus families including Parvoviridae (e.g., adeno-associated virus), Retroviridae (e.g., HIV and Alpharetrovirus), Flaviviridae (e.g., Hepatitis C virus), Paramyxoviridae (e.g., Nipah) and bacteriophages (e.g., Qβ, AP205). In some embodiments, the disclosure provides VLP systems designed using components of retrovirus, including lentiviruses such as HIV and Alpharetrovirus, in which individual plasmids comprising polynucleotides encoding the various components are introduced into a packaging cell that, in turn, produce the VLP. In some embodiments, the disclosure provides VLP comprising one or more components of i) protease, ii) a protease cleavage site, iii) one or more components of a gag poly protein selected from matrix protein (MA), nucleocapsid protein (NC), capsid protein (CA), or p1-p6 protein, v) CasX; vi) gNA, and vi) targeting glycoproteins or antibody fragments wherein the resulting VLP particle encapsidates a CasX:gNA RNP. The targeting glycoproteins or antibody fragments on the surface that provides tropism of the VLP to the target cell, wherein upon administration and entry into the target cell, the RNP molecule is free to be transported into the nucleus of the cell. In other embodiments, the disclosure provides VLP of the foregoing and further comprises one or more components of a pol polyprotein (e.g. a protease), and, optionally, a second CasX or a donor template. The foregoing offers advantages over other vectors in the art in that viral transduction to dividing and non-dividing cells is efficient and that the VLP delivers potent and short-lived RNP that escape a subject's immune surveillance mechanisms that would otherwise detect a foreign protein. In some embodiments, a system to make VLP in a host cell comprises polynucleotides encoding one or more components selected from i) one or more components of a gag polyprotein; ii) a CasX protein of any of the embodiments described herein: iii) a protease cleavage site; iv) a protease: v) a guide RNA of any of the embodiments described herein; vi) a pol polyprotein or portions thereof (e.g., a protease): vii) a pseudotyping glycoprotein or antibody fragment that provides for binding and fusion of the VLP to a target cell; and viii) a donor template. The disclosure contemplates multiple configurations of the arrangement of the encoded components, including duplicates of some of the encoded components. The envelope glycoprotein can be derived from any enveloped viruses known in the art to confer tropism to VLP, including but not limited to the group consisting of Argentine hemorrhagic fever virus, Australian bat virus, *Autographa californica* multiple nucleopolyhedrovirus, Avian leukosis virus, baboon endogenous virus, Bolivian hemorrhagic fever virus, Boma disease virus, Breda virus, Bunyamwera virus, Chandipura virus, Chikungunya virus, Crimean-Congo hemorrhagic fever virus, Dengue fever virus, Duvenhage virus, Eastern equine encephalitis virus, Ebola hemorrhagic fever virus. Ebola Zaire virus, enteric adenovirus, Ephemerovirus, Epstein-Bar virus (EBV), European bat virus 1. European bat virus 2, Fug Synthetic gP Fusion, Gibbon ape leukemia virus, Hantavirus, Hendra virus, hepatitis A virus, hepatitis B virus, hepatitis C virus, hepatitis D virus, hepatitis E virus, hepatitis G Virus (GB virus C), herpes simplex virus type 1, herpes simplex virus type 2, human cytomegalovirus (HHV5), human foamy virus, human herpesvirus (HHV), human Herpesvirus 7, human herpesvirus type 6, human herpesvirus type 8, human immunodeficiency virus 1 (HIV-1), human metapneumovirus, human T-lymphotropic virus 1, influenza A, influenza B, influenza C virus, Japanese encephalitis virus, Kaposi's sarcoma-associated herpesvirus (HHV8), Kaysanur Forest disease virus, La Crosse virus, Lagos bat virus, Lassa fever virus, lymphocytic choriomeningitis virus (LCMV), Machupo virus, Marburg hemorrhagic fever virus, measles virus, Middle eastern respiratory syndrome-related coronavirus, Mokola virus, Moloney murine leukemia virus, monkey pox, mouse mammary tumor virus, mumps virus, murine gammaherpesvirus, Newcastle disease virus, Nipah virus, Nipah virus, Norwalk virus, Omsk hemorrhagic fever virus, papilloma virus, parvovirus, pseudorabies virus, Quaranfil virus, rabies virus, RD114 Endogenous Feline Retrovirus, respiratory syncytial virus (RSV), Rift Valley fever virus, Ross River virus, rRotavirus. Rous sarcoma virus, rubella virus, Sabia-associated hemorrhagic fever virus, SARS-associated coronavirus (SARS-CoV), Sendai virus, Tacaribe virus, Thogotovirus, tick-borne encephalitis causing virus, varicella zoster virus (HHV3), varicella zoster virus (HHV3), variola major virus, variola minor virus, Venezuelan equine encephalitis virus, Venezuelan hemorrhagic fever virus, vesicular stomatitis virus (VSV), VSV-G, Vesiculovirus, West Nile virus, western equine encephalitis virus, and Zika Virus. In some embodiments, the packaging cell used for the production of VLP is selected from the group consisting of HEK293 cells, Lenti-X HEK293T cells, BHK cells, HepG2 cells, Saos-2 cells, HuH7 cells, NS0 cells, SP2/0 cells, YO myeloma cells, A549 cells, P3X63 mouse myeloma cells, PER cells, PER.C6 cells, hybridoma cells, VERO cells, NIH3T3 cells, COS cells, W138 cells, MRC5 cells, A549 cells, HeLa cells, CHO cells, or HT1080 cells.

VII. Cells

In another aspect, the present disclosure relates to a population of cells having one or more mutations in the RHO gene that has been modified by the systems and methods disclosed herein.

In some embodiments, the present disclosure provides populations of cells that have been modified to correct or compensate for the one or more mutations in the RHO gene such that wild-type rhodopsin (SEQ ID NO:33) or a functional rhodopsin protein is expressed. Cells that have been genetically modified in this way may be administered to a subject for purposes such as gene therapy; e.g., to treat a disease associated with a defect in the RHO gene. Non-limiting examples of mutations of rhodopsin contemplated for modification in populations of cells using the systems of the disclosure are presented in Table 4A. For example, patient-specific autologous induced pluripotent stem cells (iPSC), fibroblasts, or Müller glial cells can be isolated from the subject and then the target nucleic acid bearing the mutation of these iPSC cells can be edited using the CasX:gNA systems by the methods described herein. For example, the method can comprise editing within or near a P23H mutation in a RHO gene of the iPSC, then the genome-edited cells can be differentiated into cells such as photoreceptor cells or retinal progenitor cells and propagated into a population of cells that can be administered into the subject. The differentiating step may be performed according to any method known in the art. For example, iPSCs can be used to generate retinal organioids and photoreceptors as described in the art (Phillips et al., Stem Cells, June 2014, 32(6): pgs. 1480-1492: Zhong et al. Nat. Commun., 2014, 5: pg 4047; Tucker et al., PLoS One, April 2011, 6(4): e18992). In some embodiments of the foregoing, the administration is via an intraocular, intravitreal, subretinal, or suprachoroidal injection or implantation.

In some embodiments, the population of cells are modified by a Class 2, Type V Cas nuclease and one or more guides targeted to the one or more mutations of the RHO gene. In some embodiments, the disclosure provides methods and populations of cells modified by introducing into the cells of the population: i) a CasX:gNA system comprising a CasX and a gNA of any one of the embodiments described herein; ii) a CasX:gNA system comprising a CasX, a gNA, and a donor template of any one of the embodiments described herein: iii) one or more nucleic acids encoding the CasX and the gNA, and optionally comprising the donor template; iv) a vector selected from the group consisting of a retroviral vector, a lentiviral vector, an adenoviral vector, an adeno-associated viral (AAV) vector, and a herpes simplex virus (HSV) vector and comprising the nucleic acid of (iii), above: v) a VLP comprising the CasX:gNA system of any one of the embodiments described herein; or vi) combinations of two or more of (i) to (v), wherein the RHO target nucleic acid sequence of the cells targeted by the gNA is modified by the CasX protein and, optionally, the donor template.

In some embodiments, the gNA of the CasX:gNA system is targeted to a mutation in the RHO gene, including, but not limited to the mutations of Table 4A, wherein the NHEJ repair mechanisms of the cell can correct or compensate for the mutation in the cells of the population such that a functional rhodopsin protein can be expressed. In another embodiment, two or more gNA are used in the CasX:gNA system to modify the cells of the population wherein the gNA are targeted to different or overlapping portion of the RHO gene target nucleic acid. In one embodiment of the foregoing, the two or more gNA are targeted to sequences that flank (5' and 3' to) a portion or the entirety of the mutation. In a particular embodiment, the mutation in the cells of the population to be modified is the P23H mutation. In some cases of the foregoing, the NHEJ repair mechanisms of the cell can correct or compensate for the mutation. In some embodiments, the disclosure provides a population of cells wherein the cells have been modified such that at least 60%, at least 70%, at least 75%, at least 80%, at least 85%, at least 90%, or at least 95% of the modified cells express a detectable level of functional rhodopsin protein. In other embodiments, the disclosure provides a population of cells wherein the cells have been modified by the systems and methods of any of the embodiments described herein such that the expression of rhodopsin protein is increased by at least about 10%, at least about 20%, at least about 30%, at least about 40%, at least about 50%, at least about 60%, at least about 70%, at least about 80%, or at least about 90% in comparison to a cell where the RHO gene has not been modified. Expression of the rhodopsin protein can be determined by ELISA, Western blot, electrochemiluminescence assays or other methods know in the art, or as described in the Examples.

In some embodiments, the disclosure provides a method of preparing cells for treatment of a subject having retinitis pigmentosa comprising modifying cells having one or more mutations in the RHO gene by editing the target nucleic acid with a CasX:gNA system or by introducing into the cells a polynucleotide or vector encoding the CasX:gNA system of any of the embodiments described herein, wherein the modification results in the cells ability to produce a wild-type or a functional rhodopsin protein. In some embodiments, the cell has been modified such that expression of functional rhodopsin is increased by at least about 10%, at least about 20%, at least about 30%, at least about 40%, at least about 50%, at least about 60%, at least about 70%, at least about 80%, or at least about 90% in comparison to a cell where the RHO gene has not been modified. In other embodiments of the method, the cells have been modified such that at least about 50%, at least about 60%, at least about 70%, at least about 75%, at least about 80%, at least about 85%, at least about 90%, or at least about 95% of the modified cells express a detectable level of functional rhodopsin. Such modified cells altered in this manner are useful for therapy applications, for example for ex vivo preparation of cells for use in a subject having retinitis pigmentosa. In other embodiments, the disclosure provides compositions of cells modified to express functional rhodopsin for use as a medicament in the treatment of retinitis pigmentosa.

In some cases of the method, the cells of the population are contacted with a CasX and a gNA wherein the gNA is a guide RNA (gRNA). In other cases, the cells of the population are contacted with a CasX and a gNA wherein the gNA is a guide DNA (gDNA). In other cases, the cells of the populations are contacted with a CasX and a gNA wherein the gNA is a chimera comprising DNA and RNA. As described herein, in embodiments of any of the combinations, each of said gNA molecules (a combination of the scaffold and targeting sequence, w % bich can be configured as a sgRNA or a dgRNA) can be provided as an RNP complexed with a CasX molecule described herein, such that the RNP can then modify the target gene. In some embodiments, the cells of the population are contacted with an RNP of a CasX comprising a sequence of SEQ ID NOs: 49-160, 237-239, 243-246, 251-263 or 273-281, or a sequence at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, or at least 99.5% identical thereto, the gNA scaffold comprises a sequence of SEQ ID NOS: 2101-2285 or a sequence at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least $^{990}$% identical, at least 99.5% identical thereto, and the gNA comprises a targeting sequence of SEQ ID NOs: 328-346, 367-376, 382-2100 and 2286-27274, or SEQ ID NOS: 382-582 or a sequence at least 65% identical, at least 70% identical, at least 75% identical, at least 80% identical, at least 85% identical, at least 90% identical, or at least 95% identical thereto and having between 15 and 30 amino acids. Upon hybridization with the target nucleic acid by the CasX and the gNA, the CasX introduces one or more single-strand breaks or double-strand breaks within the RHO gene that results in a modification of the target nucleic acid such as a permanent indel (deletion or insertion) or a mutation (e.g., substitution, duplication, or inversion) in the target nucleic acid that, in connection with the repair mechanisms of the host cell, results in a correction or a compensation of the mutation with a corresponding expression of functional rhodopsin protein, thereby creating the modified population of cells.

In some embodiments of the method, the target nucleic acid of the cells of the population is modified using a plurality of gNAs (e.g., two, three, four or more) targeted to different or overlapping portions of the RHO gene wherein the CasX protein introduces multiple breaks in the target nucleic acid sequence that result in a permanent indel (deletion or insertion) or corrective mutation (e.g., a substitution, duplication, or inversion of one or more nucleotides), or is used in conjunction with a donor template, as described, supra.

An RNP can be introduced into the cells to be modified via any suitable method, including via electroporation, injection, nucleofection, delivery via liposomes, delivery by nanoparticles, or using a protein transduction domain (PTD) conjugated to one or more components of the CasX:gNA. In other cases, the CasX and the one or more gNA are introduced into the population of cells as encoding polynucleotides using a vector; embodiments of which are described herein. Additional methods of modification of the cells using the CasX:gNA system components include viral infection, transfection, conjugation, protoplast fusion, particle gun technology, calcium phosphate precipitation, direct microinjection, and the like. The choice of method is generally dependent on the type of cell being transformed and the circumstances under which the transformation is taking place; e.g., in vitro, ex vivo, or in vivo. A general discussion of these methods can be found in Ausubel, et al, Short Protocols in Molecular Biology, 3rd ed., Wiley & Sons, 1995.

In some embodiments of the method of modify the population of cells, the method further comprises contacting the RHO gene target nucleic acid sequence of the population of cells with: i) an additional CRISPR nuclease and a gNA targeting a different or overlapping portion of the RHO target nucleic acid compared to the first gNA; ii) a polynucleotide encoding the additional CRISPR nuclease and the gNA of (i); iii) a vector selected from the group consisting of a retroviral vector, a lentiviral vector, an adenoviral vector, an adeno-associated viral (AAV) vector, a herpes simplex virus (HSV) vector and comprising the polynucleotide of (ii): or iv) a VLP comprising the additional CRISPR nuclease and the gNA of (i), wherein the contacting results in modification of the RHO gene at a different location in the sequence compared to the sequence targeted by the first gNA. In one embodiment of the foregoing, the additional CRISPR nuclease is a CasX protein having a sequence different from the CasX protein of the previous embodiments. In another embodiment of the foregoing, the additional CRISPR nuclease is not a CasX protein and is selected from the group consisting of Cas9, Cas12a. Cas12b, Cas12c. Cas12d (CasY), Cas12J. Cas13a, Cas13b, Cas13c. Cas13d, CasX, CasY, Cas14, Cpf1, C2cl, Csn2, and sequence variants thereof.

In some embodiments, the population of modified cells are animal cells, for example, derived from a rodent, rat, mouse, rabbit or dog cell. In some embodiments, the cell is a human cell. In some embodiments, the cell is a non-human primate cell; e.g., a cynomolgus monkey cell. In some embodiments, the cells are selected from the group consisting of a rod photoreceptor cell, a retinal progenitor cell, a pluripotent stem cell (iPSC), a fibroblast, and Miller glial cells.

In some embodiments of the method, the modifying of the RHO gene target nucleic acid sequence of the population of cells occurs in vitro or ex vivo. The method provides that the cells can be obtained from a unit of blood or a biopsy collected from a subject using any number of techniques known to the skilled artisan. The cells collected may be washed and filtered or centrifuged to remove the desired cells from other cells or tissue and, optionally, to place the cells in an appropriate buffer or media for subsequent processing steps. The method may include one or more steps of i) introducing into the cells the CasX:gNA system components for the editing of the target nucleic acids: ii) introducing into the cells one or more nucleic acids encoding the CasX:gNA system components to the cells: iii) expansion of the cells, and iv) cryopreservation of the cells for subsequent administration to the subject.

VIII. Therapeutic Methods

In another aspect, the present disclosure relates to methods of treating a subject having a disease associated with mutations in the RHO gene, such as retinitis pigmentosa. In some cases, the allele related to the disease associated with mutations in the RHO gene (RHO-related disease) of the subject to be modified comprises one or more mutations, including, but not limited to the mutations presented in Table 4A. A number of therapeutic strategies have been used to design the compositions for use in the methods of treatment of a subject with a RHO-related disease. Additionally, the methods can be used to treat a subject in advance of any symptom of retinitis pigmentosa, e.g., prior to the development of loss of or changes in vision, visual acuity, nyctalopia, color vision, peripheral vision, loss of the mid-peripheral visual field, photophobia, contrast sensitivity, gaze tracking, light aversion, macular sensitivity, and depth perception. Accordingly, the prophylactic administration of a modified cell population or a therapeutically effective amount of the CasX:gNA system composition(s) or the polynucleic acids encoding the CasX:gNA systems of the embodiments can serve to prevent or reduce the progression of a RHO-related disease.

As described herein, the methods of treatment can prevent, treat and/or ameliorate a RHO-related disease of a subject. In some embodiments, the disclosure provides a method of treating a RHO-related disease in a subject in need thereof, comprising modifying a RHO gene having one or more mutations in eye cells of the subject. In some embodiments, the modifying comprises contacting said cells of one or both eyes of the subject with a therapeutically effective dose of i) a CasX:gNA system comprising a CasX and a gNA of any one of the embodiments described herein; ii) a CasX:gNA system comprising a CasX, a gNA, and a donor template of any one of the embodiments described herein; iii) one or more nucleic acids encoding the CasX and the gNA, and optionally comprising the donor template, iv) a vector selected from the group consisting of a retroviral vector, a lentiviral vector, an adenoviral vector, an adeno-associated viral (AAV) vector, and a herpes simplex virus (HSV) vector and comprising the nucleic acid of (iii), above; v) a VLP comprising the CasX:gNA system of any one of the embodiments described herein; or vi) combinations of two or more of (i) to (v), wherein the RHO target nucleic acid sequence of the cells targeted by the gNA is modified by the CasX protein and, optionally, the donor template. In some embodiments of the method, a second gNA is utilized, wherein the second gNA has a targeting sequence complementary to a different or overlapping portion of the target nucleic acid compared to the first gNA, resulting in an additional break in the RHO target nucleic acid of the cells of the subject. In some embodiments of the foregoing, the gene can be modified by the NHEJ host repair mechanisms, or the CasX:gNA system is utilized in conjunction with a donor template that is inserted by HDR or HITI mechanisms, wherein at least about 10%, at least about 20%, at least about 30%, at least about 40%, at least about 50%, at least about 60%, at least about 70%, at least about 80%, or at least about 90% of the targeted cells are modified. In some embodiments, the modification corrects or compensates for the mutation, resulting in the expression of a functional rhodopsin in the subject. In some cases, expression of a wild-type or functional rhodopsin protein is increased in the eye of a subject by at least about 10%, at least about 20%, at least about 30%, at least about 40%, at least about 50%, at least about 60%, at least about 70%, at least about 80%, or at least about 90% in comparison to a subject wherein the RHO gene of the cells has not been modified. In other embodiments of the foregoing, the gene can be modified by the NHEJ host repair mechanisms, or utilized in conjunction with a donor template that is inserted by HDR or HITI mechanisms to knock-down or knock-out the RHO gene, resulting in the reduction or elimination of the expression of the mutant rhodopsin in the cells of the subject. In some cases, expression of the mutant rhodopsin protein is decreased in the cells of the subject by at least about 10%, at least about 20%, at least about 30%, at least about 40%, at least about 50%, at least about 60%, at least about 70%, at least about 80%, or at least about 90% in comparison to cells of a subject wherein the RHO gene has not been modified. The embodiments of the paragraph are more fully detailed, below, while the methods employed in the modification of the RHO gene have been described, supra. In some embodiments of the method of treatment, the subject is selected from the group consisting of a rodent, a mouse, a rat, and a non-human primate. In other embodiments of the method of treatment, the subject is a human. In some embodiments, the eye cells of the subject to be modified are selected from the group consisting of a neuron, a rod photoreceptor cell, a retinal progenitor cell, a pluripotent stem cell (iPSC), a fibroblast, and Miller glial cell.

In some embodiments of the method of treatment, the method comprises administering to one or both eyes of the subject a therapeutically effective dose of a vector comprising or encoding the CasX protein and the gNA and, optionally, the donor template (described, supra), wherein the contacting of the cells of the subject with the vector results in modification of the target nucleic acid of the cells by the components of the CasX:gNA system. In some embodiments, the method comprises administration of the vector comprising or encoding a CasX and a plurality of gNAs targeted to different locations in the RHO gene, wherein the contacting of the cells of the subject with the CasX:gNA RNP complexes results in modification of the target nucleic acid of the cells. In one particular embodiment, the vector is an AAV. The AAV utilized can be selected from the group consisting of AAV1, AAV2, AAV3, AAV4, AAV5, AAV6, AAV7, AAV8, AAV9, AAV10, AAV11, AAV12, AAV 44.9, AAV-Rh74, and AAVRh10, or mutated variants thereof. The vector of the embodiments are administered to the subject at a therapeutically effective dose. In some embodiments, the vector is administered to the subject at a dose of at least about $1 \times 10^5$ vector genomes (vg), at least about $1 \times 10^6$ vg, at least about $1 \times 10^7$ vg, at least about $1 \times 10^8$ vg, at least about $1 \times 10^9$ vg, at least about $1 \times 10^{10}$ vg, at least about $1 \times 10^{11}$ vg, at least about $1 \times 10^{12}$ vg, at least about $1 \times 10^{13}$ vg, at least about $1 \times 10^{14}$ vg, at least about $1 \times 10^{15}$ vg, at least about $1 \times 10^{16}$ vg. In other embodiments, the vector is administered to the subject at a dose of at least about $1 \times 10^5$ vg to about $1 \times 10^{16}$ vg, or at least about $1 \times 10^6$ vg to about $1 \times 10^{15}$ vg, or at least about $1 \times 10^7$ vg to about $1 \times 10^{14}$ vg, or at least about $1 \times 10^8$ vg to about $1 \times 10^{13}$ vg, or at least about $1 \times 10^9$ vg to about $1 \times 10^{12}$ vg, or at least about $1 \times 10^{10}$ vg to about $1 \times 10^{11}$ vg. In some embodiments, the vector is administered to the subject at a dose of at least about $1 \times 10^5$ vector genomes (vg)/kg, at least about $1 \times 10^6$ vg/kg, at least about $1 \times 10^7$ vg/kg, at least about $1 \times 10^8$ vg/kg, at least about $1 \times 10^9$ vg/kg, at least about $1 \times 10^{10}$ vg/kg, at least about $1 \times 10^{11}$ vg/kg, at least about $1 \times 10^{12}$ vg/kg, at least about $1 \times 10^{13}$ vg/kg, at least about $1 \times 10^{14}$ vg/kg, at least about $1 \times 10^{15}$ vg/kg, at least about $1 \times 10^{16}$ vg/kg. In other embodiments, the vector is administered to the subject at a dose of at least about $1 \times 10^5$ vg/kg to about $1 \times 10^{16}$ vg/kg, or at least about $1 \times 10^6$ vg/kg to about $1 \times 10^{15}$ vg/kg, or at least about $1 \times 10^7$ vg/kg to about $1 \times 10^{14}$ vg/kg, or at least about $1 \times 10^8$ vg/kg to about $1 \times 10^{13}$ vg/kg, or at least about $1 \times 10^9$ vg/kg to about $1 \times 10^{12}$ vg/kg, or at least about $1 \times 10^{10}$ vg/kg to about $1 \times 10^{11}$ vg/kg.

In other cases, the vector is a VLP of any of the embodiments described herein wherein the VLP is administered to the subject at a dose of at least about $1 \times 10^5$ particles, at least about $1 \times 10^6$ particles, at least about $1 \times 10^7$ particles, at least about $1 \times 10^8$ particles, at least about $1 \times 10^9$ particles, at least about $1 \times 10^{10}$ particles, at least about $1 \times 10^{11}$ particles, at least about $1 \times 10^{12}$ particles, at least about $1 \times 10^{13}$ particles, at least about $1 \times 10^{14}$ particles, at least about $1 \times 10^{15}$ particles, at least about $1 \times 10^{16}$ particles. In still other cases, the VLP is administered to the subject at a dose of at least about $1 \times 10^5$ particles to about $1 \times 10^{16}$ particles, or at least about $1 \times 10^6$ particles to about $1 \times 10^{15}$ particles, or at least about $1 \times 10^7$ particles to about $1 \times 10^{14}$ particles, or at least about $1 \times 10^8$ particles to about $1 \times 10^{13}$ particles, or at least about $1 \times 10^9$ particles to about $1 \times 10^{12}$ particles, or at least about $1 \times 10^{10}$ particles to about $1 \times 10^{11}$ particles.

In other cases, the vector is a VLP of any of the embodiments described herein wherein the VLP is administered to the subject at a dose of at least about $1 \times 10^5$ particles/kg, at least about $1 \times 10^6$ particles/kg, at least about $1 \times 10^7$ particles/kg, at least about $1 \times 10^6$ particles/kg, at least about $1 \times 10^9$ particles/kg, at least about $1 \times 10^{10}$ particles/kg, at least about $1 \times 10^{11}$ particles/kg, at least about $1 \times 10^{12}$ particles/kg, at least about $1 \times 10^{13}$ particles/kg, at least about $1 \times 10^{14}$ particles/kg, at least about $1 \times 10^{15}$ particles/kg, at least about $1 \times 10^{16}$ particles/kg. In still other cases, the VLP is administered to the subject at a dose of at least about $1 \times 10^5$ particles/kg to about $1 \times 10^{16}$ particles/kg, or at least about $1 \times 10^6$ particles/kg to about $1 \times 10^{15}$ particles/kg, or at least about $1 \times 10^7$ particles/kg to about $1 \times 10^{14}$ particles/kg, or at least about $1 \times 10^8$ particles/kg to about $1 \times 10^{13}$ particles/kg, or at least about $1 \times 10^9$ particles/kg to about $1 \times 10^{12}$ particles/kg, or at least about $1 \times 10^{10}$ particles/kg to about $1 \times 10^{11}$ particles/kg.

The vector or VLP can be administered according to any of the treatment regimens disclosed herein, below, and are administered to one or both eyes of the subject by a route of administration selected from intraocular, intravitreal, subretinal, or suprachoroidal injection or implantation.

In some embodiments, the treatment results in the improvement of one or more clinical parameters or endpoints associated with the disease in the subject, wherein the clinical parameter or endpoint is selected from one or any combination of the group consisting of: mean change or mean rate of change in 1) best corrected visual acuity (BCVA); 2) visual field sensitivity (including analysis of hill of vision volumes); 3) retinal sensitivity measured by full-field stimulus testing (FST) 67; 4) multiluminance mobility tests: 5) electrophysiological measures of retinal function: 6) optical coherence tomography (OCT) documenting the rate of photoreceptor loss: and 7) hypo- or hyperfluorescent lesion size on fundus autofluorescence; 8) color vision; 9) contrast sensitivity: 10) gaze tracking: 11) light aversion; 12) macular sensitivity.

In other embodiments, the disclosure provides methods of treating a subject having a RHO-related disease, the method comprising administering to one or both eyes of the subject of a therapeutically effective amount of the modified population of cells of any one of the embodiments described herein, wherein the administration can produce a beneficial effect in helping to treat (e.g., reduce the severity) or prevent the progression of the disease or results in an improvement in one or more clinical parameters or endpoints associated with the disease in the subject. In the foregoing, clinical parameters or endpoints are selected from one or any combination of the group consisting of; mean change or mean rate of change in 1) best corrected visual acuity (BCVA); 2) visual field sensitivity (including analysis of hill of vision volumes); 3) retinal sensitivity measured by full-field stimulus testing (FST); 4) multiluminance mobility tests: 5) electrophysiological measures of retinal function; 6) optical coherence tomography (OCT) documenting the rate of photoreceptor loss; and 7) hypo- or hyperfluorescent lesion size on fundus autofluorescence; 8) color vision; 9) contrast sensitivity; 10) gaze tracking; I1) light aversion: 12) macular sensitivity. In the embodiments, the population of cells are modified in vitro or ex vivo by CasX:gNA system composition(s) or the nucleic acids encoding the CasX:gNA system of the embodiments described herein, supra. The cells to be modified are selected from the group consisting of a rod photoreceptor cell, a retinal progenitor cell, a pluripotent stem cell (iPSC), fibroblasts, and Miller glial cells. In some cases, the CasX and gNA is delivered to the cells of the population as an RNP (embodiments of which are described herein, supra), wherein the target nucleic acid is modified such that a wild-type or a functional rhodopsin protein is expressed. In other cases, the CasX and gNA is delivered to the cell in a vector (embodiments of which are described herein, supra), wherein the target nucleic acid is modified such that a wild-type or a functional rhodopsin protein is expressed. In some embodiments, the method of treatment comprises the administration to the subject of a population of the modified cells such that, upon administration, a wild-type or a functional rhodopsin protein is expressed. Embodiments of such populations of modified cells are described herein, supra. In some cases, the cells have been modified such that expression of a wild-type or functional rhodopsin protein is increased by at least about 10%, at least about 20%, at least about 30%, at least about 40%, at least about 50%, at least about 60%, at least about 70%, at least about 80%, or at least about 90% in comparison to a cell where the RHO gene has not been modified. In other cases, the cells have been modified such that at least about 50%, at least about 60%, at least about 70%, at least about 75%, at least about 80%, at least about 85%, at least about 90%, or at least about 95% of the modified cells express a detectable level of functional rhodopsin protein. In some embodiments, the modified cells administered to the subject, or their progeny, persist in the subject for at least one month, two month, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the modified cells to the subject. In some embodiments of the method of treatment, the dose of total cells is within a range of between at or about $10^4$ and at or about $10^9$ cells, such as between $10^5$ and $10^6$ cells body weight, for example, at or about $1\times10^5$ cells, $1.5\times10^5$ cells, $2\times10^5$ cells, or $1\times10^6$ cells body weight. For example, in some embodiments, the cells are administered at, or within a certain range of error of, between at or about $10^4$ and at or about $10^9$ cells, such as between $10^5$ and $10^6$ cells body weight, for example, at or about $1\times10^5$ cells, $1.5\times10^5$ cells, $2\times10^5$ cells, or $1\times10^6$ cells. In some embodiments, the cells are selected from the group consisting of rodent cells, mouse cells, rat cells, and non-human primate cells. In other embodiments, the cells are human cells. In some embodiments, the cells are selected from the group consisting of a rod photoreceptor cell, a retinal progenitor cell, a pluripotent stem cell (iPSC), fibroblasts, and Müller glial cells. In one embodiment, the cells are autologous with respect to the subject to be administered the cells. In another embodiment, the cells are allogeneic with respect to the subject to be administered the cells. In some embodiments, the cells are administered to one or both eyes of the subject by a route of administration selected from intraocular, intravitreal, subretinal, or suprachoroidal injection or implantation.

In another embodiment, the invention provides a method of treatment of a subject having a RHO-related disease according to a treatment regimen comprising one or more consecutive doses using a therapeutically effective dose of a population of the modified cells. In one embodiment of the treatment regimen, the therapeutically effective dose of the cells is administered as a single dose. In another embodiment of the treatment regimen, the therapeutically effective dose of the cells is administered to the subject as two or more doses over a period of at least two weeks, or at least one month, or at least two months, or at least three months, or at least four months, or at least five months, or at least six months, or once a year, or every 2 or 3 years. In some embodiments, the dose of total cells and/or dose of individual sub-populations of cells is within a range of between at or about $10^4$ and at or about $10^9$ cells per dose, such as between $10^5$ and $10^6$ cells, for example, at or about $1\times10^5$ cells, $1.5\times10^5$ cells, $2\times10^5$ cells, or $1\times10^6$ cells per dose. For example, in some embodiments, the cells are administered at, or within a certain range of error of, between at or about $10^4$ and at or about $10^9$ cells per dose, such as between $10^5$ and $10^6$ cells, for example, at or about $1\times10^5$ cells, $1.5\times10^5$ cells, $2\times10^5$ cells, or $1\times10^6$ cells per dose. The cells can be administered to one or both eyes of the subject by a route of administration selected from intraocular, intravitreal, subretinal, or suprachoroidal injection or implantation.

In another embodiment, the invention provides a method of treatment of a subject having a RHO-related disease according to a treatment regimen comprising one or more consecutive doses using a therapeutically effective dose of a CasX:gNA system, or a polynucleotide encoding the CasX:gNA system, or a vector of any of the embodiments described herein. In one embodiment of the treatment regimen, the therapeutically effective dose is administered as a single dose. In another embodiment of the treatment regimen, the therapeutically effective dose is administered to the subject as two or more doses over a period of at least two weeks, or at least one month, or at least two months, or at least three months, or at least four months, or at least five months, or at least six months, or once a year, or every 2 or 3 years. The doses can be administered to one or both eyes of the subject by a route of administration selected from intraocular, intravitreal, subretinal, or suprachoroidal injection or implantation.

In some embodiments, the treatment regimen results in the improvement of one, two, or more clinical parameters or endpoints associated with the disease in the subject, wherein the clinical parameter or endpoint is selected from one or any combination of the group consisting of: mean change or mean rate of change in 1) best corrected visual acuity (BCVA); 2) visual field sensitivity (including analysis of hill of vision volumes); 3) retinal sensitivity measured by full-field stimulus testing (FST) 67: 4) multiluminance mobility tests: 5) electrophysiological measures of retinal function; 6) optical coherence tomography (OCT) documenting the rate of photoreceptor loss; and 7) hypo- or hyperfluorescent lesion size on fundus autofluorescence: 8) color vision: 9) contrast sensitivity; 10) gaze tracking; 11) light aversion; 12) macular sensitivity.

In some embodiments, the disclosure provides compositions comprising CasX and gNA gene editing pairs, for use as a medicament for the treatment of a subject having a neurologic disease, such as retinitis pigmentosa. In the foregoing, the CasX can be a CasX variant of SEQ ID NOs: 49-160, 237-239, 243-246, 251-263 or 273-281 and the gNA can be a gNA variant comprising a sequence of SEQ ID NOS: 2101 having a targeting sequence of SEQ ID NOs: SEQ ID NOs: 49-160, 237-239, 243-246, 251-263 or 273-281, or SEQ ID NOS: 382-582. In other embodiments, the disclosure provides compositions of vectors comprising or encoding the gene editing pairs of CasX and gNA for use as a medicament for the treatment of a subject having a disease, such as retinitis pigmentosa.

IX. Kits and Articles of Manufacture

In another aspect, provided herein are kits comprising the compositions of the embodiments described herein. In some embodiments, the kit comprises a CasX protein and one or a plurality of gNA of any of the embodiments of the disclosure comprising a targeting sequence complementary to a target nucleic acid of the RHO gene, an excipient and a suitable container (for example a tube, vial or plate). In other embodiments, the kit comprises a nucleic acid encoding a CasX protein and one or a plurality of gNA of any of the embodiments of the disclosure comprising a targeting sequence complementary to a target nucleic acid of the RHO gene, an excipient and a suitable container. In other embodiments, the kit comprises a vector comprising a nucleic acid encoding a CasX protein and one or a plurality of gNA of any of the embodiments of the disclosure comprising a targeting sequence complementary to a target nucleic acid of the RHO gene, an excipient and a suitable container. In still other embodiments, the kit comprises a VLP comprising a CasX protein and one or a plurality of gNA of any of the embodiments of the disclosure comprising a targeting sequence complementary to a target nucleic acid of the RHO gene an excipient and a suitable container. In still other embodiments, the kit comprises a plurality of cells edited using the Class 2 Type V Crispr systems described herein.

In some embodiments, the kit further comprises a buffer, a nuclease inhibitor, a protease inhibitor, a liposome, a therapeutic agent, a label, a label visualization reagent, or any combination of the foregoing. In some embodiments, the kit further comprises a pharmaceutically acceptable carrier, diluent or excipient.

In some embodiments, the kit comprises appropriate control compositions for gene modifying applications, and instructions for use.

In another aspect, the disclosure relates to compositions comprising a Class 2 Type V CRISPR protein and a first guide nucleic acid (gNA), wherein the gNA comprises a targeting sequence complementary to a non-target strand sequence located 1 nucleotide 3' of a protospacer adjacent motif (PAM) sequence of a RHO gene target nucleic acid sequence, wherein the RHO gene comprises one or more mutations. In one embodiment, the PAM sequence comprises a TC motif. In another embodiment, the PAM sequence comprises ATC, GTC, CTC or TTC. In another embodiment, the Class 2 Type V CRISPR protein comprises a RuvC domain. In the foregoing embodiments, the RuvC domain generates a staggered double-stranded break in the target nucleic acid sequence and the Class 2 Type V CRISPR protein does not comprise an HNH nuclease domain.

ENUMERATED EMBODIMENTS

The invention may be defined by reference to the following sets of enumerated, illustrative embodiments:

Set I

1. A CasX:gNA system comprising a CasX protein and a guide nucleic acid (gNA), wherein the gNA comprises a targeting sequence complementary to a target nucleic acid sequence comprising a rhodopsin (RHO) gene.

2. The CasX:gNA system of Set I embodiment 1, wherein the RHO gene comprises a protein coding sequence comprising a mutation.

3. The CasX:gNA system of any one of Set I embodiments 1-2, wherein the RHO gene comprises a regulatory region, optionally comprising a mutation.

4. The CasX:gNA system of any one of Set I embodiments 1 and 3, wherein the RHO gene comprises a wild-type protein coding sequence.

5. The CasX:gNA system of Set I embodiment 2, wherein the RHO gene comprising a mutation encodes a rhodopsin protein comprising a mutation compared to a wild-type rhodopsin protein sequence of SEQ ID NO:100.

6. The CasX:gNA system of any one of Set I embodiments 2 and 5, wherein the RHO gene comprising a mutation encodes a protein comprising the sequence of SEQ ID NO:101.

7. The CasX:gNA system of any one of Set I embodiments 2 and 5-6, wherein the RHO gene comprising a mutation encodes a protein comprising a P23 or P23H substitution compared to a wild-type rhodopsin protein sequence of SEQ ID NO:100.

8. The CasX:gNA system of any one of Set I embodiments 1-7, wherein the gNA is a guide RNA (gRNA).

9. The CasX:gNA system of any one of Set I embodiments 1-7, wherein the gNA is a guide DNA (gDNA).

10. The CasX:gNA system of any one of Set I embodiments 1-7, wherein the gNA is a chimera comprising DNA and RNA.

11. The CasX:gNA system of any one of Set I embodiments 1-10, wherein the gNA is a single-molecule gNA (sgNA).

12. The CasX:gNA system of any one of Set I embodiments 1-10, wherein the gNA is a dual-molecule gNA (dgNA).

13. The CasX:gNA system of any one of Set I embodiments 1-12, wherein the gNA comprises a targeting sequence consisting of 14, 15, 16, 17, 18, 19, 20, 21, 22, 23, 24, 25, 26, 27, 28, 29, or 30 consecutive nucleotides.

14. The CasX:gNA system of Set I embodiment 13, wherein the targeting sequence of the gNA consists of 20 nucleotides.

15. The CasX:gNA system of any one of Set I embodiments 7-14, wherein the targeting sequence of the gNA is complementary to a sequence comprising the P23H substitution.

16. The CasX:gNA system of any one of Set I embodiments 1-15, wherein the targeting sequence of the gNA comprises a sequence of AAGUGGCUGCGUACCACACC (SEQ ID NO: 382).

17. The CasX:gNA system of any one of Set I embodiments 1-16, wherein the targeting sequence of the gNA consists of a sequence of AAGUGGCUGCGUACCACACC (SEQ ID NO: 382).

18. The CasX:gNA system of any one of Set I embodiments 1-16, wherein the targeting sequence of the gNA consists of a sequence of AAGUGGCUGCGUACCACAC (SEQ ID NO: 27275).

19. The CasX:gNA system of any one of Set I embodiments 1-16, wherein the targeting sequence of the gNA consists of a sequence of AAGUGGCUGCGUACCACA (SEQ ID NO: 27276).

20. The CasX:gNA system of any one of Set I embodiments 1-16, wherein the targeting sequence of the gNA consists of a sequence of AAGUGGCUGCGUACCAC (SEQ ID NO: 27277).

21. The CasX:gNA system of any one of Set I embodiments 1-16, wherein the targeting sequence of the gNA consists of a sequence of AAGUGGCUGCGUACCA (SEQ ID NO: 27278).

22. The CasX:gNA system of any one of Set I embodiments 1-16, wherein the targeting sequence of the gNA consists of a sequence of AAGUGGCUGCGUACC (SEQ ID NO: 27279).

23. The CasX:gNA system of any one Set I embodiments 1-22, further comprising a second gNA, wherein the second gNA has a targeting sequence complementary a different or overlapping portion of the target nucleic acid sequence compared to the targeting sequence of the gNA of any one of the preceding Set I embodiments.

24. The CasX:gNA system of any one of Set I embodiments 1-23, wherein the gNA has a scaffold comprising a sequence having at least about 50%, at least about 60%, at least about 70%, at least about 80%, at least about 90%, at least about 95%, at least about 96%, at least about 97%, at least about 98%, at least about 99%, or 100% sequence identity to a sequence selected from the group consisting of sequences set forth in Table 1 and Table 2.

25. The CasX:gNA system of any one of Set I embodiments 1-24, wherein the gNA has a scaffold comprising a sequence having at least one nucleotide modification relative to a reference gNA sequence having a sequence of any one of SEQ ID NOS: 4-16 of Table 1.

26. The CasX:gNA system of Set I embodiment 25, wherein the at least one modification of the reference gNA comprises at least one substitution, deletion, or substitution of a nucleotide of the gNA sequence.

27. The CasX:gNA system of any one Set I embodiments 1-26, wherein the gNA is chemically modified.

28. The CasX:gNA system of any one Set I embodiments 1-27, wherein the CasX protein comprises a reference CasX protein having a sequence of any one of SEQ ID NOS: 1-3 a CasX variant protein having a sequence selected from those presented in Table 3, or a sequence having at least about 50%, at least about 60%, at least about 70%, at least about 80%, at least about 90%, or at least about 95%, or at least about 96%, or at least about 97%, or at least about 98%, or at least about 99% sequence identity to a sequence presented in Table 3.

29. The CasX:gNA system of Set I embodiment 28, wherein the CasX protein has binding affinity for a protospacer adjacent motif (PAM) sequence selected from the group consisting of TTC, ATC, GTC, and CTC.

30. The CasX:gNA system of Set I embodiment 28 or Set I embodiment 29, wherein the CasX variant protein comprises at least one amino acid modification relative to a reference CasX protein having a sequence of any one of SEQ ID NOS:1-3.

31. The CasX:gNA system of Set I embodiment 30, wherein the at least one amino acid modification comprises an amino acid substitution, deletion, or substitution in a domain of the CasX variant protein relative to the reference CasX protein.

32. The CasX:gNA system of Set I embodiment 31, wherein the domain is selected from the group consisting of a non-target strand binding (NTSB) domain, a target strand loading (TSL) domain, a helical I domain, a helical II domain, an oligonucleotide binding domain (OBD), and a RuvC DNA cleavage domain.

33. The CasX:gNA system of any one of Set I embodiments 28-32, wherein the CasX protein is fused to one or more nuclear localization signals (NLS).

34. The CasX:gNA system of Set I embodiment 33, wherein the one or more NLS are selected from the group of sequences consisting of PKKKRKV (SEQ ID NO: 176), KRPAATKKAGQAKKKK (SEQ ID NO: 177), PAAKRVKLD (SEQ ID NO: 178), RQRRNELKRSP (SEQ ID NO: 179), NQSSNFGPMKGGNFGGRSSGPYGGGGQYFAKPRNQGGY (SEQ ID NO: 180), RMRIZFKNKGKDTAELRRRRVEVSVELRKAKKDEQILKRRNV (SEQ ID NO: 181), VSRKRPRP (SEQ ID NO: 182), PPKKARED (SEQ ID NO: 183), PQPKKKPL (SEQ ID NO: 184), SALIKKKKKMAP (SEQ ID NO: 185), DRLRR (SEQ ID NO: 186), PKQKKRK (SEQ ID NO: 187), RKLKKKIKKL (SEQ ID NO: 188), REKKKFLKRR (SEQ ID NO: 189), KRKGDEVDGVDEVAKKKSKK (SEQ ID NO: 190), RKCLQAGMNLEARKTKK (SEQ ID NO: 191), PRPRKIPR (SEQ ID NO: 192), PPRKKRTVV (SEQ ID NO: 193), NLSKKKKRKREK (SEQ ID NO: 194), RRPSRPFRKP (SEQ ID NO: 195), KRPRSPSS (SEQ ID NO: 196), KRGINDRNFWRGENERKTR (SEQ ID NO: 197), PRPPKMARYDN (SEQ ID NO: 198), KRSFSKAF (SEQ ID NO: 199), KLKIKRPVK (SEQ ID NO: 200), PKTRRRPRRSQRKRPPT (SEQ ID NO: 202), RRKKRRPRRKKRR (SEQ ID NO: 205), PKKKSRKPKKKSRK (SEQ ID NO: 206), HKKKHPDASVNFSEFSK (SEQ ID NO: 207), QRPGPYDRPQRPGPYDRP (SEQ ID NO: 208), LSPSLSPLLSPSLSPL (SEQ ID NO: 209), RGKGGKGLGKGGAKRHRK (SEQ ID NO: 210), PKRGRGRPKRGRGR (SEQ ID NO: 322), and MSRRRKANPTKLSENAKKLAKEVEN (SEQ ID NO: 203).

35. The CasX:gNA system of Set I embodiment 33 or Set I embodiment 34, wherein the one or more NLS are fused at the C-terminus of the CasX protein.

36. The CasX:gNA system of Set I embodiment 33 or Set I embodiment 34, wherein the one or more NLS are fused at the N-terminus of the CasX protein.

37. The CasX:gNA system of Set I embodiment 33 or Set I embodiment 34, wherein the one or more NLS are fused at the N-terminus and C-terminus of the CasX protein.

38. The CasX:gNA system of any one of Set I embodiments 28-37, wherein the CasX variant protein exhibits one or more improved characteristics as compared to a reference CasX protein.

39. The CasX:gNA system of Set I embodiment 38, wherein the one or more improved characteristics are selected from the group consisting of improved folding of the CasX protein, improved binding affinity of the CasX protein to the guide RNA, improved RNP complex formation, improved binding affinity to the target nucleic acid sequence, altered binding affinity to one or more PAM sequences, improved unwinding of the target nucleic acid sequence, increased activity, increased target nucleic acid sequence cleavage rate, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved CasX protein stability, improved protein:guide RNA complex stability, improved protein solubility, improved protein:guide RNA complex solubility, improved protein yield, improved protein expression, and improved fusion characteristics.

40. The CasX:gNA system of Set I embodiment 38 or Set I embodiment 39, wherein the improved characteristic of the CasX variant protein is at least about 1.1 to about 100,000-fold improved relative to the reference CasX protein of SEQ ID NO: 1, SEQ ID NO: 2, or SEQ ID NO: 3.

41. The CasX:gNA system of Set I embodiment 38 or Set I embodiment 39, wherein the improved characteristic of the CasX variant protein is at least about 10-fold, at least about 100-fold, at least about 1,000-fold, or at least about 10,000-fold improved relative to the reference CasX protein of SEQ ID NO: 1. SEQ ID NO: 2, or SEQ ID NO: 3.

42. The CasX:gNA system of any one of Set I embodiments 39-41, wherein the improved characteristic is improved binding affinity to the target nucleic acid sequence.

43. The CasX:gNA system of any one of Set I embodiments 39-41, wherein the improved characteristic is increased target nucleic acid sequence cleavage rate.

44. The CasX:gNA system of any one of Set I embodiments 39-41, wherein the improved characteristic is improved CasX protein stability.

45. The CasX:gNA system of any one of Set I embodiments 39-41, wherein the improved characteristic is increased binding affinity to one or more PAM sequences wherein the one or more PAM sequences are selected from the group consisting of TTC, ATC, GTC, and CTC.

46. The CasX:gNA system of any one of Set I embodiments 28-45, wherein the CasX variant protein and the gNA are associated together in a ribonucleoprotein (RNP) complex.

47. The CasX:gNA system of any one of Set I embodiments 28-46, wherein the CasX variant protein comprises a nuclease domain having nickase activity.

48. The CasX:gNA system of any one of Set I embodiments 28-46, wherein the CasX variant protein comprises a nuclease domain having double-stranded cleavage activity.

49. The CasX:gNA system of any one of Set I embodiments 1-37, wherein the CasX protein is a catalytically inactive CasX (dCasX) protein, and wherein the dCasX and the gNA retain the ability to bind to the target nucleic acid sequence.

50. The CasX:gNA system of Set I embodiment 49, wherein the dCasX comprises a mutation at residues:
a. D672, E769, and/or D935 corresponding to the CasX protein of SEQ ID NO:1, or
b. D659, E756 and/or D922 corresponding to the CasX protein of SEQ ID NO: 2.

51. The CasX:gNA system of Set I embodiment 50, wherein the mutation is a substitution of alanine for the residue.

52. The CasX:gNA system of any one of Set I embodiments 1-51, further comprising a donor template nucleic acid.

53. The CasX:gNA system of Set I embodiment 52, wherein the donor template comprises a nucleic acid comprising at least a portion of a RHO gene, wherein the RHO gene portion is selected from the group consisting of a RHO exon, a RHO intron, and a RHO intron-exon junction.

54. The CasX:gNA system of Set I embodiment 52 or Set I embodiment 53, wherein the donor template ranges in size from 10-10,000 nucleotides.

55. The CasX:gNA system of any one of Set I embodiments 52-54, wherein the donor template is a single-stranded DNA template or a single stranded RNA template.

56. The CasX:gNA system of any one of Set I embodiments 52-54, wherein the donor template is a double-stranded DNA template.

57. The CasX:gNA system of any one of Set I embodiments 52-56, wherein the donor template comprises at least a portion of the sequence that encodes SEQ ID NO: 100.

58. The CasX:gNA system of Set I embodiment 57, wherein the donor template encodes a protein comprising P23 of SEQ ID NO:100.

59. A nucleic acid comprising a sequence that encodes components of the CasX:gNA system of any one of Set I embodiments 1-51.

60. The nucleic acid of Set I embodiment 59, wherein the nucleic acid encoding the CasX protein or the gNA is codon optimized for expression in a eukaryotic cell.

61. A vector comprising the nucleic acid of Set I embodiment 59 or Set I embodiment 60.

62. The vector of Set I embodiment 61, wherein the vector further comprises a promoter.

63. A vector comprising a donor template for use in a CasX:gNA system, wherein the donor template comprises a nucleic acid comprising at least a portion of a RHO gene, and wherein the RHO gene portion is selected from the group consisting of a RHO exon, a RHO intron, and a RHO intron-exon junction.

64. The vector of Set I embodiment 63, wherein the donor template comprises a sequence that encodes at least a portion of the sequence that encodes SEQ ID NO: 100.

65. The vector of Set I embodiment 63 or Set I embodiment 64, further comprising the nucleic acid of Set I embodiment 59 or Set I embodiment 60.

66. The vector of any one of Set I embodiments 63-65, wherein the vector is selected from the group consisting of a retroviral vector, a lentiviral vector, an adenoviral vector, an adeno-associated viral (AAV) vector, a herpes simplex virus (HSV) vector, a virus-like particle (VLP), a plasmid, a minicircle, a nanoplasmid, and an RNA vector.

67. The vector of Set I embodiment 66, wherein the vector is an AAV vector.

68. The vector of Set I embodiment 67, wherein the AAV vector is selected from AAV1, AAV2, AAV3, AAV4, AAV5, AAV6, AAV7, AAV8, AAV9, AAV10, AAV-Rh74, or AAVRh10.

69. The vector of Set I embodiment 66, wherein the vector is a retroviral vector.

70. The vector of Set I embodiment 66, wherein the vector encoding the VLP comprises one or more nucleic acids encoding a gag polyprotein, the CasX protein of any one of Set I embodiments 28-48, and the gNA of any one of Set I embodiments 8-27.

71. A method of modifying a RHO target nucleic acid sequence comprising a RHO gene in a cell, the method comprising contacting the RHO target nucleic acid sequence with a CasX protein and a guide nucleic acid (gNA) comprising a targeting sequence, wherein said contacting comprises introducing into the cell:
a. the CasX protein of any one of Set I embodiments 28-48 or a nucleic acid encoding the CasX protein; and
b. the gNA of any one of Set I embodiments 1-27, or a nucleic acid encoding the gNA, wherein said contacting results in modification of the RHO target nucleic acid sequence by the CasX protein.

72. The method of Set I embodiment 71, wherein the CasX protein and the gNA are associated together in a RNP complex.

73. The method of Set I embodiment 71 or Set I embodiment 72, further comprising a second gNA or a nucleic acid encoding the second gNA, wherein the second gNA has a targeting sequence complementary to a different or overlapping portion of the RHO target nucleic acid sequence.

74. The method of any one of Set I embodiments 71-73, wherein the RHO regulatory region comprises a mutation.

75. The method of any one of Set I embodiments 71-74, wherein the RHO gene comprise a mutation and wherein the modifying comprises introducing a single-stranded break in the RHO target nucleic acid sequence.

76. The method of any one of Set I embodiments 71-74, wherein the RHO gene comprises a mutation and wherein the modifying comprises introducing a double-stranded break in the RHO target nucleic acid sequence.

77. The method of Set I embodiment 75 or Set I embodiment 76, wherein the mutation encodes a P23 substitution or a P23H substitution as compared to the wild-type rhodopsin protein sequence.

78. The method of Set I embodiment 77, wherein the modifying of the RHO target nucleic acid sequence results in correction of the P23H substitution.

79. The method of any one of Set I embodiments 71-78, wherein the modifying of the RHO target nucleic acid sequence results in the RHO target nucleic acid sequence encoding the wild-type rhodopsin protein sequence of SEQ ID NO:100.

80. The method of any one of Set I embodiments 71-79, wherein the modifying of the RHO target nucleic acid sequence occurs in vitro.

81. The method of any one of Set I embodiments 71-80, wherein the modifying of the RHO target nucleic acid sequence occurs in vivo.

82. The method of any one of Set I embodiments 71-81, wherein the cell is a eukaryotic cell.

83. The method of Set I embodiment 82, wherein the eukaryotic cell is selected from the group consisting of a 84. The method of Set I embodiment 83, wherein the eukaryotic cell is a human cell.

85. The method of any one of Set I embodiments 71-84, wherein the cell is a photoreceptor cell.

86. The method of any one of Set I embodiments 71-84, wherein the cell is a retinal progenitor cell, 87. The method of any one of Set I embodiments 71-84, wherein the cell is an induced pluripotent stem cell (iPSC).

88. The method of any one of Set I embodiment 71-87, wherein the method further comprises contacting the RHO target nucleic acid sequence with a donor template complementary to at least a portion of a RHO gene and/or a RHO regulatory region comprising one or more mutations, wherein the donor template is inserted into the RHO target nucleic acid sequence to correct the one or more mutations or is inserted to replace the target nucleic acid sequence.

89. The method of Set I embodiment 88, wherein the donor template ranges in size from 10-10,000 nucleotides.

90. The method of Set I embodiment 88, wherein the donor template ranges in size from 100-1,000 nucleotides.

91. The method of any one of Set I embodiments 88-90, wherein the donor template is a single-stranded DNA template or a single stranded RNA template.

92. The method of any one of Set I embodiments 88-90, wherein the donor template is a double-stranded DNA template.

93. The method of any one of Set I embodiments 88-92, wherein the donor template is inserted by homology directed repair (HDR).

94. The method of any one of Set I embodiments 82-93, wherein the method comprises contacting the eukaryotic cell with a vector encoding the CasX protein and the gNA, and optionally further comprising the donor template.

95. The method of Set I embodiment 94, wherein the vector is an Adeno-Associated Viral (AAV) vector.

96. The method of Set I embodiment 95, wherein the AAV is AAV1, AAV2, AAV3, AAV4, AAV5, AAV6, AAV7, AAV8, AAV9, AAV10, AAV-Rh74, or AAVRh10.

97. The method of Set I embodiment 94, wherein the vector is a lentiviral vector.

98. The method of any one of Set I embodiments 82-93, wherein the method comprises contacting the eukaryotic cell with a VLP vector, wherein the VLP vector comprises the RNP of Set I embodiment 46.

99. The method of any one of Set I embodiments 94-98, wherein the vector is administered to a subject at a therapeutically effective dose.

100. The method of Set I embodiment 99, wherein the subject is selected from the group consisting of mouse, rat, dog, pig, non-human primate, and human.

101. The method of Set I embodiment 100, wherein the subject is a human.

102. The method of any one of Set I embodiments 99-101, wherein the vector is administered at a dose of at least about $1\times10^5$ vector genomes (vg), or at least about $1\times10^6$ vg, or at least about $1\times10^7$ vg, or at least about $1\times10^8$ vg, or at least about $1\times10^9$ vg, or at least about $1\times10^{10}$ vg, or at least about $1\times10^{11}$ vg, or at least about $1\times10^{12}$ vg.

103. The method of any one of Set I embodiments 99-102, wherein the vector is administered by a route of administration selected from the group consisting of intraocular, intravitreal, and sub-retinal routes.

104. The method of any one of Set I embodiments 71-103, comprising further contacting the target nucleic acid sequence with an additional CRISPR protein, or a polynucleotide encoding the additional CRISPR protein.

105. The method of Set I embodiment 104, wherein the additional CRISPR protein is a CasX protein having a sequence different from the CasX of any one of Set I embodiments 28-51.

106. The method of Set I embodiment 104, wherein the additional CRISPR protein is not a CasX protein.

107. A method of modifying a RHO target nucleic acid sequence of a cell, wherein the nucleic acid encodes a protein having the sequence of SEQ ID NO: 101, the method comprising contacting said cell with: a) CasX:gNA system of any one of Set I embodiments 1-58: b) the nucleic acid of Set I embodiment 59 or Set I embodiment 60; c) the vector as in any one of Set I embodiments 94-103; or combinations thereof.

108. The method of Set I embodiment 107, wherein the cell is modified such that expression of the protein of SEQ ID: 101 is reduced by at least about 50%, at least about 60%, at least about 70%, at least about 80%, at least about 90%, or at least about 95% in comparison to a cell that has not been modified.

109. The method of Set I embodiment 107 or Set I embodiment 108, wherein the cell has been modified such that the cell does not express a detectable level of the protein of SEQ ID NO:101.

110. The method of Set I embodiment 107, wherein the cell has been modified such that it expresses RHO protein having the sequence of SEQ ID NO:100.

111. A population of cells modified by the method of Set I embodiment 107 or Set I embodiment 108, wherein the cells have been modified such that at least 70%, at least 75%, at least 80%, at least 85%, at least 90%, or at least 95% of the modified cells do not express a detectable level of the protein of SEQ ID NO:101.

112. A population of cells modified by the method of Set I embodiment 110, wherein the cells have been modified such that at least 70%, at least 75%, at least 80%, at least 85%, at least 90%, or at least 95% of the modified cells express a detectable level of RHO protein having the sequence of SEQ ID NO:100.

113. The population of cells of Set I embodiment 111 or Set I embodiment 112, wherein the cell is a non-primate mammalian cell, a non-human primate cell, or a human cell.

114. The population of cells of any one of Set I embodiments 111-113, wherein the cell is selected from the group consisting of a photoreceptor cell, a retinal progenitor cell, or a pluripotent stem cell (iPSC).

115. A method of treating a RHO-related disorder in a subject in need thereof, comprising modifying in a cell of the subject a RHO gene, wherein the RHO gene has one or more mutations, the modifying comprising either contacting said cell with;
  a. CasX:gNA system of any one of Set I embodiments 1-58;
  b. the nucleic acid of Set I embodiment 59 or Set I embodiment 60.
  c. the vector of any one of Set I embodiments 61-70: or
  d. combinations thereof.

116. The method of Set I embodiment 115, further comprising a second gNA or a nucleic acid encoding the second gNA, wherein the second gNA has a targeting sequence complementary to a different or overlapping portion of the target nucleic acid sequence.

117. The method of Set I embodiment 115 or Set I embodiment 116, wherein the modifying corrects the one or more mutations, or wherein expression of the RHO having the one or more mutations is inhibited or suppressed.

118. The method of any one of Set I embodiments 115-117, wherein the RHO-related disorder is retinitis pigmentosa.

119. The method of any one of Set I embodiments 115-118, wherein the method comprises contacting the cell with the vector.

120. The method of Set I embodiment 119, wherein the vector is an Adeno-Associated Viral (AAV) vector.

121. The method of Set I embodiment 120, wherein the AAV is AAV1, AAV2, AAV3, AAV4, AAV5, AAV6, AAV7, AAV8, AAV9, AAV10, AAV-Rh74, or AAVRh10.

122. The method of Set I embodiment 120, wherein the vector is a lentiviral vector.

123. The method of any one of Set I embodiments 115-119, wherein the method comprises contacting the eukaryotic cell with a VLP vector, wherein the VLP vector comprises the RNP of Set I embodiment 46.

124. The method of any one of Set I embodiments 115-123, wherein the vector is administered to a subject at a therapeutically effective dose.

125. The method of Set I embodiment 124, wherein the subject is selected from the group consisting of mouse, rat, dog, pig, non-human primate, and human.

126. The method of Set I embodiment 126, wherein the subject is a human.

127. The method of any one of Set I embodiments 115-126, wherein the vector is administered to the subject at a dose of at least about $1\times10^5$ vector genomes (vg), or at least about $1\times10^6$ vg, or at least about $1\times10^7$ vg, or at least about $1\times10^8$ vg, or at least about $1\times10^9$ vg, or at least about $1\times10^{10}$ vg, or at least about $1\times10^{11}$ vg, or at least about $1\times10^{12}$ vg.

128. The method of any one of Set I embodiments 115-127, wherein the vector is administered by a route of administration selected from the group consisting of intraocular, intravitreal, and sub-retinal routes.

129. The method of any one of Set I embodiments 115-128, comprising further contacting the target nucleic acid sequence with an additional CRISPR protein, or a polynucleotide encoding the additional CRISPR protein.

130. The method of Set I embodiment 129, wherein the additional CRISPR protein is a CasX protein having a sequence different from the CasX of any of the preceding Set I embodiments.

131. The method of Set I embodiment 130, wherein the additional CRISPR protein is not a CasX protein.

132. The method of any one of Set I embodiments 115-131, wherein the method results in improvement in at least one clinically-relevant endpoint selected from the group consisting of change in the mean retinal sensitivity of the central 2° of the ocular fundus, visual acuity, contrast sensitivity, multiluminance mobility test (MLMT), full-field light sensitivity threshold (FST), health-related quality of life using a questionnaire on visual function, duration of response, and time-to-treatment failure.

133. The method of any one of Set I embodiments 115-132, wherein the method results in improvement in at least one clinically-relevant endpoint selected from the group consisting of change in the mean retinal sensitivity of the central 2° of the ocular fundus, visual acuity, contrast sensitivity, multiluminance mobility test (MLMT), full-field light sensitivity threshold (FST), health-related quality of life using a questionnaire on visual function, duration of response, and time-to-treatment failure.

Set II

1. A composition comprising a Class 2 Type V CRISPR protein and a first guide nucleic acid (gNA), wherein the gNA comprises a targeting sequence complementary to a rhodopsin (RHO) gene target nucleic acid sequence, w % herein the RHO gene comprises one or more mutations.

2. The composition of Set II embodiment 1, wherein the RHO gene comprises one or more mutations in a region selected from the group consisting of;
   a. a RHO intron;
   b. a RHO exon;
   c. a RHO intron-exon junction;
   d. a RHO regulatory element; and
   e. an intergenic region.

3. The composition of any one of Set II embodiment 1 or Set II embodiment 2, wherein the mutation is an insertion, deletion, substitution, duplication, or inversion of one or more nucleotides as compared to the wild-type RHO gene sequence.

4. The composition of any one of Set II embodiments 1-3, wherein the mutation is a gain of function mutation.

5. The composition of any one of Set II embodiments 1-3, wherein the RHO gene comprises a mutation set forth in Table 4A.

6. The composition of any one of Set II embodiments 1-5, wherein the RHO gene comprising a mutation encodes a protein comprising a P23 or P23H substitution compared to a wild-type rhodopsin protein sequence of SEQ ID NO:100.

7. The composition of any one of Set II embodiments 1-6, wherein the RHO gene encodes a non-functional rhodopsin protein.

8. The composition of any one of Set II embodiments 1-6, wherein the gNA is a guide RNA (gRNA).

9. The composition of any one of Set II embodiments 1-6, wherein the gNA is a guide DNA (gDNA).

10. The composition of any one of Set II embodiments 1-6, wherein the gNA is a chimera comprising DNA and RNA.

11. The composition of any one of Set II embodiments 1-10, wherein the gNA is a single-molecule gNA (sgNA).

12. The composition of any one of Set II embodiments 1-10, wherein the gNA is a dual-molecule gNA (dgNA).

13. The composition of any one of Set I1 embodiments 1-12, wherein the targeting sequence of the gNA comprises a sequence selected from the group consisting of the sequences of SEQ ID NOS:328-346, 367-376, 382-2100 and 2286-27274, or a sequence having at least about 65%, at least about 75%, at least about 85%, or at least about 95% identity thereto.

14. The composition of any one of Set II embodiments 1-12, wherein the targeting sequence of the gNA comprises a sequence selected from the group consisting of the sequences of SEQ ID NOs:328-346, 367-376, 382-2100 and 2286-27274.

15. The composition of any one of Set I1 embodiments 1-12, wherein the targeting sequence of the gNA comprises a sequence of SEQ ID NOs: 328-346, 367-376, 382-2100 and 2286-27274 with a single nucleotide removed from the 3' end of the sequence.

16. The composition of any one of Set II embodiments 1-12, wherein the targeting sequence of the gNA comprises a sequence of SEQ ID NOs: 2328-346, 367-376, 382-2100 and 2286-27274 with two nucleotides removed from the 3' end of the sequence.

17. The composition of any one of Set II embodiments 1-12, wherein the targeting sequence of the gNA comprises a sequence of SEQ ID NOs: 328-346, 367-376, 382-2100 and 2286-27274 with three nucleotides removed from the 3' end of the sequence.

18. The composition of any one of Set II embodiments 1-12, wherein the targeting sequence of the gNA comprises a sequence of SEQ ID NOs: 328-346, 367-376, 382-2100 and 2286-27274 with four nucleotides removed from the 3' end of the sequence.

19. The composition of any one of Set II embodiments 1-12, wherein the targeting sequence of the gNA comprises a sequence of SEQ ID NOs: 328-346, 367-376, 382-2100 and 2286-27274 with five nucleotides removed from the 3' end of the sequence.

20. The composition of any one of Set II embodiments 1-19, wherein the targeting sequence of the gNA comprises a sequence having one or more single nucleotide polymorphisms (SNP) relative to a sequence of SEQ ID NOS: 328-346, 367-376, 382-2100 and 2286-27274.

21. The composition of any one of Set II embodiments 1-19, wherein the targeting sequence of the gNA is complementary to a sequence of a RHO exon.

22. The composition of any one of Set II embodiments 1-21, wherein the targeting sequence of the gNA is complementary to a sequence of RHO exon 1.

23. The composition of Set II embodiment 21 or Set II embodiment 22, wherein the targeting sequence of the gNA is complementary to a target nucleic acid sequence encoding the P23H substitution.

24. The CasX:gNA system of any one of Set II embodiments 21-23, wherein the targeting sequence of the gNA comprises a sequence of AAGUGGCUGCGUACCACACC (SEQ ID NO: 382).

25. The CasX:gNA system of any one of Set II embodiments 21-23, wherein the targeting sequence of the gNA consists of a sequence of AAGUGGCUGCGUACCACACC (SEQ ID NO: 382).

26. The CasX:gNA system of any one of Set II embodiments 21-23, wherein the targeting sequence of the gNA consists of a sequence of AAGUGGCUGCGUACCACAC (SEQ ID NO: 27275).

27. The CasX:gNA system of any one of Set II embodiments 21-23, wherein the targeting sequence of the gNA consists of a sequence of AAGUGGCUGCGUACCACA (SEQ ID NO: 27276).

28. The CasX:gNA system of any one of Set II embodiments 21-23, wherein the targeting sequence of the gNA consists of a sequence of AAGUGGCUGCGUACCAC (SEQ ID NO: 27277).

29. The CasX:gNA system of any one of Set II embodiments 21-23, wherein the targeting sequence of the gNA consists of a sequence of AAGUGGCUGCGUACCA (SEQ ID NO: 27278).

30. The CasX:gNA system of any one of Set II embodiments 21-23, wherein the targeting sequence of the gNA consists of a sequence of AAGUGGCUGCGUACC (SEQ ID NO: 27279).

31. The composition of any one of Set II embodiments 1-19, wherein the targeting sequence of the gNA is complementary to a sequence of a RHO intron.

32. The composition of any one of Set I1 embodiments 1-19, wherein the targeting sequence of the gNA is complementary to a sequence of a RHO intron-exon junction.

33. The composition of any one of Set II embodiments 1-19, wherein the targeting sequence of the gNA is complementary to a sequence of a RHO regulatory element.

34. The composition of any one of Set II embodiments 1-19, wherein the targeting sequence of the gNA is complementary to a sequence comprising one or more single nucleotide polymorphisms (SNPs) of the RHO gene.

35. The composition of any one of Set I1 embodiments 1-19, wherein the targeting sequence of the gNA is complementary to a sequence of an intergenic region of the RHO gene.

36. The composition of any one of Set II embodiments 1-35, further comprising a second gNA, wherein the second gNA has a targeting sequence complementary to a different or overlapping portion of the RHO target nucleic acid compared to the targeting sequence of the first gNA.

37. The composition of Set II embodiment 36, wherein the second gNA has a targeting sequence complementary to the same exon targeted by the first gNA.

38. The composition of Set II embodiment 36, wherein the second gNA has a targeting sequence complementary to a different exon targeted by the first gNA.

39. The composition of Set II embodiment 36, wherein the second gNA has a targeting sequence complementary to an intron 3' to the exon targeted by the first gNA.

40. The composition of any one of Set II embodiments 1-39, wherein the first or second gNA has a scaffold comprising a sequence having at least about 50%, at least about 60%, at least about 70%, at least about 80%, at least about 90%, at least about 95%, at least about 96%, at least about 97%, at least about 98%, at least about 99%, or 100% sequence identity to a sequence selected from the group consisting of SEQ ID NOS: 2201-2285.

41. The composition of any one of Set II embodiments 1-39, wherein the first or second gNA has a scaffold comprising a sequence selected from the group consisting of SEQ ID NOS: 2201-2285.

42. The composition of any one of Set II embodiments 1-39, wherein the first or second gNA scaffold comprises a sequence having at least one modification relative to a reference gNA sequence selected from the group consisting of SEQ ID NOS: 4-16.

43. The composition of Set II embodiment 42, wherein the at least one modification of the reference gNA comprises at least one substitution, deletion, or substitution of a nucleotide of the reference gNA sequence.

44. The composition of any one of Set II embodiments 1-43, wherein the first or second gNA is chemically modified.

45. The composition of any one of Set II embodiments 1-44, wherein the Class 2 Type V CRISPR protein is a reference CasX protein having a sequence of any one of SEQ ID NOS: 1-3, a CasX variant protein having a sequence of SEQ ID NOs: 49-160, 237-239, 243-246, 251-263 or 273-281, or a sequence having at least about 50%, at least about 60%, at least about 70%, at least about 80%, at least about 90%, or at least about 95%, or at least about 95%, or at least about 96%, or at least about 97%, or at least about 98%, or at least about 99% sequence identity thereto.

46. The composition of any one of Set II embodiments 1-44, wherein the Class 2 Type V CRISPR protein is a CasX variant protein having a sequence of SEQ ID NOs: 49-160, 237-239, 243-246, 251-263 or 273-281

47. The composition of Set II embodiment 45, wherein the CasX variant protein comprises at least one modification relative to a reference CasX protein having a sequence selected from SEQ ID NOS:1-3.

48. The composition of Set II embodiment 47, wherein the at least one modification comprises at least one amino acid substitution, deletion, or substitution in a domain of the CasX variant protein relative to the reference CasX protein.

49. The composition of Set II embodiment 48, w-herein the domain is selected from the group consisting of a non-target strand binding (NTSB) domain, a target strand loading (TSL) domain, a helical I domain, a helical II domain, an oligonucleotide binding domain (OBD), and a RuvC DNA cleavage domain.

50. The composition of any one of Set II embodiments 45-49, wherein the CasX protein further comprises one or more nuclear localization signals (NLS).

51. The composition of Set II embodiment 50, wherein the one or more NLS are selected from the group of sequences consisting of SEQ ID NOS: 176-213.

52. The composition of Set II embodiment 50 or Set II embodiment 51, wherein the one or more NLS are expressed at or near the C-terminus of the CasX protein.

53. The composition of Set II embodiment 50 or Set II embodiment 51, wherein the one or more NLS are expressed at or near the N-terminus of the CasX protein.

54. The composition of Set II embodiment 50 or Set II embodiment 51, comprising one or more NLS located at or near the N-terminus and at or near the C-terminus of the CasX protein.

55. The composition of any one of Set II embodiments 45-54, wherein the Class 2 Type V CRISPR protein is capable of forming a ribonuclear protein complex (RNP) with the gNA.

56. The composition of Set II embodiment 55, wherein an RNP comprising the CasX variant protein and the gNA exhibit at least one or more improved characteristics as compared to an RNP comprising the reference CasX protein of SEQ ID NO: 1, SEQ ID NO: 2, or SEQ ID NO: 3 and a gNA comprising a sequence of any one of SEQ ID NOS: 4-16.

57. The composition of Set II embodiment 56, wherein the improved characteristic is selected from one or more of the group consisting of improved folding of the CasX variant; improved binding affinity to a guide nucleic acid (gNA); improved binding affinity to a target DNA; improved ability to utilize a greater spectrum of one or more PAM sequences, including ATC, CTC, GTC, or TTC, in the editing of target DNA; improved unwinding of the target DNA: increased editing activity; improved editing efficiency; improved editing specificity; increased nuclease activity: increased target strand loading for double strand cleavage; decreased target strand loading for single strand nicking; decreased off-target cleavage; improved binding of non-target DNA strand; improved protein stability; improved protein solubility; improved protein:gNA complex (RNP) stability; improved protein:gNA complex solubility; improved protein yield; improved protein expression: and improved fusion characteristics.

58. The composition of Set II embodiment 56 or Set II embodiment 57, wherein the improved characteristic of the RNP of the CasX variant protein and the gNA variant is at least about 1.1 to about 100-fold or more improved relative to the RNP of the reference CasX protein of SEQ ID NO: 1, SEQ ID NO: 2, or SEQ ID NO: 3 and the gNA comprising a sequence of any one of SEQ ID NOS: 4-16.

59. The composition of Set II embodiment 56 or Set II embodiment 57, wherein the improved characteristic of the CasX variant protein is at least about 1.1, at least about 2, at least about 10, at least about 100-fold or more improved relative to the reference CasX protein of SEQ ID NO: 1, SEQ ID NO: 2, or SEQ ID NO: 3 and the gNA comprising a sequence of any one of SEQ ID NOS: 4-16.

60. The composition of any one of Set II embodiments 56-59, wherein the improved characteristic comprises editing efficiency, and the RNP of the CasX variant protein and the gNA variant comprises a 1.1 to I00-fold improvement in editing efficiency compared to the RNP of the reference CasX protein of SEQ ID NO: 2 and the gNA of any one of SEQ ID NOS: 4-16.

61. The composition of any one of Set II embodiments 56-60, wherein the RNP comprising the CasX variant and the gNA variant exhibits greater editing efficiency and/or binding of a target sequence in the target nucleic acid when any one of the PAM sequences TTC, ATC, GTC, or CTC is located 1 nucleotide 5' to the non-target strand sequence having identity with the targeting sequence of the gNA in a cellular assay system compared to the editing efficiency and/or binding of an RNP comprising a reference CasX protein and a reference gNA in a comparable assay system.

62. The composition of Set II embodiment 61, wherein the PAM sequence is TTC.

63. The composition of Set II embodiment 62, wherein the targeting sequence of the gNA comprises a sequence selected from the group consisting of SEQ ID NOs: 370-371, 373-376, and 19918-27274.

64. The composition of Set II embodiment 61, wherein the PAM sequence is ATC

65. The composition of Set II embodiment 64, wherein the targeting sequence of the gNA comprises a sequence selected from the group consisting of SEQ ID NOs: 583-2100, and 2286-5554.

66. The composition of Set II embodiment 61, wherein the PAM sequence is CTC.

67. The composition of Set II embodiment 66, wherein the targeting sequence of the gNA comprises a sequence selected from the group consisting of SEQ ID NOs: 367-369, 372, and 10487-19917.

68. The composition of Set II embodiment 61, wherein the PAM sequence is GTC.

69. The composition of Set II embodiment 68, wherein the targeting sequence of the gNA comprises a sequence selected from the group consisting of SEQ ID NOs: 5555-10486.

70. The composition of any one of Set II embodiments 61-69, wherein the increased binding affinity for the one or more PAM sequences is at least 1.5-fold greater compared to the binding affinity of any one of the reference CasX proteins of SEQ ID NOS: 1-3 for the PAM sequences.

71. The composition of any one of Set II embodiments 56-70, wherein the RNP has at least a 5%, at least a 10%, at least a 15%, or at least a 20% higher percentage of cleavage-competent RNP compared to an RNP of the reference CasX proteins of SEQ ID NOS: 1-3 and the gNA of SEQ ID NOS: 4-16.

72. The composition of any one of Set II embodiments 45-71, wherein the CasX variant protein comprises a RuvC DNA cleavage domain having nickase activity.

73. The composition of any one of Set II embodiments 45-71, wherein the CasX variant protein comprises a RuvC DNA cleavage domain having double-stranded cleavage activity.

74. The composition of any one of Set I1 embodiments 45-71, wherein the CasX protein is a catalytically inactive CasX (dCasX) protein, and wherein the dCasX and the gNA retain the ability to bind to the RHO target nucleic acid.

75. The composition of Set II embodiment 74, wherein the dCasX comprises a mutation at residues:

a. D672, E769, and/or D935 corresponding to the CasX protein of SEQ ID NO:1; or b. D659, E756 and/or D922 corresponding to the CasX protein of SEQ ID NO: 2.

76. The composition of Set II embodiment 75, wherein the mutation is a substitution of alanine for the residue.

77. The composition of any one of Set II embodiments 1-73, further comprising a donor template nucleic acid.

78. The composition of Set II embodiment 77, wherein the donor template comprises a nucleic acid comprising at least a portion of a RHO gene selected from the group consisting of a RHO exon, a RHO intron, a RHO intron-exon junction, and a RHO regulatory element.

79. The composition of Set II embodiment 78, wherein the donor template comprises a wild-type nucleic acid sequence.

80. The composition of Set II embodiment 78, wherein the donor template comprises a nucleic acid sequence having one or more mutations relative to the wild-type RHO gene sequence.

81. The composition of any one of Set II embodiments 77-80, wherein the donor template ranges in size from 10-10,000 nucleotides.

82. The composition of any one of Set II embodiments 77-81, wherein the donor template is a single-stranded DNA template or a single stranded RNA template.

83. The composition of any one of Set II embodiments 77-81, wherein the donor template is a double-stranded DNA template.

84. The composition of any one of Set II embodiments 77-83, wherein the donor template comprises homologous arms at or near the 5' and 3' ends of the donor template that are complementary to sequences flanking cleavage sites in the RHO target nucleic acid introduced by the Class 2 Type V CRISPR protein.

85. A nucleic acid comprising the donor template of any one of Set II embodiments 77-84.

86. A nucleic acid comprising a sequence that encodes the CasX of any one of Set II embodiments 45-76.

87. A nucleic acid comprising a sequence that encodes the gNA of any one of Set II embodiments 1-44.

88. The nucleic acid of Set II embodiment 86, wherein the sequence that encodes the CasX protein is codon optimized for expression in a eukaryotic cell.

89. A vector comprising the gNA of any one of Set II embodiments 1-44, the CasX protein of any one of Set II embodiments 45-76, or the nucleic acid of any one of Set II embodiments 85-88.

90. The vector of Set II embodiment 89, wherein the vector further comprises a promoter.

91. The vector of Set II embodiment 89 or Set II embodiment 90, wherein the vector is selected from the group consisting of a retroviral vector, a lentiviral vector, an adenoviral vector, an adeno-associated viral (AAV) vector, a herpes simplex virus (HSV) vector, a virus-like particle (VLP), a plasmid, a minicircle, a nanoplasmid, a DNA vector, and an RNA vector.

92. The vector of Set II embodiment 91, wherein the vector is an AAV vector.

93. The vector of Set II embodiment 92, wherein the AAV vector is selected from AAV1, AAV2, AAV3, AAV4, AAV5. AAV6, AAV7, AAV8, AAV9, AAV10. AAV11, AAV12, AAV 44.9, AAV-Rh74, or AAVRh10.

94. The vector of Set II embodiment 93, wherein the AAV vector is selected from AAV1. AAV2, AAV5, AAV8, or AAV9.

95. The vector of Set II embodiment 91, wherein the vector is a retroviral vector.

96. The vector of Set II embodiment 91, wherein the vector is a VLP vector comprising one or more components of a gag polyprotein.

97. The vector of Set II embodiment 96, wherein the one or more components of the gag polyprotein are selected from the group consisting of matrix protein (MA), nucleocapsid protein (NC), capsid protein (CA), p1-p6 protein, and protease cleavage site.

98. The vector of Set II embodiment 96 or Set II embodiment 97, comprising the CasX protein and the gNA.

99. The vector of Set II embodiment 98, wherein the CasX protein and the gNA are associated together in an RNP.

100. The vector of any one of Set II embodiments 96-99, further comprising the donor template.

101. The vector of any one of Set II embodiments 96-1I0, further comprising a pseudotyping viral envelope glycoprotein or antibody fragment that provides for binding and fusion of the VLP to a target cell.

102. A host cell comprising the vector of any one of Set II embodiments 89-101.

103. The host cell of Set II embodiment 101, wherein the host cell is selected from the group consisting of BHK, HEK293. HEK293T, NS0, SP2/0, YO myeloma cells. P3X63 mouse myeloma cells, PER, PER.C6. NIH3T3, COS. HeLa, CHO, and yeast cells.

104. A method of modifying a RHO target nucleic acid sequence in a population of cells, wherein the RHO target nucleic acid comprises one or more mutations, the method comprising introducing into cells of the population:
  a. the composition of any one of Set II embodiments 1-84;
  b. the nucleic acid of any one of Set II embodiments 85-88;
  c. the vector of any one of Set II embodiments 89-101; or
  d. combinations of two or more of (a)-(c), wherein the RHO target nucleic acid sequence of the cells targeted by the first gNA is modified by the CasX protein.

105. The method of Set II embodiment 104, wherein the modifying comprises introducing a single-stranded break in the RHO target nucleic acid sequence of the cells of the population.

106. The method of Set II embodiment 104, wherein the modifying comprises introducing a double-stranded break in the RHO target nucleic acid sequence of the cells of the population.

107. The method of any one of Set II embodiments 104-106, further comprising introducing into the cells of the population a second gNA or a nucleic acid encoding the second gNA, wherein the second gNA has a targeting sequence complementary to a different or overlapping portion of the RHO target nucleic acid compared to the first gNA, resulting in an additional break in the RHO target nucleic acid of the cells of the population.

108. The method of any one of Set II embodiments 104-107, wherein the modifying comprises introducing an insertion, deletion, substitution, duplication, or inversion of one or more nucleotides in the RHO target nucleic acid of the cells of the population.

109. The method of any one of Set II embodiments 104-108, wherein the RHO target nucleic acid of at least 10% of the cells of the population is modified.

110. The method of Set I1 embodiment 108, wherein the modifying results in a knocking down or knocking out of the RHO gene in the cells of the population such that expression of non-functional rhodopsin protein is decreased by at least about 10%, at least about 20%, at least about 30%, at least about 40%, at least about 50%, at least about 60%, at least about 70%, at least about 80%, or at least about 90% in comparison to a cell where the RHO gene has not been modified.

111. The method of Set II embodiment 108, wherein the RHO gene of the cells of the population is modified such that at least about 10% f, at least about 20%, at least about 30% r, at least about 40%, at least about 50%, at least about 60%, at least about 70%, at least about 80%, or at least about 90% of the modified cells do not express a detectable level of non-functional rhodopsin protein.

112. The method of Set II embodiment 108, wherein the modifying results in a correction or compensation of the mutation of the RHO gene in the cells of the population such that functional rhodopsin protein is expressed by the cells.

113. The method of Set II embodiment 108, wherein expression of the functional rhodopsin protein by the cells of the population is increased by at least about 10%, at least about 20%, at least about 30%, at least about 40%, at least about 50%, at least about 60%, at least about 70%, at least about 80%, or at least about 90% in comparison to a cell where the RHO gene has not been modified.

114. The method of any one of Set II embodiments 104-107, wherein the method comprises insertion of the donor template into the break site(s) of the RHO gene target nucleic acid sequence of the cells of the population.

115. The method of Set II embodiment 114, wherein insertion of the donor template is mediated by homology-directed repair (HDR) or homology-independent targeted integration (HITI).

116. The method of Set I1 embodiment 114 or Set II embodiment 115, wherein insertion of the donor template results in a correction or compensation of the RHO gene in the cells of the population such that functional rhodopsin protein is expressed by the cells.

117. The method of Set II embodiment 114, wherein expression of the functional rhodopsin protein by the cells of the population is increased by at least about 10%, at least about 20%, at least about 30%, at least about 40%, at least about 50%, at least about 60%, at least about 70%, at least about 80%, or at least about 90% in comparison to a cell where the RHO gene has not been modified.

118. The method of any one of Set II embodiments 114-116, wherein the RHO gene of the cells of the population is modified such that at least about 50%, at least about 60%, at least about 70%, at least about 75%, at least about 80%, at least about 85%, at least about 90%, or at least about 95% of the modified cells express a detectable level of functional rhodopsin.

119. The method of Set II embodiment 114 or Set II embodiment 115, wherein insertion of the donor template results in a knocking down or knocking out the RHO gene in the cells of the population such that expression of a non-functional rhodopsin protein is decreased by at least about 10%, at least about 20%, at least about 30%, at least about 40%, at least about 50%, at least about 60%, at least about 70%, at least about 80%, or at least about 90% in comparison to a cell where the RHO gene has not been modified of the RHO gene in the cells of the population.

120. The method of Set II embodiment 114 or Set II embodiment 115, wherein the RHO gene of the cells of the population is modified such that at least about 10%, at least about 20%, at least about 30%, at least about 40%, at least about 50%, at least about 60%, at least about 70%, at least about 80%, or at least about 90% of the modified cells do not express a detectable level of non-functional rhodopsin protein.

121. The method of any one of Set II embodiments 104-120, wherein the cells are eukaryotic.

122. The method of Set II embodiment 121, wherein the eukaryotic cells are selected from the group consisting of rodent cells, mouse cells, rat cells, and non-human primate cells.

123. The method of Set II embodiment 121, wherein the eukaryotic cells are human cells.

124. The method of Set II embodiment 121-123, wherein the eukaryotic cells are selected from the group consisting of a neuron, a rod photoreceptor cell, a retinal progenitor cell, a pluripotent stem cell (iPSC), a fibroblast, and a Miller glial cell.

125. The method of any one of Set II embodiment 104-124, wherein the modifying of the RHO gene target nucleic acid sequence of the population of cells occurs in vitro or ex vivo.

126. The method of Set II embodiments 104-124, wherein the modifying of the RHO gene target nucleic acid sequence of the population of cells occurs in vivo in a subject.

127. The method of Set II embodiment 126, wherein the subject is selected from the group consisting of a rodent, a mouse, a rat, and a non-human primate.

128. The method of Set I1 embodiment 126, wherein the subject is a human.

129. The method of any one of Set II embodiments 126-128, wherein the method comprises administering a therapeutically effective dose of an AAV vector to the subject.

130. The method of Set II embodiment 129, wherein the AAV vector is administered to the subject at a dose of at least about $1\times10^5$ vector genomes (vg), at least about $1\times10^5$ vector genomes (vg)/kg, at least about $1\times106$ vg/kg, at least about $1\times10^7$ vg/kg, at least about $1\times10^8$ vg/kg, at least about $1\times109$ vg/kg, at least about $1\times10^{10}$ vg/kg, at least about $1\times10^{11}$ vg/kg, at least about $1\times10^{12}$ vg/kg, at least about $1\times10^{13}$ vg/kg, at least about $1\times10^{14}$ vg/kg, at least about $1\times10^{15}$ vg/kg, or at least about $1\times10^{16}$ vg/kg.

131. The method of Set II embodiment 129, wherein the AAV vector is administered to the subject at a dose of at least about $1\times10^5$ vg/kg to about $1\times10^{16}$ vg/kg, at least about $1\times10^6$ vg/kg to about $1\times10^{15}$ vg/kg, at least about $1\times10^7$ vg/kg to about $1\times10^{14}$ vg/kg, at least about $1\times10^8$ vg/kg to about $1\times10^{13}$ vg/kg, at least about $1\times10^9$ vg/kg to about $1\times10^{12}$ vg/kg, or at least about $1\times10^{10}$ vg/kg to about $1\times10^{11}$ vg/kg.

132. The method of any one of Set II embodiments 126-128, wherein the method comprises administering a therapeutically effective dose of a VLP to the subject.

133. The method of Set II embodiment 132, wherein the VLP is administered to the subject at a dose of at least about $1\times10^5$ particles/kg, at least about $1\times10^6$ particles/kg, at least about $1\times10^7$ particles/kg, at least about $1\times10^8$ particles/kg, at least about $1\times10^9$ particles/kg, at least about $1\times10^{10}$ particles/kg, at least about $1\times10^{11}$ particles/kg, at least about $1\times10^{12}$ particles/kg, at least about $1\times10^{13}$ particles/kg, at least about $1\times10^{14}$ particles/kg, at least about $1\times10^{15}$ particles/kg, at least about $1\times10^{16}$ particles/kg.

134. The method of Set II embodiment 132, wherein the VLP is administered to the subject at a dose of at least about $1\times10^5$ particles/kg to about $1\times10^{16}$ particles/kg, at least about $1\times10^6$ particles/kg to about $1\times10^{15}$ particles/kg, at least about $1\times10^7$ particles/kg to about $1\times10^9$ particles/kg, at least about $1\times10^{12}$ particles/kg to about $1\times10^{10}$ particles/kg, at least about $1\times10^9$ particles/kg to about $1\times10^{12}$ particles/kg, at least about $1\times10^{10}$ particles/kg to about $1\times10^{11}$ particles/kg.

135. The method of any one of Set II embodiments 127-134 wherein the vector or VLP is administered to one or both eyes of the subject by a route of administration selected from intraocular, intravitreal, subretinal, or suprachoroidal injection or implantation.

136. The method of any one of Set II embodiments 104-134, further comprising contacting the RHO target nucleic acid sequence of the population of cells with:
  a. an additional CRISPR nuclease and a gNA targeting a different or overlapping portion of the RHO target nucleic acid compared to the first gNA;
  b. a polynucleotide encoding the additional CRISPR nuclease and the gNA of (a);
  c. a vector comprising the polynucleotide of (b); or
  d. a VLP comprising the additional CRISPR nuclease and the gNA of (a);
wherein the contacting results in modification of the RHO gene at a different location in the sequence compared to the sequence targeted by the first gNA.

137. The method of Set II embodiment 136, wherein the additional CRISPR nuclease is a CasX protein having a sequence different from the CasX protein of any of the preceding Set 11 embodiments.

138. The method of Set II embodiment 136, wherein the additional CRISPR nuclease is not a CasX protein.

139. The method of Set I embodiment 138, wherein the additional CRISPR nuclease is selected from the group consisting of Cas9, Cas12a, Cas12b, Cas12c, Cas12d (CasY), Cas12J, Cas13a. Cas13b, Cas13c. Cas13d, CasX, CasY, Cas14, Cpf1, C2cl, Csn2, Cas Phi, and sequence variants thereof.

140. A population of cells modified by the method of any one of Set II embodiments 104-139, wherein the cells have been modified such that at least 70%, at least 75%, at least 80%, at least 85%, at least 90%, or at least 95% of the modified cells do not express a detectable level of non-functional rhodopsin protein.

141. A population of cells modified by the method of any one of Set II embodiments 104-139, wherein the mutation of the RHO target nucleic acid is corrected or compensated for in the modified cells of the population, resulting in expression of a functional rhodopsin protein by the modified cells.

142. The population of cells of Set II embodiment 141, wherein the cells have been modified such that expression of a functional rhodopsin protein is increased by at least about 10%, at least about 20%, at least about 30%, at least about 40%, at least about 50%, at least about 60%, at least about 70%, at least about 80%, or at least about 90% in comparison to a cell where the RHO gene has not been modified.

143. The population of cells of any one of Set II embodiment 140-142, wherein the cells are selected from the group consisting of a neuron, a rod photoreceptor cell, a retinal progenitor cell, a pluripotent stem cell (iPSC), a fibroblast, and a Miller glial cell.

144. A method of treating a RHO-related disease in a subject in need thereof, the method comprising administering to one or both eyes of the subject a therapeutically effective amount of the cells of any one of Set II embodiments 140-143.

145. The method of Set II embodiment 144, wherein the RHO-related disease is retinitis pigmentosa.

146. The method of Set I1 embodiment 144 or Set II embodiment 145, wherein the subject is selected from the group consisting of a rodent, a mouse, a rat, and a non-human primate.

147. The method of any one of Set II embodiments 144-146, wherein the subject is a human.

148. The method of any one of Set II embodiments 144-147, wherein the cells are autologous with respect to the subject to be administered the cells.

149. The method of any one of Set II embodiments 144-147 wherein the cells are allogeneic with respect to the subject to be administered the cells.

150. The method of any one of Set II embodiments 144-149, wherein the cells are administered by a route of administration selected from intraocular, intravitreal, subretinal, or suprachoroidal injection or implantation.

151. A method of treating a RHO-related disease in a subject in need thereof, comprising modifying a RHO gene having one or more mutations in eye cells of the subject, the modifying comprising contacting said cells in one or both eyes with a therapeutically effective dose of;
  a. the composition of any one of Set II embodiments 1-84;
  b. the nucleic acid of any one of Set II embodiments 85-88;
  c. the vector as in any one of Set II embodiments 89-95;
  d. the VLP of any one of Set II embodiments 96-101: or
  e. combinations of two or more of (a)-(d),
wherein the RHO gene of the cells targeted by the first gNA is modified by the CasX protein.

152. The method of Set II embodiment 151, wherein the modifying comprises introducing a single-stranded break in the RHO gene of the cells.

153. The method of Set II embodiment 151, wherein the modifying comprises introducing a double-stranded break in the RHO gene of the cells.

154. The method of any one of Set II embodiments 151-153, further comprising introducing into the cells of the subject a second gNA or a nucleic acid encoding the second gNA, wherein the second gNA has a targeting sequence complementary to a different or overlapping portion of the target nucleic acid compared to the first gNA, resulting in an additional break in the RHO target nucleic acid of the cells of the subject.

155. The method of any one of Set II embodiments 151-153, wherein the modifying comprises introducing an insertion, deletion, substitution, duplication, or inversion of one or more nucleotides in the RHO gene of the cells.

156. The method of any one of Set II embodiments 151-154, wherein the modifying comprises insertion of the donor template into the break site(s) of the RHO gene target nucleic acid sequence of the cells.

157. The method of Set II embodiment 156, wherein the insertion of the donor template is mediated by homology-directed repair (HDR) or homology-independent targeted integration (HITI).

158. The method of any one of Set II embodiments 151-157, wherein the modifying results in a correction of or compensation for the mutation(s) in the RHO gene in the modified cells of the subject.

159. The method of Set II embodiment 158, wherein correction of the mutation results in expression of functional rhodopsin protein by the modified cells of the subject.

160. The method of Set II embodiment 158 or Set II embodiment 159, wherein the RHO gene of the modified cells express increased levels of a functional rhodopsin protein, wherein the increase is at least about 10%, at least about 20%, at least about 30%, at least about 40%, at least about 50%, at least about 60%, at least about 70%, at least about 80%, or at least about 90% in comparison to a cell with a RHO gene that has not been modified.

161. The method of any one of Set II embodiments 151-157, wherein the modifying results in a knocking down or knocking out the RHO gene in the modified cells of the subject such that at least about 10%, at least about 20%, at least about 30%, at least about 40%, at least about 50%, at least about 60%, at least about 70%, at least about 80%, or at least about 90% of the modified cells do not express a detectable level of non-functional rhodopsin protein.

162. The method of any one of Set II embodiments 151-157, wherein the modifying results in a knocking down or knocking out the RHO gene in the modified cells of the subject such that expression of non-functional rhodopsin protein in the subject is decreased by at least about 10%, at least about 20%, at least about 30%, at least about 40%, at least about 50%, at least about 60%, at least about 70%, at least about 80%, or at least about 90% in comparison to a subject where the RHO gene has not been modified.

163. The method of any one of Set II embodiments 151-162, wherein the subject is selected from the group consisting of rodent, mouse, rat, and non-human primate.

164. The method of any one of Set II embodiments 151-162, wherein the subject is a human.

165. The method of any one of Set II embodiments 151-162, wherein the cells that are modified are selected from the group consisting of a neuron, a rod photoreceptor cell, a retinal progenitor cell, a pluripotent stem cell (iPSC), a fibroblast, and a Müller glial cell.

166. The method of any one of Set II embodiments 151-164, wherein the RHO-related disease is retinitis pigmentosa.

167. The method of any one of Set II embodiments 151-166, wherein the vector is administered to the subject at a therapeutically-effective dose.

168. The method of any one of Set II embodiments 151-167, wherein the vector is an AAV, and is administered to the subject at a dose of at least $1 \times 10^5$ vector genomes (vg), at least about $1 \times 10^5$ vector genomes (vg)/kg, at least about $1 \times 10^6$ vg/kg, at least about $1 \times 10^7$ vg/kg, at least about $1 \times 10^8$ vg/kg, at least about $1 \times 10^9$ vg/kg, at least about $1 \times 10^{10}$ vg/kg, at least about $1 \times 10^{11}$ vg/kg, at least about $1 \times 10^{12}$ vg/kg, at least about $1 \times 10^{13}$ vg/kg, at least about $1 \times 10^{14}$ vg/kg, at least about $1 \times 10^{15}$ vg/kg, or at least about $1 \times 10^{16}$ vg/kg.

169. The method of any one of Set II embodiments 151-167, wherein the vector is an AAV, and is administered to the subject at a dose of at least about $1 \times 10^5$ vg/kg to about $1 \times 10^{16}$ vg/kg, at least about $1 \times 10^6$ vg/kg to about $1 \times 10^{15}$ vg/kg, at least about $1 \times 10^7$ vg/kg to about $1 \times 10^{14}$ vg/kg, at least about $1 \times 10^8$ vg/kg to about $1 \times 10^{13}$ vg/kg, at least about $1 \times 10^9$ vg/kg to about $1 \times 10^{12}$ vg/kg, or at least about $1 \times 10^{10}$ vg/kg to about $1 \times 10^{11}$ vg/kg.

170. The method of any one of Set II embodiments 151-166, wherein the VLP is administered to the subject at a therapeutically-effective dose.

171. The method of Set II embodiment 170, wherein the VLP is administered to the subject at a dose of at least about $1 \times 10^7$ particles/kg, at least about $1 \times 10^6$ particles/kg, at least about $1 \times 10^7$ particles/kg, at least about $1 \times 10^8$ particles/kg, at least about $1 \times 10^9$ particles/kg, at least about $1 \times 10^{10}$ particles/kg, at least about $1 \times 10^{11}$ particles/kg, at least about $1 \times 10^{12}$ particles/kg, at least about $1 \times 10^{13}$ particles/kg, at least about $1 \times 10^{14}$ particles/kg, at least about $1 \times 10^{15}$ particles/kg, at least about $1 \times 10^{16}$ particles/kg.

172. The method of Set II embodiment 170, wherein the VLP is administered to the subject at a dose of at least about $1 \times 10^5$ particles/kg to about $1 \times 10^{16}$ particles/kg, at least about $1 \times 10^6$ particles/kg to about $1 \times 10^{15}$ particles/kg, at least about $1 \times 10^7$ particles/kg to about $1 \times 10^{14}$ particles/kg, at least about $1 \times 10^8$ particles/kg to about $1 \times 10^{13}$ particles/kg, at least about $1 \times 10^9$ particles/kg to about $1 \times 10^{12}$ particles/kg, at least about $1 \times 10^{10}$ particles/kg to about $1 \times 10^{11}$ particles/kg.

173. The method of any one of Set II embodiments 167-172, wherein the vector or VLP is administered to one or both eyes of the subject by a route of administration selected from intraocular, intravitreal, subretinal, or suprachoroidal injection or implantation.

174. The method of any one of Set II embodiments 151-173, wherein the method results in improvement in at least one clinically-relevant endpoint selected from the group consisting of mean change or mean rate of change in: 1) best corrected visual acuity (BCVA); 2) visual field sensitivity (including analysis of hill of vision volumes); 3) retinal sensitivity measured by full-field stimulus testing (FST): 4) multiluminance mobility tests; 5) electrophysiological measures of retinal function; 6) optical coherence tomography (OCT) documenting the rate of photoreceptor loss; and 7) hypo- or hyperfluorescent lesion size on fundus autofluorescence: 8) color vision; 9) contrast sensitivity: 10) gaze tracking: 11) light aversion: 12) macular sensitivity.

175. The method of any one of Set II embodiments 151-173, wherein the method results in improvement in at least two clinically-relevant endpoints selected from the group consisting of mean change or mean rate of change in: 1) best corrected visual acuity (BCVA): 2) visual field sensitivity (including analysis of hill of vision volumes): 3) retinal sensitivity measured by full-field stimulus testing (FST): 4) multiluminance mobility tests; 5) electrophysiological measures of retinal function: 6) optical coherence tomography (OCT) documenting the rate of photoreceptor loss; and 7) hypo- or hyperfluorescent lesion size on fundus autofluorescence; 8) color vision: 9) contrast sensitivity; 10) gaze tracking; I I) light aversion: 12) macular sensitivity.

176. The composition of Set II embodiment 1, wherein the target nucleic acid sequence is complementary to a non-target strand sequence located 1 nucleotide 3' of a protospacer adjacent motif (PAM) sequence.

177. The composition of Set II embodiment 176, wherein the PAM sequence comprises a TC motif.

178. The composition of Set II embodiment 177, wherein the PAM sequence comprises ATC, GTC, CTC or TTC.

179. The composition of any one of Set II embodiments 176-178, wherein the Class 2 Type V CRISPR protein comprises a RuvC domain.

180. The composition of Set II embodiment 179, wherein the RuvC domain generates a staggered double-stranded break in the target nucleic acid sequence.

181. The composition of any one of Set II embodiments 176-180, wherein the Class 2 Type V CRISPR protein does not comprise an HNH nuclease domain.

182. A composition of any one of Set II embodiments 1-84 or Set II embodiments 176-181; a nucleic acid of any one of Set II embodiments 85-88; a vector of any one of Set II embodiments 89-95: a VLP of any one of Set II embodiments %-101; or combinations thereof, for use as a medicament for the treatment of a RHO-related disease.

The present description sets forth numerous exemplary configurations, methods, parameters, and the like. It should be recognized, however, that such description is not intended as a limitation on the scope of the present disclosure, but is instead provided as a description of exemplary embodiments.

EXAMPLES

Example 1: Creation, Expression and Purification of CasX Stx2

1. Growth and Expression

An expression construct for CasX Stx2 (also referred to herein as CasX2), derived from Planctomycetes (having the amino acid sequence of SEQ ID NO: 2 and encoded by the sequence of the Table 5, below), was constructed from gene fragments (Twist Biosciences) that were codon optimized for *E. coli*. The assembled construct contains a TEV-cleavable, C-terminal, TwinStrep tag and was cloned into a pBR322-derivative plasmid backbone containing an ampicillin resistance gene. The expression construct was transformed into chemically competent BL21* (DE3) *E. coli* and a starter culture was grown overnight in LB broth supplemented with carbenicillin at 37° C., 200 RPM, in UltraYield Flasks (Thomson Instrument Company). The following day, this culture was used to seed expression cultures at a 1:100 ratio (starter culture:expression culture). Expression cultures were Terrific Broth (Novagen) supplemented with carbenicillin and grown in UltraYield flasks at 37C, 200 RPM. Once the cultures reached an OD of 2, they were chilled to 16-C and IPTG (isopropyl β-D-1-thiogalactopyranoside) was added to a final concentration of 1 mM, from a 1 M stock. The cultures were induced at 16 C, 200 RPM for 20 hours before being harvested by centrifugation at 4,000×g for 15 minutes, 4° C. The cell paste was weighed and resuspended in lysis buffer (50 mM HEPES-NaOH, 250 mM NaCl, 5 mM $MgCl_2$, 1 mM TCEP, 1 mM benzamidine-HCL, 1 mM PMSF, 0.5% CHAPS, 10% glycerol, pH 8) at a ratio of 5 mL of lysis buffer per gram of cell paste. Once resuspended, the sample was frozen at −80° C. until purification.

TABLE 5

DNA sequence of CasX Stx2 construct

| Construct | DNA Sequence |
|---|---|
| SV40 NLS-CasX-SV40 NILS-TEV cleavage site - TwinStrep tag | (SEQ ID NO: 236) |

2. Purification

Frozen samples were thawed overnight at 4° C. with magnetic stirring. The viscosity of the resulting lysate was reduced by sonication and lysis was completed by homogenization in three passes at 17 k PSI using an Emulsiflex C3 (Avestin). Lysate was clarified by centrifugation at 50,000× g, 4° C., for 30 minutes and the supernatant was collected. The clarified supernatant was applied to a Heparin 6 Fast Flow column (GE Life Sciences) by gravity flow. The column was washed with 5 CV of Heparin Buffer A (50 mM HEPES-NaOH, 250 mM NaCl, 5 mM $MgCl_2$, 1 mM TCEP, 10% glycerol. pH 8), then with 5 CV of Heparin Buffer B (Buffer A with the NaCl concentration adjusted to 500 mM). Protein was eluted with 5 CV of Heparin Buffer C (Buffer A with the NaCl concentration adjusted to 1 M), collected in fractions. Fractions were assayed for protein by Bradford Assay and protein-containing fractions were pooled. The pooled heparin eluate was applied to a Strep-Tactin XT Superflow column (IBA Life Sciences) by gravity flow. The column was washed with 5 CV of Strep Buffer (50 mM HEPES-NaOH, 500 mM NaCl, 5 mM $MgCl_2$, 1 mM TCEP, 10% glycerol, pH 8). Protein was eluted from the column using 5 CV of Strep Buffer with 50 mM D-Biotin added and collected in fractions. CasX-containing fractions were pooled, concentrated at 4° C. using a 30 kDa cut-off spin concentrator, and purified by size exclusion chromatography on a Superdex 200 pg column (GE Life Sciences). The column was equilibrated with SEC Buffer (25 mM sodium phosphate, 300 mM NaCl, 1 mM TCEP, 10% glycerol, pH 7.25) operated by an AKTA Pure FPLC system (GE Life Sciences). CasX-containing fractions that eluted at the appropriate molecular weight were pooled, concentrated at 4° C. using a 30 kDa cut-off spin concentrator, aliquoted, and snap-frozen in liquid nitrogen before being stored at −80° C.

3. Results

Figure 2:
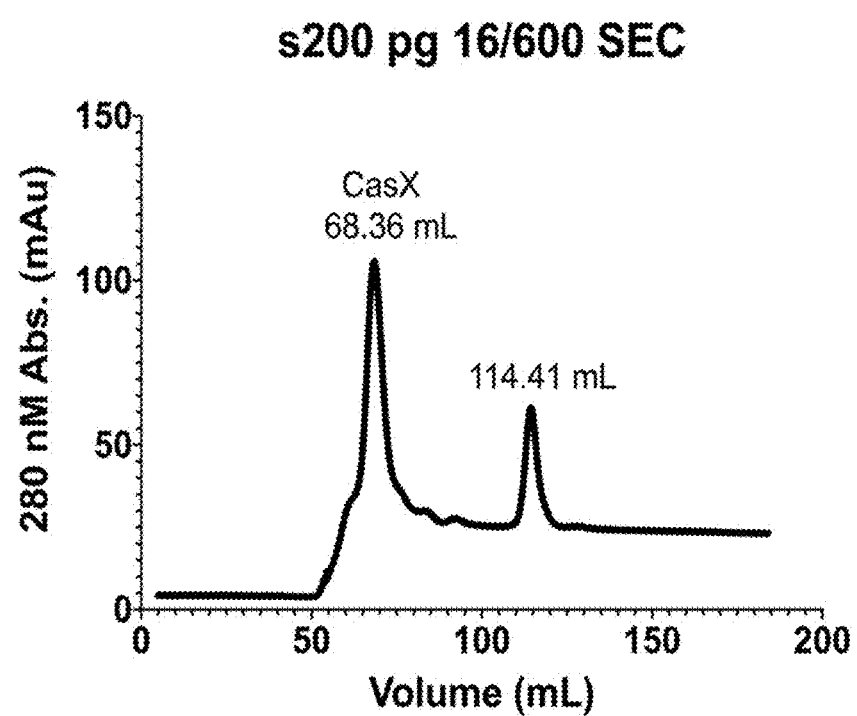
FIG. 2 shows the chromatogram from a size exclusion chromatography assay of the StX2, using of Superdex 200 16/600 pg Gel Filtration, as described in Example 1.
Figure 3:
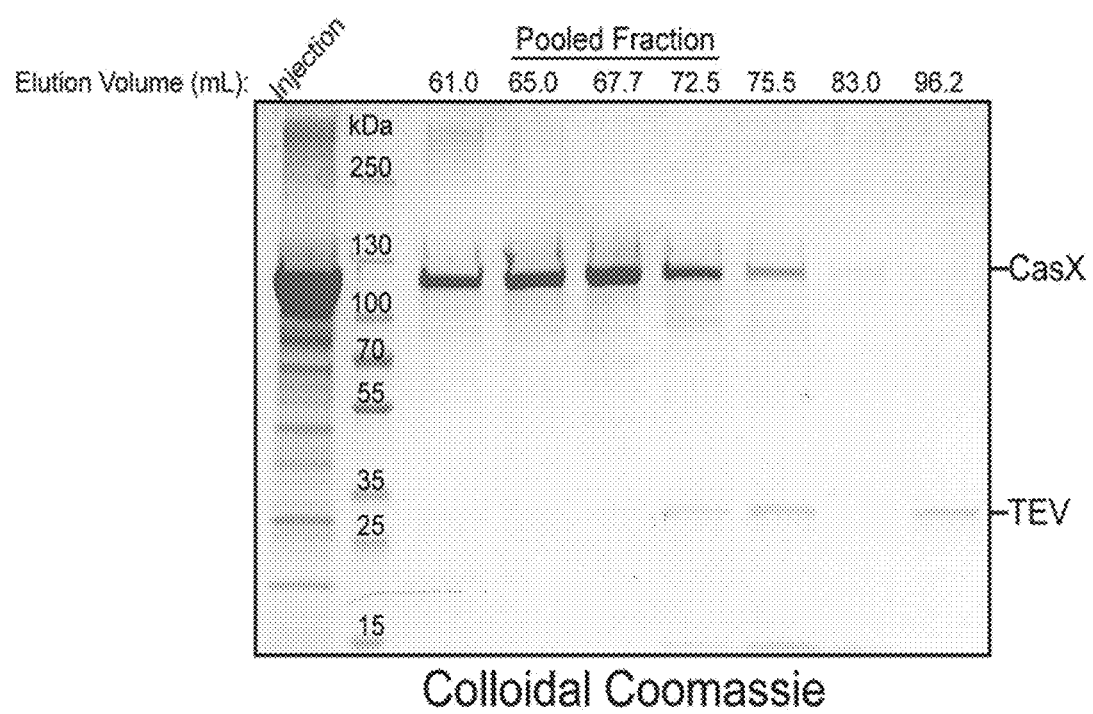
FIG. 3 shows an SDS-PAGE gel of StX2 purification fractions visualized by colloidal Coomassie staining, as described in Example 1.

Samples from throughout the purification were resolved by SDS-PAGE and visualized by colloidal Coomassie staining, as shown in FIG. 1 and FIG. 3. In FIG. 1, the lanes, from left to right, are: molecular weight standards, Pellet: insoluble portion following cell lysis, Lysate: soluble portion following cell lysis, Flow Thru: protein that did not bind the Heparin column, Wash: protein that eluted from the column in wash buffer, Elution: protein eluted from the heparin column with elution buffer, Flow Thru: Protein that did not bind the StrepTactinXT column, Elution: protein eluted from the StrepTactin XT column with elution buffer, Injection: concentrated protein injected onto the s200 gel filtration column, Frozen: pooled fractions from the s200 elution that have been concentrated and frozen. In FIG. 3, the lanes from right to left, are the injection (sample of protein injected onto the gel filtration column,) molecular weight markers, lanes 3-9 are samples from the indicated elution volumes. Results from the gel filtration are shown in FIG. 2. The 68.36 mL peak corresponds to the apparent molecular weight of CasX and contained the majority of CasX protein. The average yield was 0.75 mg of purified CasX protein per liter of culture, with 75% purity, as evaluated by colloidal Coomassie staining.

Example 2: Generation of CasX 119, 438, and 457

Figure 4:
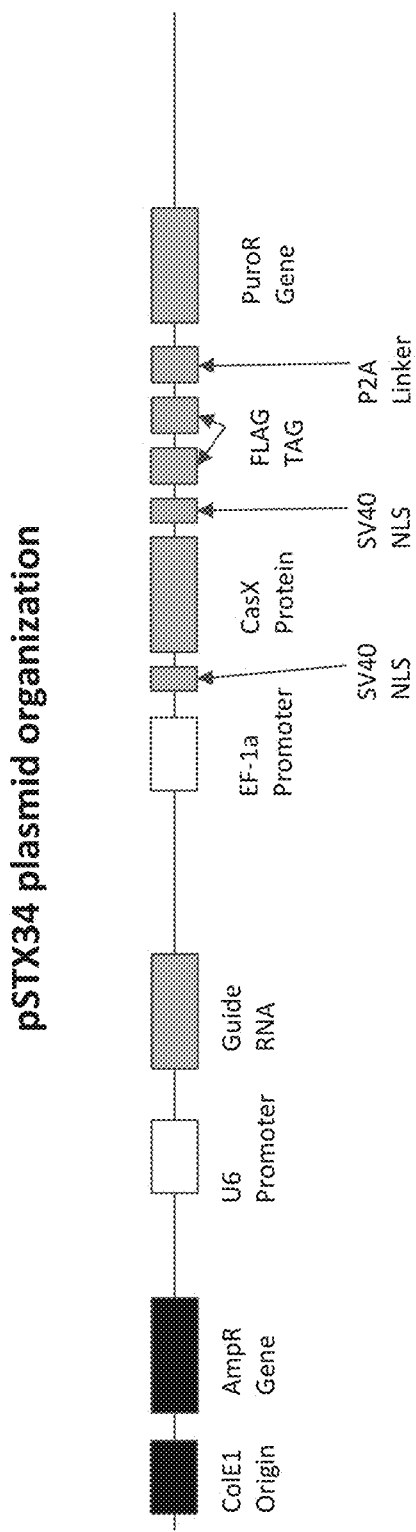
FIG. 4 is a schematic showing the organization of the components in the pSTX34 plasmid used to assemble the CasX constructs, as described in Example 2.

In order to generate the CasX 119, 438, and 457 constructs (sequences in Table 6), the codon-optimized CasX 37 construct (based on the CasX Stx2 construct of Example 1, encoding Planctomycetes CasX SEQ ID NO: 2, with a A708K substitution and a [P793] deletion with fused NLS, and linked guide and non-targeting sequences) was cloned into a mammalian expression plasmid (pStX; see FIG. 4) using standard cloning methods. To build CasX 119, the CasX 37 construct DNA was PCR amplified in two reactions using Q5 DNA polymerase (New England BioLabs Cat #M0491L) according to the manufacturer's protocol, using primers oIC539 and oIC88 as well as oIC87 and oIC540 respectively (see FIG. 5). To build CasX 457, the CasX 365 construct DNA was PCR amplified in four reactions using Q5 DNA polymerase (New England BioLabs Cat #M0491L) according to the manufacturer's protocol, using primers oIC539 and oIC212, oIC21 I and oIC376, oIC375 and oIC551, and oIC550 and oIC540 respectively. To build CasX 438, the CasX 119 construct DNA was PCR amplified in four reactions using Q5 DNA polymerase according to the manufacturer's protocol, using primers oIC539 and oIC689, oIC688 and oIC376, oIC375 and oIC551, and oIC550 and oIC540 respectively. The resulting PCR amplification products were then purified using Zymoclean™ DNA clean and concentrator (Zymo Research Cat #4014) according to the manufacturer's protocol. The pStX backbone was digested using XbaI and SpeI in order to remove the 2931 base pair fragment of DNA between the two sites in plasmid pStx34. The digested backbone fragment was purified by gel extraction from a 1% agarose gel (Gold Bio Cat #A-201-500) using Zymoclean™ Gel DNA Recovery Kit (Zymo Research Cat #D4002) according to the manufacturer's protocol. The three fragments were then pieced together using Gibson Assembly® (New England BioLabs Cat #E2621S) following the manufacturer's protocol. Assembled products in the pStx34 were transformed into chemically-competent or electro-competent Turbo Competent E. coli bacterial cells, plated on LB-Agar plates (LB: Teknova Cat #L9315, Agar: Quartzy Cat #214510) containing carbenicillin. Individual colonies were picked and miniprepped using Qiagen spin Miniprep Kit (Qiagen Cat #27104) following the manufacturer's protocol. The resultant plasmids were sequenced using Sanger sequencing to ensure correct assembly, pStX34 includes an EF-1α promoter for the protein as well as a selection marker for both puromycin and carbenicillin. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent E. coli (NEB Cat #C29841), plated on LB-Agar plates containing carbenicillin. Individual colonies were picked and miniprepped using Qiagen spin Miniprep Kit and following the manufacturer's protocol. The resultant plasmids were sequenced using Sanger sequencing to ensure correct ligation. SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods. The expression and recovery of the CasX 119, 438 and 457 proteins was performed using the general methodologies of Example 1 (however the DNA sequences were codon optimized for expression in E. coli).

Figure 6:
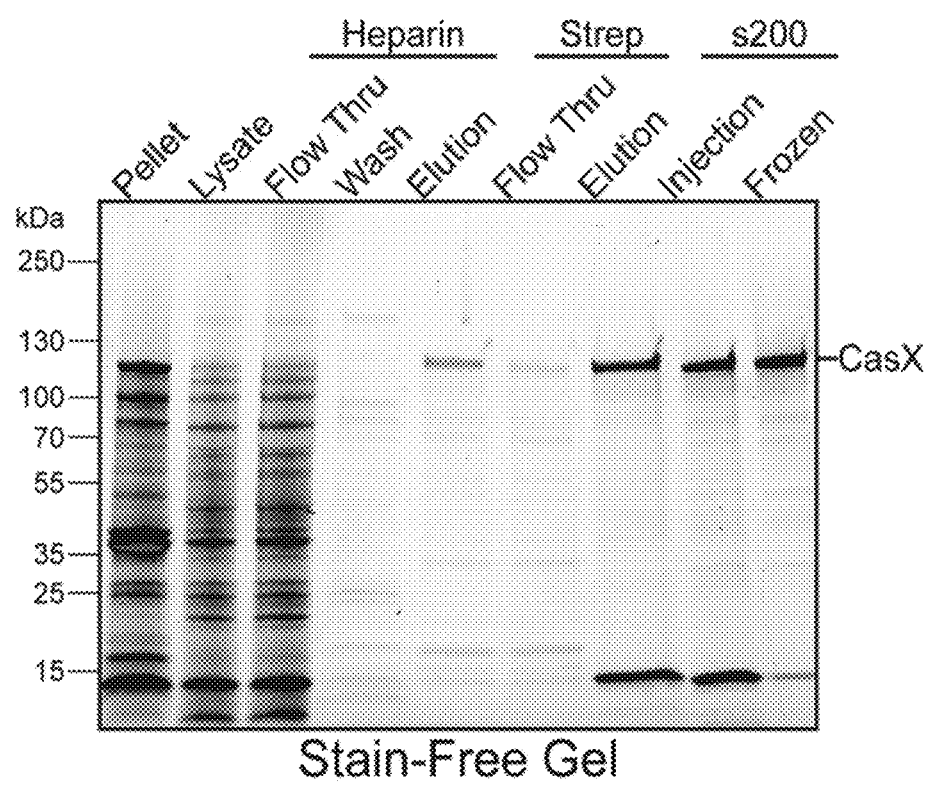
FIG. 6 shows an SDS-PAGE gel of purification samples, visualized on a Bio-Rad Stain-Free™ gel, as described in Example 2.
Figure 7:
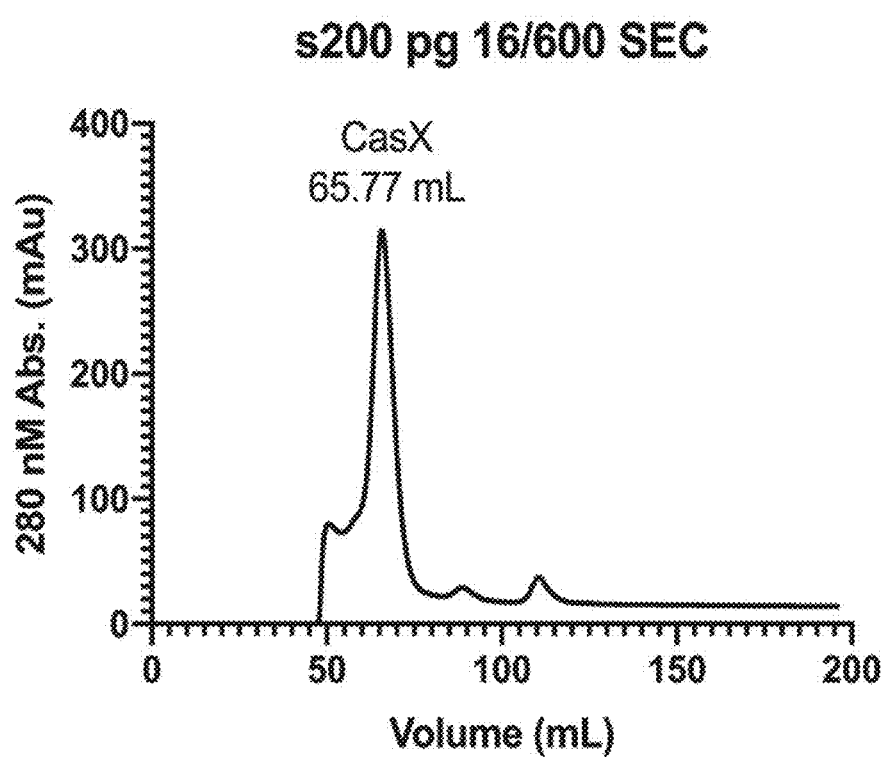
FIG. 7 shows the chromatogram of Superdex 200 16/600 pg Gel Filtration, as described in Example 2.
Figure 8:
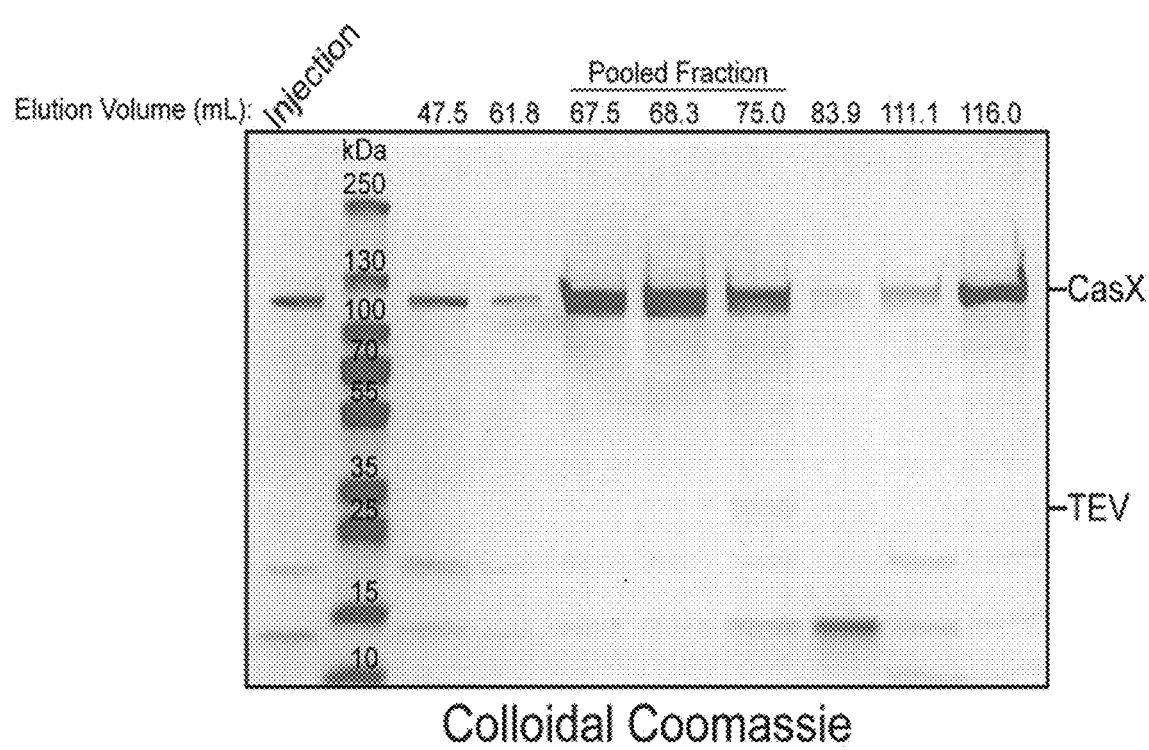
FIG. 8 shows an SDS-PAGE gel of gel filtration samples, stained with colloidal Coomassie, as described in Example 2.

CasX Variant 119: following the same expression and purification scheme for WT CasX, the following results were obtained for CasX variant 119. Samples from throughout the purification procedure were resolved by SDS-PAGE and visualized by colloidal Coomassie staining, as shown in FIG. 6 and FIG. 8. Results from the gel filtration are shown in FIG. 7. The average yield was 11.7 mg of purified CasX protein per liter of culture at 95% purity, as evaluated by colloidal Coomassie staining.

Figure 9:
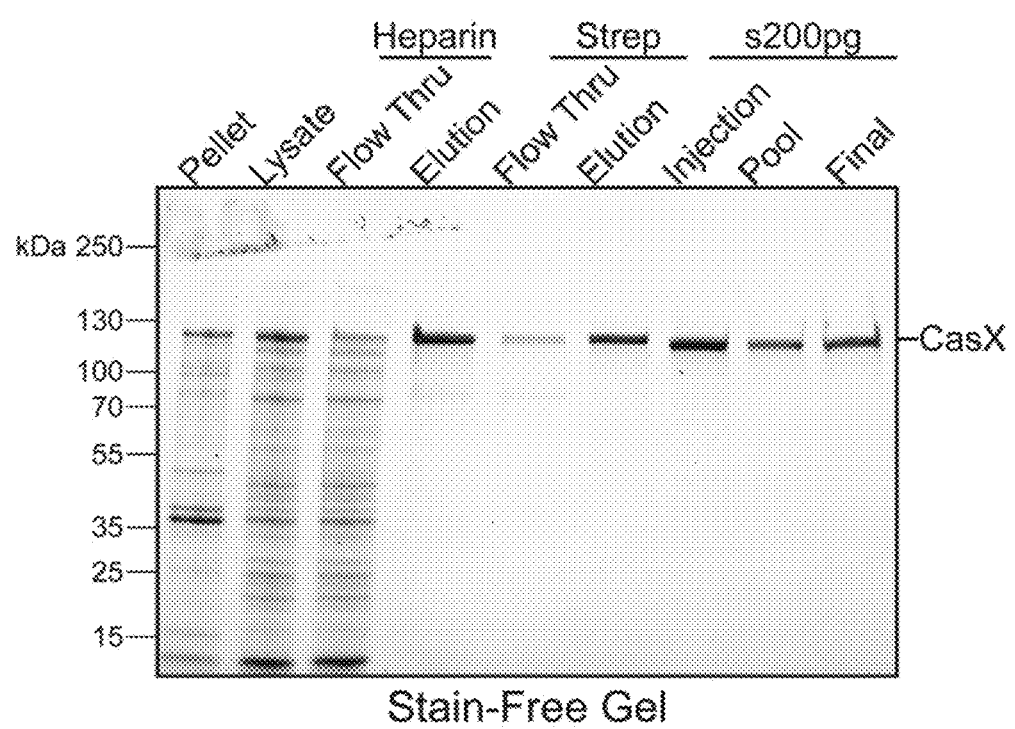
FIG. 9 shows an SDS-PAGE gel of purification samples of CasX 438, visualized on a Bio-Rad Stain-Free™ gel, as described in Example 2.
Figure 10:
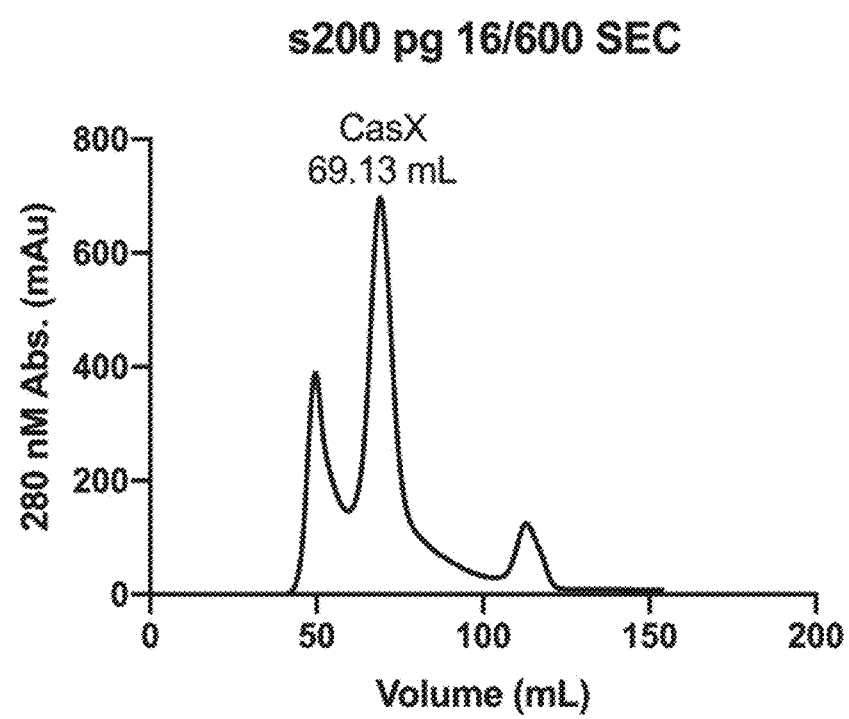
FIG. 10 shows the chromatogram from a size exclusion chromatography assay of the CasX 438, using of Superdex 200 16/600 pg gel filtration, as described in Example 2.
Figure 11:
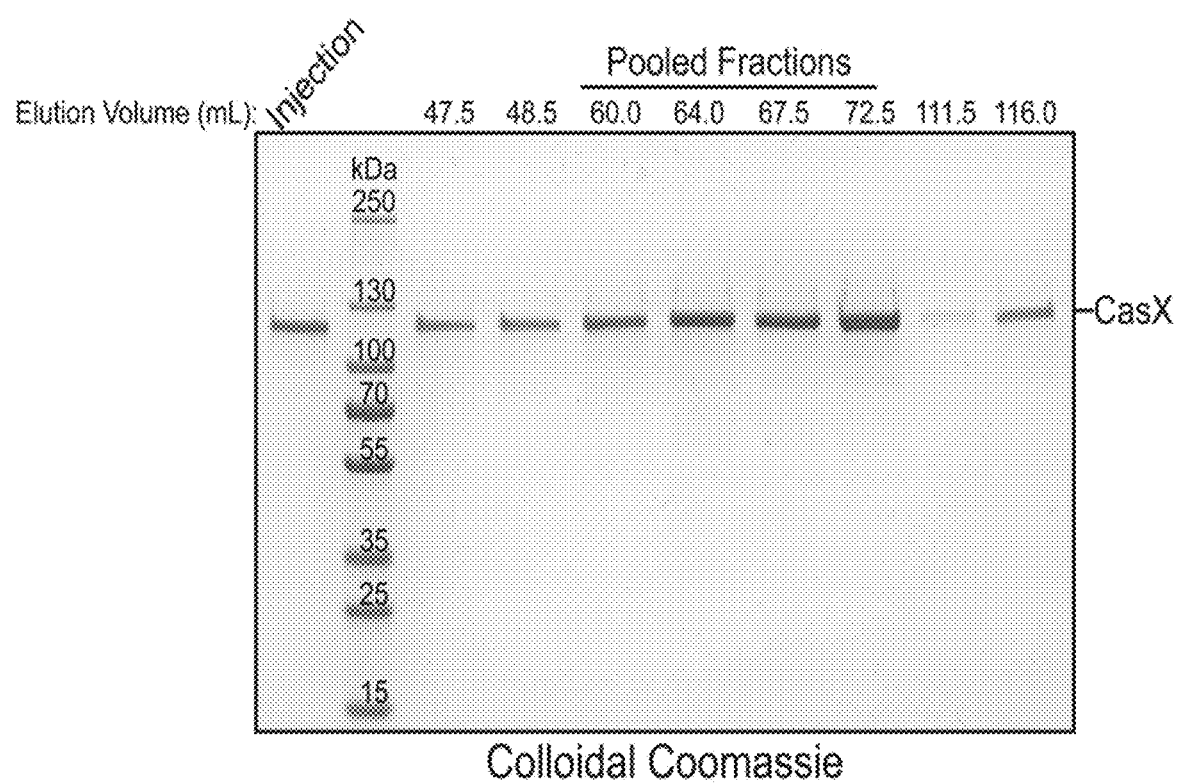
FIG. 11 shows an SDS-PAGE gel of CasX 438 purification fractions visualized by colloidal Coomassie staining, as described in Example, as described in Example 2.

CasX Variant 438: Following the same expression and purification scheme for WT CasX, the following results were obtained for CasX variant 438. Samples from throughout the purification procedure were resolved by SDS-PAGE and visualized by colloidal Coomassie staining, as shown in FIGS. 9 and 11. Results from the gel filtration are shown in FIG. 10. The average yield was 13.1 mg of purified CasX protein per liter of culture at 97.5% purity, as evaluated by colloidal Coomassie staining.

Figure 12:
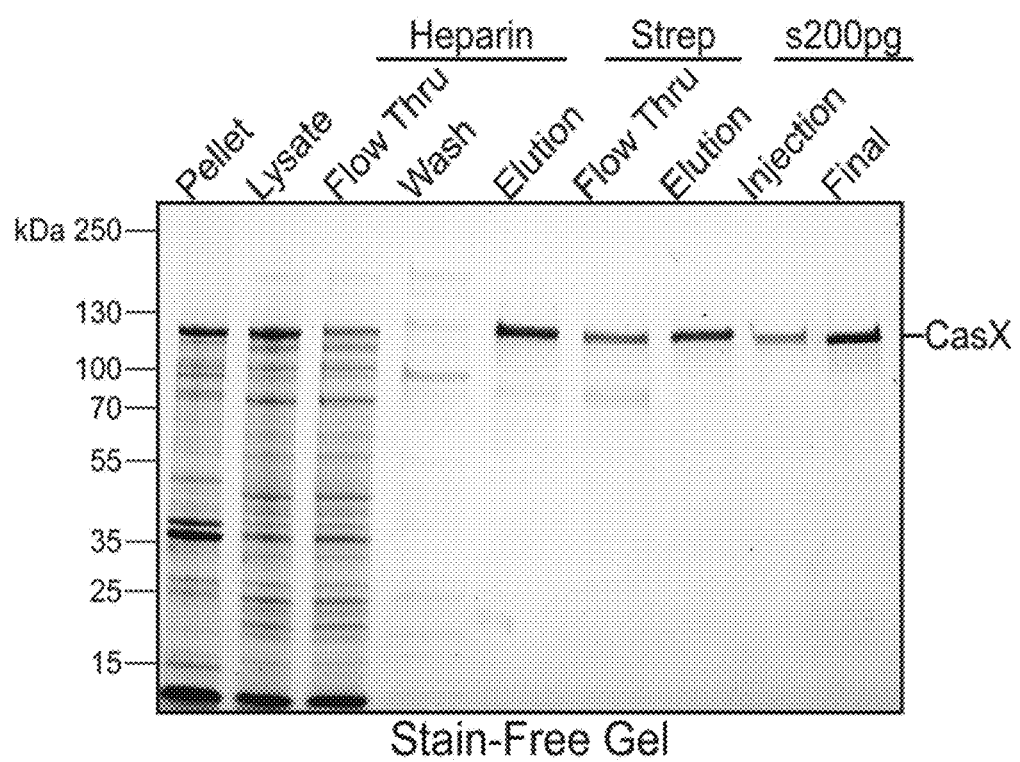
FIG. 12 shows an SDS-PAGE gel of purification samples of CasX 457, visualized on a Bio-Rad Stain-Free™ gel, as described in Example 2.
Figure 13:
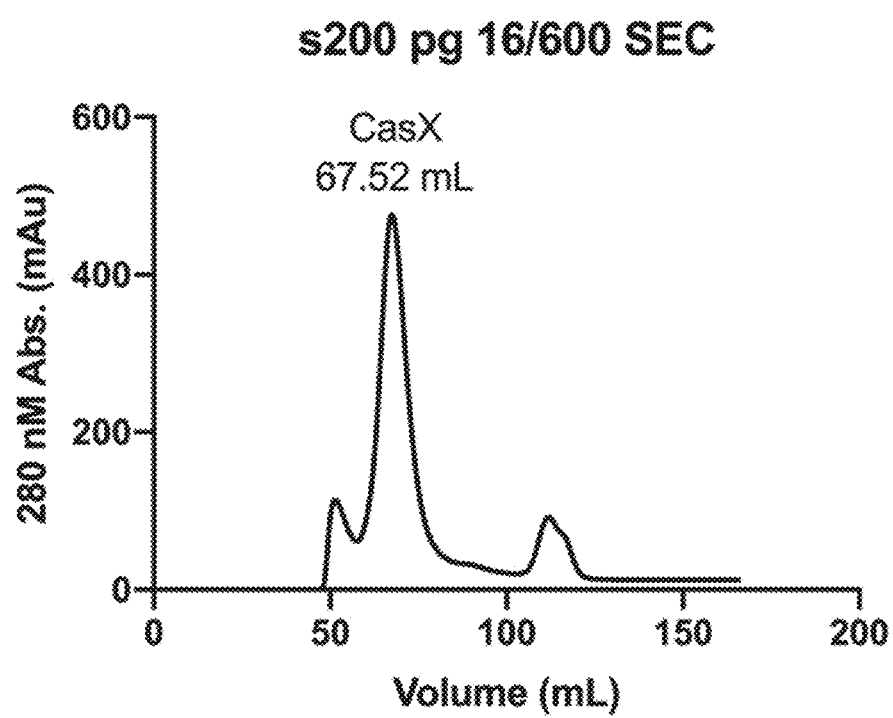
FIG. 13 shows the chromatogram from a size exclusion chromatography assay of the CasX 457, using of Superdex 200 16/600 pg gel filtration, as described in Example 2.
Figure 14:
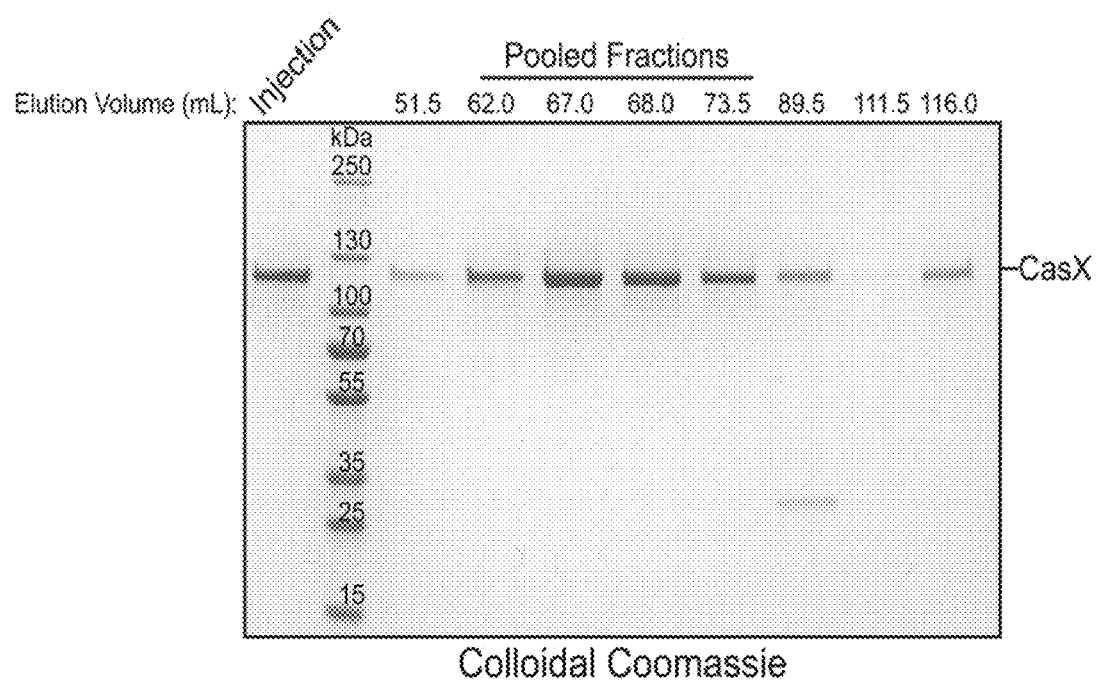
FIG. 14 shows an SDS-PAGE gel of CasX 457 purification fractions visualized by colloidal Coomassie staining, as described in Example 2.
Figure 15:
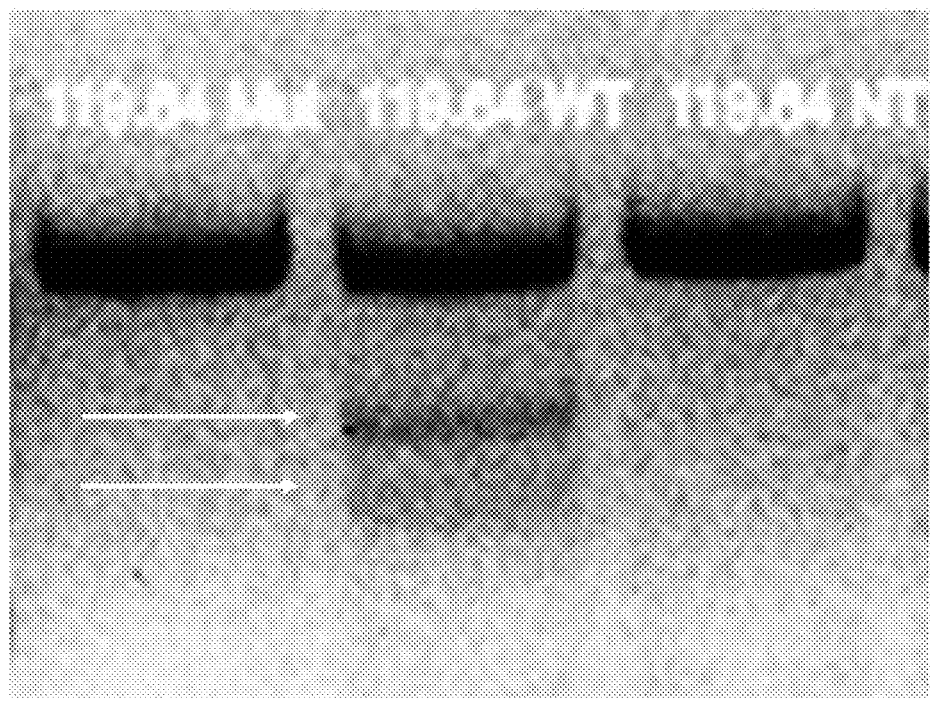
FIG. 15 is a gel image from a T7E1 assay demonstrating allele-specific editing at the wild-type RHO p23 locus in HEK293T cells (arrows, center lane), while the construct targeting the P23H mutation (left lane) as well as a non-targeting negative control (right lane) show no evidence of editing, as described in Example 18.
Figure 16:
FIG. 16 is a gel image from a T7E1 assay demonstrating allele-specific editing at the wild-type RHO p23 locus in HEK293T cells by CasX 119, guide 174 and spacer 11.1 (second lane), while the construct having the 11.2 spacer targeting the P23H mutation (third lane) shows no evidence of editing, as described in Example 18. Similarly, Cas9 constructs with appropriate WT spacers showed evidence of editing (lanes 5 and 6) while Cas9 constructs with spacers to the mutation show no evidence of editing (lanes 4 and 7).
Figure 17:
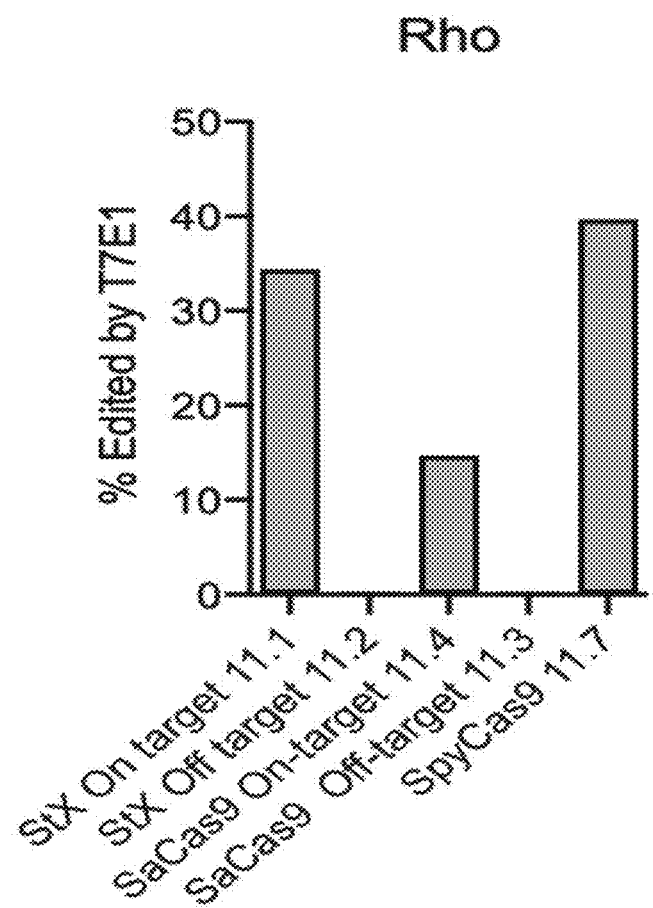
FIG. 17 is a graph quantifying the results of the T7E1 assay.

CasX Variant 457: Following the same expression and purification scheme for WT CasX, the following results were obtained for CasX variant 457. Samples from throughout the purification procedure were resolved by SDS-PAGE and visualized by colloidal Coomassie staining, as shown in FIGS. 12 and 14 and gel filtration, as shown in FIG. 13. The average yield was 9.76 mg of purified CasX protein per liter of culture at 91.6% purity, as evaluated by colloidal Coomassie staining.

Overall, the results support that CasX variants can be produced and recovered at high levels of purity sufficient for experimental assays and evaluation.

TABLE 6

Sequences of CasX 119, 438 and 457

| Construct | DNA Sequence | Amino Acid Sequence |
|---|---|---|
| CasX 119 | (SEQ ID NO: 240) | QEIKRINKIRRRLVKDSNTKKAGKTGPMKTLLVRVMTPDLR ERLENLRKKPENIPQPISNTSRANLNKLLTDYTEMKKAILHV YWEEFQKDPVGLMSRVAQPAPKNIDQRKLIPVKDGNERLTS SGFACSQCCQPLYVYKLEQVNDKGKPHTNYFGRCNVSEHER LILLSPHKPEANDELVTYSLGKFGQRALDFYSIHVTRESNHPV KPLEQIGGNSCASGPVGKALSDACMGAVASFLTKYQDIILEH QKVIKKNEKRLANLKDIASANGLAFPKITLPPQPHTKEGIEAY NNVVAQIVIWVNLNLWQKLKIGRDEAKPLQRLKGFPSFPLV ERQANEVDWWDMVCNVKKLINEKKEDGKVFWQNLAGYK RQEALRPYLSSEEDRKKGKKFARYQFGDLLLHLEKKHGED WGKVYDEAWERIDKKVEGLSKHIKLEEERRSEDAQSKAALT DWLRAKASFVIEGLKEADKDEFCRCELKLQKWYGDLRGKP FAIEAENSILDISGFSKQYNCAFIWQKDGVKKLNLYLIINYFK GGKLRFKKIKPEAFEANRFYTVINKKSGEIVPMEVNFNFDDP NLIILPLAFGKRQGREFIWNDLLSLETGSLKLANGRVIEKTLY NRRTRQDEPALFVALTFERREVLDSSNIKPMNLIGIDRGENIP AVIALTDPEGCPLSRFKDSLGNPTHILRIGESYKEKQRTIQAK KEVEQRRAGGYSRKYASKAKNLADDMVRNTARDLLYYAV TQDAMLIFENLSRGFGRQGKRTFMAERQYTRMEDWLTAKL AYEGLSKTYLSKTLAQYTSKTCSNCGFTITSADYDRVLEKLK KTATGWMTTINGKELKVEGQITYYNRYKRQNVVKDLSVEL DRLSEESVNNDISSWTKGRSGEALSLLKKRFSHRPVQEKFVC LNCGFETHADEQAALNIARSWLFLRSQEYKKYQTNKTTGNT DKRAFVETWQSFYRKKLKEVWKPAV (SEQ ID NO: 237) |

TABLE 6-continued

Sequences of CasX 119, 438 and 457

| Construct | DNA Sequence | Amino Acid Sequence |
|---|---|---|
| CasX 457 | (SEQ ID NO: 241) | QEIKRINKIRRRLVKDSNTKKAGKTGPMKTLLVRVMTPDLR ERLENLRKKPENIPQPISNTSRANLNKLLTDYTEMKKAILHV YWEEFQKDPVGLMSRVAQPAPKNIDQRKLIPVKDGNERLTS SGFACSQCCQPLYVYKLEQVNDKGKPHTNYFGRCNVSEHER LILLSPHKPEANDELVTYSLGKFGQRALDFYSIHVTRESNHPV KPLEQIGGNSCASGPVGKALSDACMGAVASFLTKYQDIILEH KKVIKKNEKRLANLKDIASANGLAFPKITLPPQPHTKEGIEAY NNVVAQIVIWVNLNLWQKLKIGRDEAKPLQRLKGFPSFPLV ERQANEVDWWDMVCNVKKLINEKKEDGKVFWQNLAGYK RQEALRPYLSSPEDRKKGKKFARYQLGDLLLHLEKKHGED WGKVYDEAWERIDKKVEGLSKHIKLEEERRSEDAQSKAALT DWLRAKASFVIEGLKEADKDEFCRCELKLQKWYGDLRGKP FAIEAENSILDISGFSKQYNCAFIWQKDGVKKLNLYLIINYFK GGKLRFKKIKPEAFEANRFYTVINKKSGEIVPMEVNFNFDDP NLIILPLAFGKRQGREFIWNDLLSLETGSLKLANGRVIEKPLY NRRTRQDEPALFVALTFERREVLDSSNIKPMNLIGVDRGENIP AVIALTDPEGCPLSRFKDSLGNPTHILRIGESYKEKQRTIQAK KEVEQRRAGGYSRKYASKAKNLADDMVRNTARDLLYYAV TQDAMLIFENLSRGFGRQGKRTFMAERQYTRMEDWLTAKL AYEGLSKTYLSKTLAQYTSKTCSNCGFTITSADYDRVLEKLK KTATGWMTTINGKELKVEGQITYYNRRKRQNVVKDLSVEL DRLSEESVNNDISSWTKGRSGEALSLLKKRFSHRPVQEKFVC LNCGFETHADEQAALNIARSWLFLRSQEYKKYQTNKTTGNT DKRAFVETWQSFYRKKLKEVWKPAV (SEQ ID NO: 238) |
| CasX 438 | (SEQ ID NO: 242) | QEIKRINKIRRRLVKDSNTKKAGKTGPMKTLLVRVMTPDLR ERLENLRKKPENIPQPISNTSRANLNKLLTDYTEMKKAILHV YWEEFQKDPVGLMSRVAQPAPKNIDQRKLIPVKDGNERLTS SGFACSQCCQPLYVYKLEQVNDKGKPHTNYFGRCNVSEHER LILLSPHKPEANDELVTYSLGKFGQRALDFYSIHVTRESNHPV KPLEQIGGNSCASGPVGKALSDACMGAVASFLTKYQDIILEH QKVIKKNEKRLANLKDIASANGLAFPKITLPPQPHTKEGIEAY NNVVAQIVIWVNLNLWQKLKIGRDEAKPLQRLKGFPSFPLV ERQANEVDWWDMVCNVKKLINEKKEDGKVFWQNLAGYK RQEALRPYLSSEEDRKKGKKFARYQLGDLLKHLEKKHGED WGKVYDEAWERIDKKVEGLSKHIKLEEERRSEDAQSKAALT DWLRAKASFVIEGLKEADKDEFCRCELKLQKWYGDLRGKP FAIEAENSILDISGFSKQYNCAFIWQKDGVKKLNLYLIINYFK GGKLRFKKIKPEAFEANRFYTVINKKSGEIVPMEVNFNFDDP NLIILPLAFGKRQGREFIWNDLLSLETGSLKLANGRVIEKTLY NRRTRQDEPALFVALTFERREVLDSSNIKPMNLIGVDRGENIP AVIALTDPEGCPLSRFKDSLGNPTHILRIGESYKEKQRTIQAK KEVEQRRAGGYSRKYASKAKNLADDMVRNTARDLLYYAV TQDAMLIFENLSRGFGRQGKRTFMAERQYTRMEDWLTAKL AYEGLSKTYLSKTLAQYTSKTCSNCGFTITSADYDRVLEKLK KTATGWMTTINGKELKVEGQITYYNRRKRQNVVKDLSVEL DRLSEESVNNDISSWTKGRSGEALSLLKKRFSHRPVQEKFVC LNCGFETHADEQAALNIARSWLFLRSQEYKKYQTNKTTGNT DKRAFVETWQSFYRKKLKEVWKPAV (SEQ ID NO: 239) |

Example 3: CasX Construct 488, 491, 515 and 527

In order to generate the CasX 488 construct (sequences in Table 7), the codon-optimized CasX 119 construct (based on the CasX Stx2 construct of Example 1, encoding Planctomycetes CasX SEQ ID NO: 2, with a A708K substitution, a L379R substitution, and a [P793] deletion with fused NLS, and linked guide and non-targeting sequences) was cloned into a destination plasmid (pStX: see FIG. 4) using standard cloning methods. In order to generate the CasX 491 construct (sequences in Table 7), the codon-optimized CasX 484 construct (based on the CasX Stx2 construct of Example 1, encoding Planctomycetes CasX SEQ ID NO: 2, with a A708K substitution, a L379R substitution, a [P793] deletion, a 1658V substitution, and a F399L substitution with fused NLS, and linked guide and non-targeting sequences) was cloned into a destination plasmid (pStX; see FIG. 4) using standard cloning methods. Construct CasX 1 (CasX SEQ ID NO: 1) was cloned into a destination vector using standard cloning methods. To build CasX 488, the CasX 119 construct DNA was PCR amplified using Q5 DNA polymerase according to the manufacturer's protocol, using primers oIC765 and oIC762 (see FIG. 5). To build CasX 491, the codon optimized CasX 484 construct DNA was PCR amplified using Q5 DNA polymerase according to the manufacturer's protocol, using primers oIC765 and oIC762 (see FIG. 5). The CasX 1 construct was PCR amplified using Q5 DNA polymerase according to the manufacturer's protocol, using primers oIC766 and oIC784. Each of the PCR products were purified by gel extraction from a 1% agarose gel (Gold Bio Cat #A-201-500) using Zymoclean™ Gel DNA Recovery Kit according to the manufacturer's protocol. The corresponding fragments were then pieced together using Gibson Assembly® (New England BioLabs Cat #E2621S) following the manufacturer's protocol. Assembled products in pStx1 were transformed into chemically-competent Turbo Competent *E. coli* bacterial cells, plated on LB-Agar plates containing kanamycin. Individual colonies were picked and miniprepped using Qiagen spin Miniprep Kit following the manufacturer's protocol. The resultant plasmids were sequenced using Sanger sequencing to ensure correct assembly. The correct clones were then subcloned into the mammalian expression vector pStx34 using restriction enzyme cloning. The pStx34 backbone and the CasX 488 and 491 clones in pStx1 were digested with XbaI and BamHI respectively. The digested backbone and respective insert fragments were purified by gel extraction from a 1% agarose gel (Gold Bio Cat #A-201-500) using Zymoclean™ Gel DNA Recovery Kit according to the manufacturer's protocol. The clean backbone and insert were then ligated together using T4 Ligase (New England Biolabs Cat #M0202L) according to the manufacturer's protocol. The ligated products were transformed into chemically-competent Turbo Competent *E. coli* bacterial cells, plated on LB-Agar plates containing carbenicillin. Individual colonies were picked and miniprepped using Qiagen spin Miniprep Kit following the manufacturer's protocol. The resultant plasmids were sequenced using Sanger sequencing to ensure correct assembly.

Figure 5:
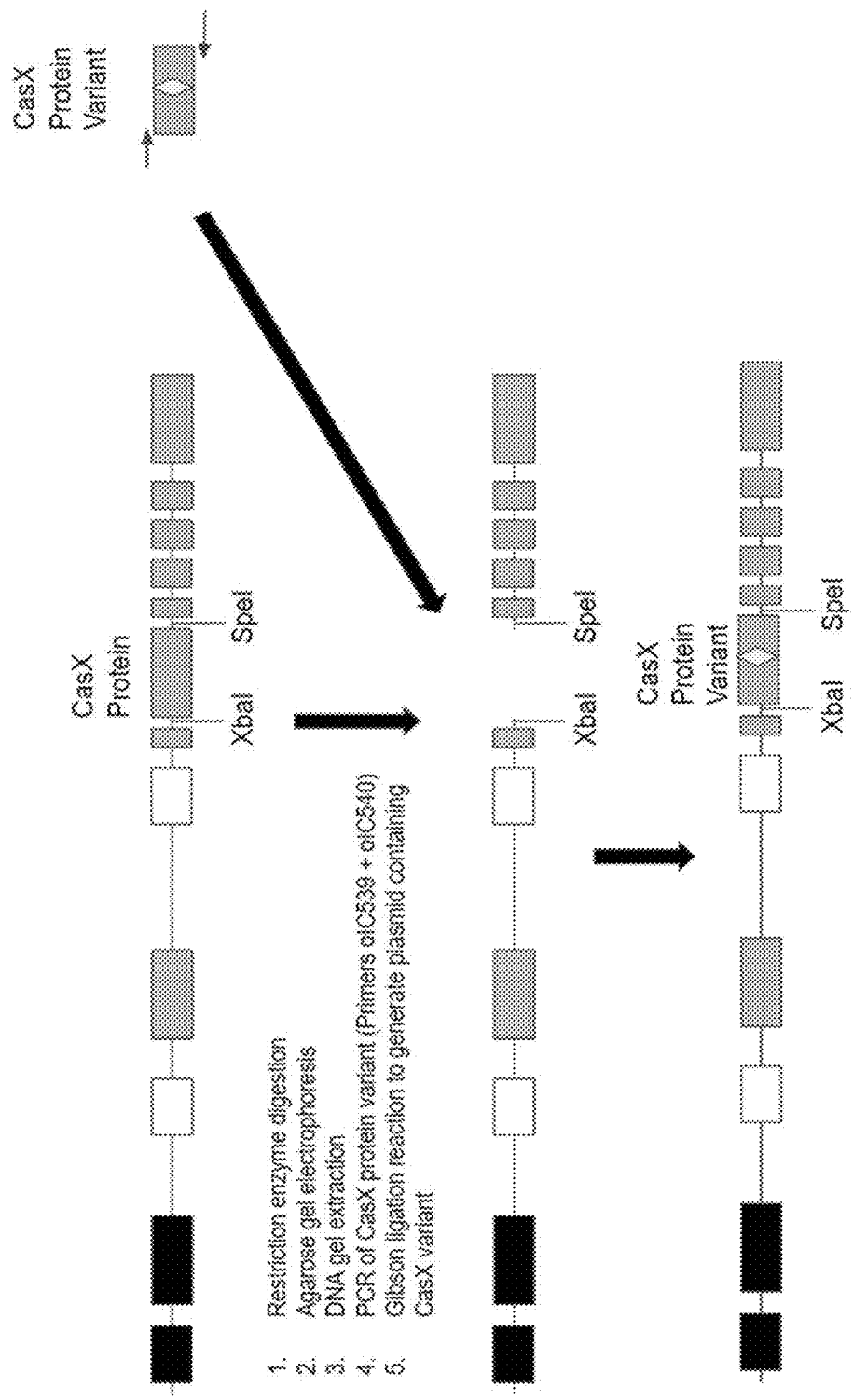
FIG. 5 is a schematic showing the steps of generating the CasX 119 variant, as described in Example 1.

To build CasX 515 (sequences in Table 7), the CasX 491 construct DNA was PCR amplified in two reactions using Q5 DNA polymerase according to the manufacturer's protocol, using primers oIC539 and oSH556 as well as oSH555 and oIC540 respectively (see FIG. 5). To build CasX 527 (sequences in Table 7), the CasX 491 construct DNA was PCR amplified in two reactions using Q5 DNA polymerase according to the manufacturer's protocol, using primers oIC539 and oSH584 as well as oSH583 and oIC540 respectively. The PCR products were purified by gel extraction from a 1% agarose gel using Zymoclean™ Gel DNA Recovery Kit according to the manufacturer's protocol. The pStX backbone was digested using XbaI and SpeI in order to remove the 2931 base pair fragment of DNA between the two sites in plasmid pStx56. The digested backbone fragment was purified by gel extraction from a 1% agarose gel using Zymoclean™ Gel DNA Recovery Kit according to the manufacturer's protocol. The insert and backbone fragments were then pieced together using Gibson Assembly® (New England BioLabs Cat #E2621S) following the manufacturer's protocol. Assembled products in the pStx56 were transformed into chemically-competent Turbo Competent *E. coli* bacterial cells, plated on LB-Agar plates containing kanamycin. Individual colonies were picked and miniprepped using Qiagen spin Miniprep Kit following the manufacturer's protocol. The resultant plasmids were sequenced using Sanger sequencing to ensure correct assembly, pStX34 includes an EF-1α promoter for the protein as well as a selection marker for both puromycin and carbenicillin, pStX56 includes an EF-1α promoter for the protein as well as a selection marker for both puromycin and kanamycin Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase and an appropriate restriction enzyme for the plasmid. Golden Gate products were transformed into chemically or electro-competent cells such as NEB Turbo competent *E. coli* (NEB Cat #C2984I), plated on LB-Agar plates containing the appropriate antibiotic. Individual colonies were picked and miniprepped using QIAprep® Spin Miniprep Kit and following the manufacturer's protocol. The resultant plasmids were sequenced using Sanger sequencing to ensure correct ligation. SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods. The expression and recovery of the CasX constructs was performed using the general methodologies of Example 1 and are summarized as follows:

CasX variant 488: following the same expression and purification scheme for WT CasX, the following results were obtained for CasX variant 488. Samples from throughout the purification procedure were resolved by SDS-PAGE and visualized by colloidal Coomassie staining, as well as resolved by gel filtration. The average yield was 2.7 mg of purified CasX protein per liter of culture at 98.8% purity, as evaluated by colloidal Coomassie staining.

CasX Variant 491: following the same expression and purification scheme for WT CasX, the following results were obtained for CasX variant 488. Samples from throughout the purification procedure were resolved by SDS-PAGE and visualized by colloidal Coomassie staining, as well as resolved by gel filtration. The average yield was 12.4 mg of purified CasX protein per liter of culture at 99.4% purity, as evaluated by colloidal Coomassie staining.

CasX variant 515: following the same expression and purification scheme for WT CasX, the following results were obtained for CasX variant 488. Samples from throughout the purification procedure were resolved by SDS-PAGE and visualized by colloidal Coomassie staining, as well as resolved by gel filtration. The average yield was 7.8 mg of purified CasX protein per liter of culture at 87.2% purity, as evaluated by colloidal Coomassie staining.

TABLE 7

Sequences of CasX 488, 491, 515 and 527

| Construct Sequence | DNA Sequence | Amino Acid |
|---|---|---|
| CasX 488 | CAAGAGATCAAGAGAATCAACAAGATCAGAAGG | QEIKRINKIRRRL |
| | AGACTGGTCAAGGACAGCAACACAAAGAAGGCC | VKDSNTKKAGK |
| | GGCAAGACAGGCCCCATGAAaACCCTGCTCGTCA | TGPMKTLLVRV |
| | GAGTGATGACCCCTGACCTGAGAGAGCGGCTGG | MTPDLRERLENL |
| | AAAACCTGAGAAAGAAGCCCGAGAACATCCCTC | RKKPENIPQPISN |
| | AGCCTATCAGCAACACCAGCAGGGCCAACCTGA | TSRANLNKLLTD |
| | ACAAGCTGCTGACCGACTACACCGAGATGAAGA | YTEMKKAILHV |
| | AAGCCATCCTGCACGTGTACTGGGAAGAGTTCCA | YWEEFQKDPVG |
| | GAAAGACCCCGTGGGCCTGATGAGCAGAGTTGCT | LMSRVAQPASK |
| | CAGCCTGCCAGCAAGAAGATCGACCAGAACAAG | KIDQNKLKPEMD |

TABLE 7-continued

Sequences of CasX 488, 491, 515 and 527

| Construct Sequence | DNA Sequence | Amino Acid |
|---|---|---|
| | CTGAAGCCCGAGATGGACGAGAAGGGCAATCTG | EKGNLTTAGFAC |
| | ACCACAGCCGGCTTTGCCTGCTCTCAGTGTGGCC | SQCGQPLFVYKL |
| | AGCCTCTGTTCGTGTACAAGCTGGAACAGGTGTC | EQVSEKGKAYT |
| | CGAGAAAGGCAAGGCCTACACCAACTACTTCGG | NYFGRCNVAEH |
| | CAGATGTAACGTGGCCGAGCACGAGAAGCTGAT | EKLILLAQLKPE |
| | TCTGCTGGCCCAGCTGAAACCTGAGAAGGACTCT | KDSDEAVTYSLG |
| | GATGAGGCCGTGACCTACAGCCTGGGCAAGTTTG | KFGQRALDFYSI |
| | GACAGAGAGCCCTGGACTTCTACAGCATCCACGT | HVTKESTHPVKP |
| | GACCAAAGAAAGCACACACCCCGTGAAGCCCCT | LAQIAGNRYASG |
| | GGCTCAGATCGCCGGCAATAGATACGCCTCTGGA | PVGKALSDACM |
| | CCTGTGGGCAAAGCCCTGTCCGATGCCTGCATGG | GTIASFLSKYQDI |
| | GAACAATCGCCAGCTTCCTGAGCAAGTACCAGGA | IIEHQKVVKGNQ |
| | CATCATCATCGAGCACCAGAAGGTGGTCAAGGG | KRLESLRELAGK |
| | CAACCAGAAGAGACTGGAAAGCCTGAGGGAGCT | ENLEYPSVTLPP |
| | GGCCGGCAAAGAGAACCTGGAATACCCCAGCGT | QPHTKEGVDAY |
| | GACCCTGCCTCCTCAGCCTCACACAAAAGAAGGC | NEVIARVRMWV |
| | GTGGACGCCTACAACGAAGTGATCGCCAGAGTG | NLNLWQKLKLS |
| | AGAATGTGGGTCAACCTGAACCTGTGGCAGAAG | RDDAKPLLRLKG |
| | CTGAAACTGTCCAGGGACGACGCCAAGCCTCTGC | FPSFPLVERQAN |
| | TGAGACTGAAGGGCTTCCCTAGCTTCCCTCTGGT | EVDWWDMVCN |
| | GGAAAGACAGGCCAATGAAGTGGATTGGTGGGA | VKKLINEKKEDG |
| | CATGGTCTGCAACGTGAAGAAGCTGATCAACGA | KVFWQNLAGYK |
| | GAAGAAAGAGGATGGCAAGGTTTTCTGGCAGAA | RQEALRPYLSSE |
| | CCTGGCCGGCTACAAGAGACAAGAAGCCCTGAG | EDRKKGKKFAR |
| | GCCTTACCTGAGCAGCGAAGAGGACCGGAAGAA | YQFGDLLLHLEK |
| | GGGCAAGAAGTTCGCCAGATACCAGTTCGGCGA | KHGEDWGKVYD |
| | CCTGCTGCTGCACCTGGAAAAGAAGCACGGCGA | EAWERIDKKVE |
| | GGACTGGGGCAAAGTGTACGATGAGGCCTGGGA | GLSKHIKLEEER |
| | GAGAATCGACAAGAAGGTGGAAGGCCTGAGCAA | RSEDAQSKAALT |
| | GCACATTAAGCTGGAAGAGGAAAGAAGGAGCGA | DWLRAKASFVIE |
| | GGACGCCCAATCTAAAGCCGCTCTGACCGATTGG | GLKEADKDEFCR |
| | CTGAGAGCCAAGGCCAGCTTTGTGATCGAGGGCC | CELKLQKWYGD |
| | TGAAAGAGGCCGACAAGGACGAGTTCTGCAGAT | LRGKPFAIEAEN |
| | GCGAGCTGAAGCTGCAGAAGTGGTACGGCGATC | SILDISGFSKQYN |
| | TGAGAGGCAAGCCCTTCGCCATTGAGGCCGAGA | CAFIWQKDGVK |
| | ACAGCATCCTGGACATCAGCGGCTTCAGCAAGCA | KLNLYLIINYFK |
| | GTACAACTGCGCCTTCATTTGGCAGAAAGACGGC | GGKLRFKKIKPE |
| | GTCAAGAAACTGAACCTGTACCTGATCATCAATT | AFEANRFYTVIN |
| | ACTTCAAAGGCGGCAAGCTGCGGTTCAAGAAGA | KKSGEIVPMEVN |
| | TCAAACCCGAGGCCTTCGAGGCTAACAGATTCTA | FNFDDPNLIILPL |
| | CACCGTGATCAACAAAAAGTCCGGCGAGATCGT | AFGKRQGREFIW |
| | GCCCATGGAAGTGAACTTCAACTTCGACGACCCC | NDLLSLETGSLK |
| | AACCTGATTATCCTGCCTCTGGCCTTCGGCAAGA | LANGRVIEKTLY |
| | GACAGGGCAGAGAGTTCATCTGGAACGATCTGCT | NRRTRQDEPALF |
| | GAGCCTGGAAACCGGCTCTCTGAAGCTGGCCAAT | VALTFERREVLD |
| | GGCAGAGTGATCGAGAAAACCCTGTACAACAGG | SSNIKPMNLIGID |
| | AGAACCAGACAGGACGAGCCTGCTCTGTTTGTGG | RGENIPAVIALTD |
| | CCCTGACCTTCGAGAGAAGAGAGGTGCTGGACA | PEGCPLSRFKDS |
| | GCAGCAACATCAAGCCCATGAACCTGATCGGCAT | LGNPTHILRIGES |
| | CGACCGGGGCGAGAATATCCCTGCTGTGATCGCC | YKEKQRTIQAKK |
| | CTGACAGACCCTGAAGGATGCCCACTGAGCAGAT | EVEQRRAGGYS |
| | TCAAGGACTCCCTGGGCAACCCTACACACATCCT | RKYASKAKNLA |
| | GAGAATCGGCGAGAGCTACAAAGAGAAGCAGAG | DDMVRNTARDL |
| | GACAATCCAGGCCAAGAAAGAGGTGGAACAGAG | LYYAVTQDAML |
| | AAGAGCCGGCGGATACTCTAGGAAGTACGCCAG | IFENLSRGFGRQ |
| | CAAGGCCAAGAATCTGGCCGACGACATGGTCCG | GKRTFMAERQY |
| | AAACACCGCCAGAGATCTGCTGTACTACGCCGTG | TRMEDWLTAKL |
| | ACACAGGACGCCATGCTGATCTTCGAGAATCTGA | AYEGLSKTYLSK |
| | GCAGAGGCTTCGGCCGGCAGGGCAAGAGAACCT | TLAQYTSKTCSN |
| | TTATGGCCGAGAGGCAGTACACCAGAATGGAAG | CGFTITSADYDR |
| | ATTGGCTCACAGCTAAACTGGCCTACGAGGGACT | VLEKLKKTATG |
| | GAGCAAGACCTACCTGTCCAAAACACTGGCCCAG | WMTTINGKELK |
| | TATACCTCCAAGACCTGCAGCAATTGCGGCTTCA | VEGQITYYNRYK |
| | CCATCACCAGCGCCGACTACGACAGAGTGCTGGA | RQNVVKDLSVE |
| | AAAGCTCAAGAAAACCGCCACCGGCTGGATGAC | LDRLSEESVNND |
| | CACCATCAACGGCAAAGAGCTGAAGGTTGAGGG | ISSWTKGRSGEA |
| | CCAGATCACCTACTACAACAGGTACAAGAGGCA | LSLLKKRFSHRP |
| | GAACGTCGTGAAGGATCTGAGCGTGGAACTGGA | VQEKFVCLNCGF |
| | CAGACTGAGCGAAGAGAGCGTGAACAACGACAT | ETHADEQAALNI |
| | CAGCAGCTGGACAAAGGGCAGATCAGGCGAGGC | ARSWLFLRSQEY |
| | TCTGAGCCTGCTGAAGAAGAggTTTAGCCACAGA | KKYQTNKTTGN |
| | CCTGTGCAAGAAGTTCGTGTGCCTGAACTGCG | TDKRAFVETWQ |
| | GCTTCGAGACACACGCCGATGAACAGGCTGCCCT | SFYRKKLKEVW |
| | GAACATTGCCAGAAGCTGGCTGTTCCTGAGAAGC | KPAV (SEQ ID |
| | CAAGAGTACAAGAAGTACCAGACCAACAAGACC | NO: 243) |

TABLE 7-continued

Sequences of CasX 488, 491, 515 and 527

| Construct Sequence | DNA Sequence | Amino Acid |
|---|---|---|
| | ACCGGCAACACCGACAAGAGGGCCTTTGTGGAA ACCTGGCAGAGCTTCTACAGAAAAAAGCTGAAA GAAGTCTGGAAGCCCGCCGTG(SEQ ID NO: 247) | |
| CasX 491 | CAAGAGATCAAGAGAATCAACAAGATCAGAAGG AGACTGGTCAAGGACAGCAACACAAAGAAGGCC GGCAAGACAGGCCCCATGAAaACCCTGCTCGTCA GAGTGATGACCCCTGACCTGAGAGAGCGGCTGG AAAACCTGAGAAAGAAGCCCGAGAACATCCCTC AGCCTATCAGCAACACCAGCAGGGCCAACCTGA ACAAGCTGCTGACCGACTACACCGAGATGAAGA AAGCCATCCTGCACGTGTACTGGGAAGAGTTCCA GAAAGACCCCGTGGGCCTGATGAGCAGAGTTGCT CAGCCTGCCAGCAAGAAGATCGACCAGAACAAG CTGAAGCCCGAGATGGACGAGAAGGGCAATCTG ACCACAGCCGGCTTTGCCTGCTCTCAGTGTGGCC AGCCTCTGTTCGTGTACAAGCTGGAACAGGTGTC CGAGAAAGGCAAGGCCTACACCAACTACTTCGG CAGATGTAACGTGGCCGAGCACGAGAAGCTGAT TCTGCTGGCCCAGCTGAAACCTGAGAAGGACTCT GATGAGGCCGTGACCTACAGCCTGGGCAAGTTTG GACAGAGAGCCCTGGACTTCTACAGCATCCACGT GACCAAAGAAAGCACACACCCCGTGAAGCCCCT GGCTCAGATCGCCGGCAATAGATACGCCTCTGGA CCTGTGGGCAAAGCCCTGTCCGATGCCTGCATGG GAACAATCGCCAGCTTCCTGAGCAAGTACCAGGA CATCATCATCGAGCACCAGAAGGTGGTCAAGGG CAACCAGAAGAGACTGGAAAGCCTGAGGGAGCT GGCCGGCAAAGAGAACCTGGAATACCCCAGCGT GACCCTGCCTCCTCAGCCTCACACAAAAGAAGGC GTGGACGCCTACAACGAAGTGATCGCCAGAGTG AGAATGTGGGTCAACCTGAACCTGTGGCAGAAG CTGAAACTGTCCAGGGACGACGCCAAGCCTCTGC TGAGACTGAAGGGCTTCCCTAGCTTCCCTCTGGT GGAAAGACAGGCCAATGAAGTGGATTGGTGGGA CATGGTCTGCAACGTGAAGAAGCTGATCAACGA GAAGAAAGAGGATGGCAAGGTTTTCTGGCAGAA CCTGGCCGGCTACAAGAGACAAGAAGCCCTGAG GCCTTACCTGAGCAGCGAAGAGGACCGGAAGAA GGGCAAGAAGTTCGCCAGATACCAGCTGGGCGA CCTGCTGCTGCACCTGGAAAAGAAGCACGGCGA GGACTGGGGCAAAGTGTACGATGAGGCCTGGGA GAGAATCGACAAGAAGGTGGAAGGCCTGAGCAA GCACATTAAGCTGGAAGAGGAAAGAAGGAGCGA GGACGCCCAATCTAAAGCCGCTCTGACCGATTGG GTGGACATTAAGCTGGAAGAGGAAAGAAGGAGCGA GGACGCCCAATCTAAAGCCGCTCTGACCGATTGG CTGAGAGCCAAGGCCAGCTTTGTGATCGAGGGCC TGAAAGAGGCCGACAAGGACGAGTTCTGCAGAT GCGAGCTGAAGCTGCAGAAGTGGTACGGCGATC TGAGAGGCAAGCCCTTCGCCATTGAGGCCGAGA ACAGCATCCTGGACATCAGCGGCTTCAGCAAGCA GTACAACTGCGCCTTCATTTGGCAGAAAGACGGC GTCAAGAAACTGAACCTGTACCTGATCATCAATT ACTTCAAAGGCGGCAAGCTGCGGTTCAAGAAGA TCAAACCCGAGGCCTTCGAGGCTAACAGATTCTA CACCGTGATCAACAAAAAGTCCGGCGAGATCGT GCCCATGGAAGTGAACTTCAACTTCGACGACCCC AACCTGATTATCCTGCCTCTGGCCTTCGGCAAGA GACAGGGCAGAGAGTTCATCTGGAACGATCTGCT GAGCCTGGAAACCGGCTCTCTGAAGCTGGCCAAT GGCAGAGTGATCGAGAAAACCCTGTACAACAGG AGAACCAGACAGGACGAGCCTGCTCTGTTTGTGG CCCTGACCTTCGAGAGGAAGAGGTGCTGGACA GCAGCAACATCAAGCCCATGAACCTGATCGGCGT GGACCGGGGCGAGAATATCCCTGCTGTGATCGCC CTGACAGACCCTGAAGGATGCCCACTGAGCAGAT TCAAGGACTCCCTGGGCAACCCTACACACATCCT GAGAATCGGCGAGAGCTACAAAGAGAAGCAGAG GACAATCCAGGCCAAGAAAGAGGTGGAACAGAG AAGAGCCGGCGGATACTCTAGGAAGTACGCCAG CAAGGCCAAGAATCTGGCCGACAAGAATGGTCCG AAACACCGCCAGAGATCTGCTGTACTACGCCGTG ACACAGGACGCCATGCTGATCTTCGAGAATCTGA GCAGAGGCTTCGGCCGGCAGGGCAAGAGAACCT TTATGGCCGAGAGGCAGTACACCAGAATGGAAG ATTGGCTCACAGCTAAACTGGCCTACGAGGGACT | QEIKRINKIRRRL VKDSNTKKAGK TGPMKTLLVRV MTPDLRERLENL RKKPENIPQPISN TSRANLNKLLTD YTEMKKAILHV YWEEFQKDPVG LMSRVAQPASK KIDQNKLKPEMD EKGNLTTAGFAC SQCGQPLFVYKL EQVSEKGKAYT NYFGRCNVAEH EKLILLAQLKPE KDSDEAVTYSLG KFGQRALDFYSI HVTKESTHPVKP LAQIAGNRYASG PVGKALSDACM GTIASFLSKYQDI IIEHQKVVKGNQ KRLESLRELAGK ENLEYPSVTLPP QPHTKEGVDAY NEVIARVRMWV NLNLWQKLKLS RDDAKPLLRLKG FPSFPLVERQAN EVDWWDMVCN VKKLINEKKEDG KVFWQNLAGYK RQEALRPYLSSE EDRKKGKKFAR YQLGDLLLHLEK KHGEDWGKVYD EAWERIDKKVE GLSKHIKLEEER RSEDAQSKAALT DWLRAKASFVIE GLKEADKDEFCR CELKLQKWYGD LRGKPFAIEAEN SILDISGFSKQYN CAFIWQKDGVK KLNLYLIINYFK GGKLRFKKIKPE AFEANRFYTVIN KKSGEIVPMEVN FNFDDPNLIILPL AFGKRQGREFIW NDLLSLETGSLK LANGRVIEKTLY NRRTRQDEPALF VALTFERREVLD SSNIKPMNLIGV DRGENIPAVIALT DPEGCPLSRFKD SLGNPTHILRIGE SYKEKQRTIQAK KEVEQRRAGGY SRKYASKAKNL ADDMVRNTARD LLYYAVTQDAM LIFENLSRGFGRQ GKRTFMAERQY TRMEDWLTAKL AYEGLSKTYLSK TLAQYTSKTCSN CGFTITSADYDR VLEKLKKTATG |

TABLE 7-continued

Sequences of CasX 488, 491, 515 and 527

| Construct Sequence | DNA Sequence | Amino Acid |
|---|---|---|
| | GAGCAAGACCTACCTGTCCAAAACACTGGCCCAG<br>TATACCTCCAAGACCTGCAGCAATTGCGGCTTCA<br>CCATCACCAGCGCCGACTACGACAGAGTGCTGGA<br>AAAGCTCAAGAAAACCGCCACCGGCTGGATGAC<br>CACCATCAACGGCAAAGAGCTGAAGGTTGAGGG<br>CCAGATCACCTACTACAACAGGTACAAGAGGCA<br>GAACGTCGTGAAGGATCTGAGCGTGGAACTGGA<br>CAGACTGAGCGAAGAGAGCGTGAACAACGACAT<br>CAGCAGCTGGACAAAGGGCAGATCAGGCGAGGC<br>TCTGAGCCTGCTGAAGAAGAggTTTAGCCACAGA<br>CCTGTGCAAGAGAAGTTCGTGTGCCTGAACTGCG<br>GCTTCGAGACACACGCCGATGAACAGGCTGCCCT<br>GAACATTGCCGAAGCTGGCTGTTCCTGAGAAGC<br>CAAGAGTACAAGAAGTACCAGACCAACAAGACC<br>ACCGGCAACACCGACAAGAGGGCCTTTGTGGAA<br>ACCTGGCAGAGCTTCTACAGAAAAAAGCTGAAA<br>GAAGTCTGGAAGCCCGCCGTG (SEQ ID NO: 248) | WMTTINGKELK<br>VEGQITYYNRYK<br>RQNVVKDLSVE<br>LDRLSEESVNND<br>ISSWTKGRSGEA<br>LSLLKKRFSHRP<br>VQEKFVCLNCGF<br>ETHADEQAALNI<br>ARSWLFLRSQEY<br>KKYQTNKTTGN<br>TDKRAFVETWQ<br>SFYRKKLKEVW<br>KPAV (SEQ ID NO: 244) |
| CasX 515 | CAAGAGATCAAGAGAATCAACAAGATCAGAAGG<br>AGATGGTCAAGGACAGCAACACAAAGAAGGCC<br>GGCAAGACAGGCCCCATGAAaCCCTGCTCGTCA<br>GAGTGATGACCCCTGACCTGAGAGAGCGGCTGG<br>AAAACCTGAGAAAGAAGCCCGAGAACATCCCTC<br>AGCCTATCAGCAACACCAGCAGGGCCAACCTGA<br>ACAAGCTGCTGACCGACTACACCGAGATGAAGA<br>AAGCCATCCTGCACGTGTACTGGGAAGAGTTCCA<br>GAAAGACCCCGTGGGCCTGATGAGCAGAGTTGCT<br>CAGCCTGCCAGCAAGAAGATCGACCAGAACAAG<br>CTGAAGCCCGAGATGGACGAGAAGGGCAATCTG<br>ACCACAGCCGGCTTTGCCTGCTCTCAGTGTGGCC<br>AGCCTCTGTTCGTGTACAAGCTGGAACAGGTGTC<br>CGAGAAAGGCAAGGCCTACACCAACTACTTCGG<br>CAGATGTAACGTGGCCGAGCACGAGAAGCTGAT<br>TCTGCTGGCCCAGCTGAAACCTGAGAAGGACTCT<br>GATGAGGCCGTGACCTACAGCCTGGGCAAGTTTG<br>GACAGAGAGCCCTGGACTTCTACAGCATCCACGT<br>GACCAAAGAAAGCACACACCCCGTGAAGCCCCT<br>GGCTCAGATCGCCGGCAATAGATACGCCTCTGGA<br>CCTGTGGGCAAAGCCCTGTCCGATGCCTGCATGG<br>GAACAATCGCCAGCTTCCTGAGCAAGTACCAGGA<br>CATCATCATCGAGCACCAGAAGGTGGTCAAGGG<br>CAACCAGAAGAGACTGGAAAGCCTGAGGGAGCT<br>GGCCGGCAAAGAGAACCTGGAATACCCCAGCGT<br>GACCCTGCCTCCTCAGCCTCACACAAAAGAAGGC<br>GTGGACGCCTACAACGAAGTGATCGCCAGAGTG<br>AGAATGTGGGTCAACCTGAACCTGTGGCAGAAG<br>CTGAAACTGTCCAGGGACGACGCCAAGCCTCTGC<br>TGAGACTGAAGGGCTTCCCTAGCTTCCCTCTGGT<br>GGAAAGACAGGCCAATGAAGTGGATTGGTGGGA<br>CATGGTCTGCAACGTGAAGAAGCTGATCAACGA<br>GAAGAAAGAGGATGGCAAGGTTTTCTGGCAGAA<br>CCTGGCCGGCTACAAGAGACAAGAAGCCCTGAG<br>GCCTTACCTGAGCAGCGAAGAGGACCGGAAGAA<br>GGGCAAGAAGTTCGCCAGATACCAGCTGGGCGA<br>CCTGCTGCTGCACCTGGAAAAGAAGCACGGCGA<br>GGACTGGGGCAAAGTGTACGATGAGGCCTGGGA<br>GAGAATCGACAAGAAGGTGGAAGGCCTGAGCAA<br>GCACATTAAGCTGGAAGAGGAAAGAAGGAGCGA<br>GGACGCCCAATCTAAAGCCGCTCTGACCGATTGG<br>CTGAGAGCCAAGGCCAGCTTTGTGATCGAGGGCC<br>TGAAAGAGGCCGACAAGGACGAGTTCTGCAGAT<br>GCGAGCTGAAGCTGCAGAAGTGGTACGGCGATC<br>TGAGAGGCAAGCCCTTCGCCATTGAGGCCGAGA<br>ACAGCATCCTGGACATCAGCGGCTTCAGCAAGCA<br>GTACAACTGCGCCTTCATTTGGCAGAAAGACGGC<br>GTCAAGAAACTGAACCTGTACCTGATCATCAATT<br>ACTTCAAAGGCGGCAAGCTGCGGTTCAAGAAGA<br>TCAAACCCGAGGCCTTCGAGGCTAACAGATTCTA<br>CACCGTGATCAACAAAAGTCCGGCGAGATCGT<br>GCCCATGGAAGTGAACTTCAACTTCGACGACCCC<br>AACCTGATTATCCTGCCTCTGGCCTTCGGCAAGA<br>GACAGGGCAGAGAGTTCATCTGGAACGATCTGCT<br>GAGCCTGGAAACCGGCTCTCTGAAGCTGGCCAAT<br>GGCAGAGTGATCGAGAAACCCTGTACAACAGG<br>AGAACCAGACAGGACGAGCCTGCTCTGTTTGTGG | QEIKRINKIRRRL<br>VKDSNTKKAGK<br>TGPMKTLLVRV<br>MTPDLRERLENL<br>RKKPENIPQPISN<br>TSRANLNKLLTD<br>YTEMKKAILHV<br>YWEEFQKDPVG<br>LMSRVAQPASK<br>KIDQNKLKPEMD<br>EKGNLTTAGFAC<br>SQCGQPLFVYKL<br>EQVSEKGKAYT<br>NYFGRCNVAEH<br>EKLILLAQLKPE<br>KDSDEAVTYSLG<br>KFGQRALDFYSI<br>HVTKESTHPVKP<br>LAQIAGNRYASG<br>PVGKALSDACM<br>GTIASFLSKYQDI<br>IIEHQKVVKGNQ<br>KRLESLRELAGK<br>ENLEYPSVTLPP<br>QPHTKEGVDAY<br>NEVIARVRMWV<br>NLNLWQKLKLS<br>RDDAKPLLRLKG<br>FPSFPLVERQAN<br>EVDWWDMVCN<br>VKKLINEKKEDG<br>KVFWQNLAGYK<br>RQEALRPYLSSE<br>EDRKKGKKFAR<br>YQLGDLLLHLEK<br>KHGEDWGKVYD<br>EAWERIDKKVE<br>GLSKHIKLEEER<br>RSEDAQSKAALT<br>DWLRAKASFVIE<br>GLKEADKDEFCR<br>CELKLQKWYGD<br>LRGKPFAIEAEN<br>SILDISGFSKQYN<br>CAFIWQKDGVK<br>KLNLYLIINYFK<br>GGKLRFKKIKPE<br>AFEANRFYTVIN<br>KKSGEIVPMEVN<br>FNFDDPNLIILPL<br>AFGKRQGREFIW<br>NDLLSLETGSLK<br>LANGRVIEKTLY<br>NRRTQDEPALF<br>VALTFERREVLD<br>SSNIKPMNLIGV<br>DRGENIPAVIALT |

TABLE 7-continued

Sequences of CasX 488, 491, 515 and 527

| Construct Sequence | DNA Sequence | Amino Acid |
|---|---|---|
| | CCCTGACCTTCGAGAGAAGAGAGGTGCTGGACA GCAGCAACATCAAGCCCATGAACCTGATCGGCGT GGACCGGGGCGAGAATATCCCTGCTGTGATCGCC CTGACAGACCCTGAAGGATGCCCACTGAGCAGAT TCAAGGACTCCCTGGGCAACCCTACACACATCCT GAGAATCGGCGAGAGCTACAAAGAGAAGCAGAG GACAATCCAGGCCAAGAAAGAGGTGGAACAGAG AAGAGCCGGCGGATACTCTAGGAAGTACGCCAG CAAGGCCAAGAATCTGGCCGACGACATGGTCCG AAACACCGCCAGAGATCTGCTGTACTACGCCGTG ACACAGGACGCCATGCTGATCTTCGAGAATCTGA GCAGAGGCTTCGGCCGGCAGGGCAAGAGAACCT TTATGGCCGAGAGGCAGTACACCAGAATGGAAG ATTGGCTCACAGCTAAACTGGCCTACGAGGGACT GCCCAGCAAGACCTACCTGTCCAAAACACTGGCC CAGTATACCTCCAAGACCTGCAGCAATTGCGGCT TCACCATCACCAGCGCCGACTACGACAGAGTGCT GGAAAAGCTCAAGAAAACCGCCACCGGCTGGAT GACCACCATCAACGGCAAAGAGCTGAAGGTTGA GGGCCAGATCACCTACTACAACAGGTACAAGAG GCAGAACGTCGTGAAGGATCTGAGCGTGGAACT GGACAGACTGAGCGAAGAGAGCGTGAACAACGA CATCAGCAGCTGGACAAAGGGCAGATCAGGCGA GGCTCTGAGCCTGCTGAAGAAGAggTTTAGCCAC AGACCTGTGCAAGAGAAGTTCGTGTGCCTGAACT GCGGCTTCGAGACACACGCCGATGAACAGGCTG CCCTGAACATTGCCAGAAGCTGGCTGTTCCTGAG AAGCCAAGAGTACAAGAAGTACCAGACCAACAA GACCACCGGCAACACCGACAAGAGGGCCTTTGT GGAAACCTGGCAGAGCTTCTACAGAAAAAAGCT GAAAGAAGTCTGGAAGCCCGCCGTG (SEQ ID NO: 249) | DPEGCPLSRFKD SLGNPTHILRIGE SYKEKQRTIQAK KEVEQRRAGGY SRKYASKAKNL ADDMVRNTARD LLYYAVTQDAM LIFENLSRGFGRQ GKRTFMAERQY TRMEDWLTAKL AYEGLPSKTYLS KTLAQYTSKTCS NCGFTITSADYD RVLEKLKKTATG WMTTINGKELK VEGQITYYNRYK RQNVVKDLSVE LDRLSEESVNND ISSWTKGRSGEA LSLLKKRFSHRP VQEKFVCLNCGF ETHADEQAALNI ARSWLFLRSQEY KKYQTNKTTGN TDKRAFVETWQ SFYRKKLKEVW KPAV (SEQ ID NO: 245) |
| CasX 527 | CAAGAGATCAAGAGAATCAACAAGATCAGAAGG AGACTGGTCAAGGACAGCAACACAAAGAAGGCC GGCAAGACAcggGGCCCCATGAAaACCCTGCTCGT CAGAGTGATGACCCCTGACCTGAGAGAGCGGCT GGAAAACCTGAGAAAGAAGCCCGAGAACATCCC TCAGCCTATCAGCAACACCAGCAGGGCCAACCTG AACAAGCTGCTGACCGACTACACCGAGATGAAG AAAGCCATCCTGCACGTGTACTGGGAAGAGTTCC AGAAAGACCCCGTGGGCCTGATGAGCAGAGTTG CTCAGCCTGCCAGCAAGAAGATCGACCAGAACA AGCTGAAGCCCGAGATGGACGAGAAGGGCAATC TGACCACAGCCGGCTTTGCCTGCTCTCAGTGTGG CCAGCCTCTGTTCGTGTACAAGCTGGAACAGGTG TCCGAGAAAGGCAAGGCCTACACCAACTACTTCG GCAGATGTAACGTGGCCGAGCACGAGAAGCTGA TTCTGCTGGCCCAGCTGAAACCTGAGAAGGACTC TGATGAGGCCGTGACCTACAGCCTGGGCAAGTTT GGACAGAGAGCCCTGGACTTCTACAGCATCCACG TGACCAAAGAAAGCACACACCCCGTGAAGCCCC TGGCTCAGATCGCCGGCAATAGATACGCCTCTGG ACCTGTGGGCAAAGCCCTGTCCGATGCCTGCATG GGAACAATCGCCAGCTTCCTGAGCAAGTACCAGG ACATCATCATCGAGCACCAGAAGGTGGTCAAGG GCAACCAGAAGAGACTGGAAAGCCTGAGGGAGC TGGCCGGCAAAGAGAACCTGGAATACCCCAGCG TGACCCTGCCTCCTCAGCCTCACACAAAAGAAGG CGTGGACGCCTACAACGAAGTGATCGCCAGAGT GAGAATGTGGGTCAACCTGAACCTGTGGCAGAA GCTGAAACTGTCCAGGGACGACGCCAAGCCTCTG CTGAGACTGAAGGGCTTCCCTAGCTTCCCTCTGG TGGAAAGACAGGCCAATGAAGTGGATTGGTGGG ACATGGTCTGCAACGTGAAGAAGCTGATCAACG AGAAGAAAGAGGATGGCAAGGTTTTCTGGCAGA ACCTGGCCGGCTACAAGAGACAAGAAGCCCTGA GGCCTTACCTGAGCAGCGAAGAGGACCGGAAGA AGGGCAAGAAGTTCGCCAGATACCAGCTGGGCG ACCTGCTGCTGCACCTGGAAAAGAAGCACGGCG AGGACTGGGGCAAAGTGTACGATGAGGCCTGGG AGAGAATCGACAAGAAGGTGGAAGCCTGAGCA AGCACATTAAGCTGGAAGAGGAAAGAAGGAGCG AGGACGCCCAATCTAAAGCCGCTCTGACCGATTG GCTGAGAGCCAAGGCCAGCTTTGTGATCGAGGGC | QEIKRINKIRRRL VKDSNTKKAGK TRGPMKTLLVR VMTPDLRERLEN LRKKPENIPQPIS NTSRANLNKLLT DYTEMKKAILH VYWEEFQKDPV GLMSRVAQPAS KKIDQNKLKPEM DEKGNLTTAGFA CSQCGQPLFVYK LEQVSEKGKAYT NYFGRCNVAEH EKLILLAQLKPE KDSDEAVTYSLG KFGQRALDFYSI HVTKESTHPVKP LAQIAGNRYASG PVGKALSDACM GTIASFLSKYQDI IIEHQKVVKGNQ KRLESLRELAGK ENLEYPSVTLPP QPHTKEGVDAY NEVIARVRMWV NLNLWQKLKLS RDDAKPLLRLKG FPSFPLVERQAN EVDWWDMVCN VKKLINEKKEDG KVFWQNLAGYK RQEALRPYLSSE EDRKKGKKFAR YQLGDLLLHLEK KHGEDWGKVYD EAWERIDKKVE GLSKHIKLEEER RSEDAQSKAALT DWLRAKASFVIE GLKEADKDEFCR CELKLQKWYGD |

TABLE 7-continued

Sequences of CasX 488, 491, 515 and 527

| Construct Sequence | DNA Sequence | Amino Acid |
|---|---|---|
| | CTGAAAGAGGCCGACAAGGACGAGTTCTGCAGA | LRGKPFAIEAEN |
| | TGCGAGCTGAAGCTGCAGAAGTGGTACGGCGAT | SILDISGFSKQYN |
| | CTGAGAGGCAAGCCCTTCGCCATTGAGGCCGAGA | CAFIWQKDGVK |
| | ACAGCATCCTGGACATCAGCGGCTTCAGCAAGCA | KLNLYLIINYFK |
| | GTACAACTGCGCCTTCATTTGGCAGAAAGACGGC | GGKLRFKKIKPE |
| | GTCAAGAAACTGAACCTGTACCTGATCATCAATT | AFEANRFYTVIN |
| | ACTTCAAAGGCGGCAAGCTGCGGTTCAAGAAGA | KKSGEIVPMEVN |
| | TCAAACCCGAGGCCTTCGAGGCTAACAGATTCTA | FNFDDPNLIILPL |
| | CACCGTGATCAACAAAAAGTCCGGCGAGATCGT | AFGKRQGREFIW |
| | GCCCATGGAAGTGAACTTCAACTTCGACGACCCC | NDLLSLETGSLK |
| | AACCTGATTATCCTGCCTCTGGCCTTCGGCAAGA | LANGRVIEKTLY |
| | GACAGGGCAGAGAGTTCATCTGGAACGATCTGCT | NRRTRQDEPALF |
| | GAGCCTGGAAACCGGCTCTCTGAAGCTGGCCAAT | VALTFERREVLD |
| | GGCAGAGTGATCGAGAAAACCCTGTACAACAGG | SSNIKPMNLIGV |
| | AGAACCAGACAGGACGAGCCTGCTCTGTTTGTGG | DRGENIPAVIALT |
| | CCCTGACCTTCGAGAGAAGAGAGGTGCTGGACA | DPEGCPLSRFKD |
| | GCAGCAACATCAAGCCCATGAACCTGATCGGCGT | SLGNPTHILRIGE |
| | GGACCGGGGCGAGAATATCCCTGCTGTGATCGCC | SYKEKQRTIQAK |
| | CTGACAGACCCTGAAGGATGCCCACTGAGCAGAT | KEVEQRRAGGY |
| | TCAAGGACTCCCTGGGCAACCCTACACACATCCT | SRKYASKAKNL |
| | GAGAATCGGCGAGAGCTACAAAGAGAAGCAGAG | ADDMVRNTARD |
| | GACAATCCAGGCCAAGAAAGAGGTGGAACAGAG | LLYYAVTQDAM |
| | AAGAGCCGGCGGATACTCTAGGAAGTACGCCAG | LIFENLSRGFGRQ |
| | CAAGGCCAAGAATCTGGCCGACGACATGGTCCG | GKRTFMAERQY |
| | AAACACCGCCAGAGATCTGCTGTACTACGCCGTG | TRMEDWLTAKL |
| | ACACAGGACGCCATGCTGATCTTCGAGAATCTGA | AYEGLSKTYLSK |
| | GCAGAGGCTTCGGCCGGCAGGGCAAGAGAACCT | TLAQYTSKTCSN |
| | TTATGGCCGAGAGGCAGTACACCAGAATGGAAG | CGFTITSADYDR |
| | ATTGGCTCACAGCTAAACTGGCCTACGAGGGACT | VLEKLKKTATG |
| | GAGCAAGACCTACCTGTCCAAAACACTGGCCCAG | WMTTINGKELK |
| | TATACCTCCAAGACCTGCAGCAATTGCGGCTTCA | VEGQITYYNRYK |
| | CCATCACCAGCGCCGACTACGACAGAGTGCTGGA | RQNVVKDLSVE |
| | AAAGCTCAAGAAAACCCACCGGCTGGATGAC | LDRLSEESVNND |
| | CACCATCAACGGCAAAGAGCTGAAGGTTGAGGG | ISSWTKGRSGEA |
| | CCAGATCACCTACTACAACAGGTACAAGAGGCA | LSLLKKRFSHRP |
| | GAACGTCGTGAAGGATCTGAGCGTGGAACTGGA | VQEKFVCLNCGF |
| | CAGACTGAGCGAAGAGAGCGTGAACAACGACAT | ETHADEQAALNI |
| | CAGCAGCTGGACAAAGGGCAGATCAGGCGAGGC | ARSWLFLRSQEY |
| | TCTGAGCCTGCTGAAGAAGAggTTTAGCCACAGA | KKYQTNKTTGN |
| | CCTGTGCAAGAGAAGTTCGTGTGCCTGAACTGCG | TDKRAFVETWQ |
| | GCTTCGAGACACACGCCGATGAACAGGCTGCCCT | SFYRKKLKEVW |
| | GAACATTGCCAGAAGCTGGCTGTTCCTGAGAAGC | KPAV (SEQ ID |
| | CAAGAGTACAAGAAGTACCAGACCAACAAGACC | NO: 246) |
| | ACCGGCAACACCGACAAGAGGGCCTTTGTGGAA | |
| | ACCTGGCAGAGCTTCTACAGAAAAAAGCTGAAA | |
| | GAAGTCTGGAAGCCCGCCGTG (SEQ ID NO: 250) | |

Example 4: Design and Generation of CasX Constructs 278-280, 285-288, 290, 291, 293, 300, 492, and 493

In order to generate the CasX 278-280, 285-288, 290, 291, 293, 300, 492, and 493 constructs (sequences in Table 8), the N- and C-termini of the codon-optimized CasX 119 construct (based on the CasX Stx37 construct of Example 2, encoding Planctomycetes CasX SEQ ID NO: 2, with a A708K substitution and a [P793] deletion with fused NLS, and linked guide and non-targeting sequences) in a mammalian expression vector were manipulated to delete or add NLS sequences (sequences in Table 9). Constructs 278, 279, and 280 were manipulations of the N- and C-termini using only an SV40 NLS sequence. Construct 280 had no NLS on the N-terminus and added two SV40 NLS' on the C-terminus with a triple proline linker in between the two SV40 NLS sequences. Constructs 278, 279, and 280 were made by amplifying pStx34.119.174.NT with Q5 DNA polymerase according to the manufacturer's protocol, using primers oIC527 and oIC528, oIC730 and oIC522, and oIC730 and oIC530 for the first fragments each and using oIC529 and oIC520, oIC519 and oIC731, and oIC529 and oIC731 to create the second fragments each. These fragments were purified by gel extraction from a 1% agarose gel using Zymoclean™ Gel DNA Recovery Kit according to the manufacturer's protocol. The respective fragments were cloned together using Gibson Assembly® (New England BioLabs Cat #E2621S) following the manufacturer's protocol. Assembled products in the pStx34 were transformed into chemically-competent Turbo Competent E. coli bacterial cells, plated on LB-Agar plates containing carbenicillin and incubated at 37° C. Individual colonies were picked and miniprepped using Qiagen spin Miniprep Kit following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically- or electro-competent cells such as NEB Turbo competent *E. coli* (NEB Cat #C29841), plated on LB-Agar plates containing carbenicillin and incubated at 37° C. Individual colonies were picked and miniprepped using Qiagen spin Miniprep Kit and following the manufacturer's protocol. The resultant plasmids were sequenced using Sanger sequencing to ensure correct ligation.

In order to generate constructs 285-288, 290, 291, 293, and 300, a nested PCR method was used for cloning. The backbone vector and PCR template used was construct pStx34 279.119.174.NT, having the CasX 119, guide 174, and non-targeting spacer (see Examples 8 and 9 and Tables therein for sequences). Construct 278 has the configuration SV40NLS-CasX119. Construct 279 has the configuration CasX119-SV40NLS. Construct 280 has the configuration CasX119-SV40NLS-PPP linker-SV40NLS. Construct 285 has the configuration CasX119-SV40NLS-PPP linker-SynthNLS3. Construct 286 has the configuration CasX119-SV40NLS-PPP linker-SynthNLS4. Construct 287 has the configuration CasX119-SV40NLS-PPP linker-SynthNLS5. Construct 288 has the configuration CasX119-SV40NLS-PPP linker-SynthNLS6. Constrict 290 has the configuration CasX119-SV40NLS-PPP linker-EGL-13 NLS. Construct 291 has the configuration CasX119-SV40NLS-PPP linker-c-Myc NLS. Construct 293 has the configuration CasX119-SV40NLS-PPP linker-Nucleolar RNA Helicase II NLS. Construct 300 has the configuration CasX119-SV40NLS-PPP linker-Influenza A protein NLS. Construct 492 has the configuration SV40NLS-CasX119-SV40NLS-PPP linker-SV40NLS. Construct 493 has the configuration SV40NLS-CasX119-SV40NLS-PPP linker-c-Myc NLS. Each variant had a set of three PCRs: two of which were nested, were purified by gel extraction, digested, and then ligated into the digested and purified backbone. Assembled products in the pStx34 were transformed into chemically-competent Turbo Competent *E. coli* bacterial cells, plated on LB-Agar plates containing carbenicillin and incubated at 37° C. Individual colonies were picked and miniprepped using Qiagen spin Miniprep Kit following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence.

These two oligos were annealed together and cloned into the resulting pStX individually or in bulk by Golden Gate assembly using T4 DNA Ligase (New England BioLabs Cat #M0202L) and an appropriate restriction enzyme for the plasmid. Golden Gate products were transformed into chemically- or electro-competent cells such as NEB Turbo competent *E. coli* (NEB Cat #C29841), plated on LB-Agar plates containing carbenicillin and incubated at 37° C. Individual colonies were picked and miniprepped using Qiagen spin Miniprep Kit and following the manufacturer's protocol. The resultant plasmids were sequenced using Sanger sequencing to ensure correct ligation.

In order to generate constructs 492 and 493, constructs 280 and 291 were digested using XbaI and BamHI (NEB #R0145S and NEB #R3136S) according to the manufacturer's protocol. Next, they were purified by gel extraction from a 1% agarose gel using Zymoclean™ Gel DNA Recovery Kit according to the manufacturer's protocol. Finally, they were ligated using T4 DNA ligase (NEB #M0202S) according to the manufacturer's protocol into the digested and purified pStx34.119.174.NT using XbaI and BamHI and Zymoclean™ Gel DNA Recovery Kit. Assembled products in the pStx34 were transformed into chemically-competent Turbo Competent *E. coli* bacterial cells, plated on LB-Agar plates containing carbenicillin and incubated at 37° C. Individual colonies were picked and miniprepped using Qiagen spin Miniprep Kit following the manufacturer's protocol. The resultant plasmids were sequenced using Sanger sequencing to ensure correct assembly. Sequences encoding the targeting spacer sequences that target the gene of interest were designed based on CasX PAM locations. Targeting sequence DNA was ordered as single-stranded DNA (ssDNA) oligos (Integrated DNA Technologies) consisting of the targeting spacer sequence and the reverse complement of this sequence. These two oligos were annealed together and cloned into each pStX individually or in bulk by Golden Gate assembly using T4 DNA Ligase (New England BioLabs Cat #M0202L) and an appropriate restriction enzyme for the respective plasmids. Golden Gate products were transformed into chemically- or electro-competent cells such as NEB Turbo competent *E. coli* (NEB Cat #C29841), plated on LB-Agar plates containing carbenicillin and incubated at 37° C. Individual colonies were picked and miniprepped using Qiagen spin Miniprep Kit and following the manufacturer's protocol. The resultant plasmids were sequenced using Sanger sequencing to ensure correct ligation. The plasmids would be used to produce and recover CasX protein utilizing the general methodologies of Examples 1 and 2.

TABLE 8

CasX 278-280, 285-288, 290, 291, 293, 300, 492, and 493 sequences

| Construct | Amino Acid Sequence |
|---|---|
| 278 | MAPKKKRKVSRQEIKRINKIRRRLVKDSNTKKAGKTGPMKTLLVRVMTP<br>DLRERLENLRKKPENIPQPISNTSRANLNKLLTDYTEMKKAILHVYWEEF<br>QKDPVGLMSRVAQPAPKNIDQRKLIPVKDGNERLTSSGFACSQCCQPLYV<br>YKLEQVNDKGKPHTNYFGRCNVSEHERLILLSPHKPEANDELVTYSLGKF<br>GQRALDFYSIHVTRESNHPVKPLEQIGGNSCASGPVGKALSDACMGAVAS<br>FLTKYQDIILEHQKVIKKNEKRLANLKDIASANGLAFPKITLPPQPHTKEGI<br>EAYNNVVAQIVIWVNLNLWQKLKIGRDEAKPLQRLKGFPSFPLVERQAN<br>EVDWWDMVCNVKKLINEKKEDGKVFWQNLAGYKRQEALRPYLSSEED<br>RKKGKKFARYQFGDLLLHLEKKHGEDWGKVYDEAWERIDKKVEGLSKH<br>IKLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYF<br>KGGKLRFKKIKPEAFEANRFYTVINKKSGEIVPMEVNFNFDDPNLIILPLAF<br>GKRQGREFIWNDLLSLETGSLKLANGRVIEKTLYNRRTRQDEPALFVALT<br>FERREVLDSSNIKPMNLIGIDRGENIPAVIALTDPEGCPLSRFKDSLGNPTHI |

TABLE 8-continued

CasX 278-280, 285-288, 290, 291, 293, 300, 492, and 493 sequences

| Construct | Amino Acid Sequence |
|---|---|
| | LRIGESYKEKQRTIQAKKEVEQRRAGGYSRKYASKAKNLADDMVRNTAR DLLYYAVTQDAMLIFENLSRGFGRQGKRTFMAERQYTRMEDWLTAKLA YEGLSKTYLSKTLAQYTSKTCSNCGFTITSADYDRVLEKLKKTATGWMT TINGKELKVEGQITYYNRYKRQNVVKDLSVELDRLSEESVNNDISSWTKG RSGEALSLLKKRFSHRPVQEKFVCLNCGFETHADEQAALNIARSWLFLRS QEYKKYQTNKTTGNTDKRAFVETWQSFYRKKLKEVWKPAV (SEQ ID NO: 251) |
| 279 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKGK PHTNYFGRCNVSEHERLILLSPHKPEANDELVTYSLGKFGQRALDFYSIHV TRESNHPVKPLEQIGGNSCASGPVGKALSDACMGAVASFLTKYQDIILEHQ KVIKKNEKRLANLKDIASANGLAFPKITLPPQPHTKEGIEAYNNVVAQIVI WVNLNLWQKLKIGRDEAKPLQRLKGFPSFPLVERQANEVDWWDMVCNV KKLINEKKEDGKVFWQNLAGYKRQEALRPYLSSEEDRKKGKKFARYQFG DLLLHLEKKHGEDWGKVYDEAWERIDKKVEGLSKHIKLEEERRSEDAQS KAALTDWLRAKASFVIEGLKEADKDEFCRCELKLQKWYGDLRGKPFAIE AENSILDISGFSKQYNCAFIWQKDGVKKLNLYLIINYFKGGKLRFKKIKPE AFEANRFYTVINKKSGEIVPMEVNFNFDDPNLIILPLAFGKRQGREFIWNDL LSLETGSLKLANGRVIEKTLYNRRTRQDEPALFVALTFERREVLDSSNIKP MNLIGIDRGENIPAVIALTDPEGCPLSRFKDSLGNPTHILRIGESYKEKQRTI QAKKEVEQRRAGGYSRKYASKAKNLADDMVRNTARDLLYYAVTQDAM LIFENLSRGFGRQGKRTFMAERQYTRMEDWLTAKLAYEGLSKTYLSKTL AQYTSKTCSNCGFTITSADYDRVLEKLKKTATGWMTTINGKELKVEGQIT YYNRYKRQNVVKDLSVELDRLSEESVNNDISSWTKGRSGEALSLLKKRFS HRPVQEKFVCLNCGFETHADEQAALNIARSWLFLRSQEYKKYQTNKTTG NTDKRAFVETWQSFYRKKLKEVWKPAVTSPKKKRKV (SEQ ID NO: 252) |
| 280 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKGK PHTNYFGRCNVSEHERLILLSPHKPEANDELVTYSLGKFGQRALDFYSIHV TRESNHPVKPLEQIGGNSCASGPVGKALSDACMGAVASFLTKYQDIILEHQ KVIKKNEKRLANLKDIASANGLAFPKITLPPQPHTKEGIEAYNNVVAQIVI WVNLNLWQKLKIGRDEAKPLQRLKGFPSFPLVERQANEVDWWDMVCNV KKLINEKKEDGKVFWQNLAGYKRQEALRPYLSSEEDRKKGKKFARYQFG DLLLHLEKKHGEDWGKVYDEAWERIDKKVEGLSKHIKLEEERRSEDAQS KAALTDWLRAKASFVIEGLKEADKDEFCRCELKLQKWYGDLRGKPFAIE AENSILDISGFSKQYNCAFIWQKDGVKKLNLYLIINYFKGGKLRFKKIKPE AFEANRFYTVINKKSGEIVPMEVNFNFDDPNLIILPLAFGKRQGREFIWNDL LSLETGSLKLANGRVIEKTLYNRRTRQDEPALFVALTFERREVLDSSNIKP MNLIGIDRGENIPAVIALTDPEGCPLSRFKDSLGNPTHILRIGESYKEKQRTI QAKKEVEQRRAGGYSRKYASKAKNLADDMVRNTARDLLYYAVTQDAM LIFENLSRGFGRQGKRTFMAERQYTRMEDWLTAKLAYEGLSKTYLSKTL AQYTSKTCSNCGFTITSADYDRVLEKLKKTATGWMTTINGKELKVEGQIT YYNRYKRQNVVKDLSVELDRLSEESVNNDISSWTKGRSGEALSLLKKRFS HRPVQEKFVCLNCGFETHADEQAALNIARSWLFLRSQEYKKYQTNKTTG NTDKRAFVETWQSFYRKKLKEVWKPAVTSPKKKRKVPPPPKKKRKV (SEQ ID NO: 253) |
| 285 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKGK PHTNYFGRCNVSEHERLILLSPHKPEANDELVTYSLGKFGQRALDFYSIHV TRESNHPVKPLEQIGGNSCASGPVGKALSDACMGAVASFLTKYQDIILEHQ KVIKKNEKRLANLKDIASANGLAFPKITLPPQPHTKEGIEAYNNVVAQIVI WVNLNLWQKLKIGRDEAKPLQRLKGFPSFPLVERQANEVDWWDMVCNV KKLINEKKEDGKVFWQNLAGYKRQEALRPYLSSEEDRKKGKKFARYQFG DLLLHLEKKHGEDWGKVYDEAWERIDKKVEGLSKHIKLEEERRSEDAQS KAALTDWLRAKASFVIEGLKEADKDEFCRCELKLQKWYGDLRGKPFAIE AENSILDISGFSKQYNCAFIWQKDGVKKLNLYLIINYFKGGKLRFKKIKPE AFEANRFYTVINKKSGEIVPMEVNFNFDDPNLIILPLAFGKRQGREFIWNDL LSLETGSLKLANGRVIEKTLYNRRTRQDEPALFVALTFERREVLDSSNIKP MNLIGIDRGENIPAVIALTDPEGCPLSRFKDSLGNPTHILRIGESYKEKQRTI QAKKEVEQRRAGGYSRKYASKAKNLADDMVRNTARDLLYYAVTQDAM LIFENLSRGFGRQGKRTFMAERQYTRMEDWLTAKLAYEGLSKTYLSKTL AQYTSKTCSNCGFTITSADYDRVLEKLKKTATGWMTTINGKELKVEGQIT YYNRYKRQNVVKDLSVELDRLSEESVNNDISSWTKGRSGEALSLLKKRFS HRPVQEKFVCLNCGFETHADEQAALNIARSWLFLRSQEYKKYQTNKTTG NTDKRAFVETWQSFYRKKLKEVWKPAVTSPKKKRKVPPPHKKKHPDASV NFSEFSK (SEQ ID NO: 254) |
| 286 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKGK |

TABLE 8-continued

CasX 278-280, 285-288, 290, 291, 293, 300, 492, and 493 sequences

| Construct | Amino Acid Sequence |
|---|---|
|  | PHTNYFGRCNVSEHERLILLSPHKPEANDELVTYSLGKFGQRALDFYSIHV<br>TRESNHPVKPLEQIGGNSCASGPVGKALSDACMGAVASFLTKYQDIILEHQ<br>KVIKKNEKRLANLKDIASANGLAFPKITLPPQPHTKEGIEAYNNVVAQIVI<br>WVNLNLWQKLKIGRDEAKPLQRLKGFPSFPLVERQANEVDWWDMVCNV<br>KKLINEKKEDGKVFWQNLAGYKRQEALRPYLSSEEDRKKGKKFARYQFG<br>DLLLHLEKKHGEDWGKVYDEAWERIDKKVEGLSKHIKLEEERRSEDAQS<br>KAALTDWLRAKASFVIEGLKEADKDEFCRCELKLQKWYGDLRGKPFAIE<br>AENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDL<br>LSLETGSLKLANGRVIEKTLYNRRTRQDEPALFVALTFERREVLDSSNIKP<br>MNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAM<br>LIFENL SRGF GRQGKRTFMAERQYTRMEDWLTAKLAYEGLSKTYLSKTL<br>AQYTSKTCSNCGFTITSADYDRVLEKLKKTATGWMTTINGKELKVEGQIT<br>YYNRYKRQNVVKDLSVELDRLSEESVNNDISSWTKGRSGEALSLLKKRFS<br>HRPVQEKFVCLNCGFETHADEQAALNIARSWLFLRSQEYKKYQTNKTTG<br>NTDKRAFVETWQSFYRKKLKEVWKPAVTSPKKKRKVPPPQRPGPYDRPQ<br>RPGPYDRP (SEQ ID NO: 255) |
| 287 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKGK<br>PHTNYFGRCNVSEHERLILLSPHKPEANDELVTYSLGKFGQRALDFYSIHV<br>TRESNHPVKPLEQIGGNSCASGPVGKALSDACMGAVASFLTKYQDIILEHQ<br>KVIKKNEKRLANLKDIASANGLAFPKITLPPQPHTKEGIEAYNNVVAQIVI<br>WVNLNLWQKLKIGRDEAKPLQRLKGFPSFPLVERQANEVDWWDMVCNV<br>KKLINEKKEDGKVFWQNLAGYKRQEALRPYLSSEEDRKKGKKFARYQFG<br>DLLLHLEKKHGEDWGKVYDEAWERIDKKVEGLSKHIKLEEERRSEDAQS<br>KAALTDWLRAKASFVIEGLKEADKDEFCRCELKLQKWYGDLRGKPFAIE<br>AENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDL<br>LSLETGSLKLANGRVIEKTLYNRRTRQDEPALFVALTFERREVLDSSNIKP<br>MNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAM<br>LIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQIT<br>YYNRYKRQNVVKDLSVELDRLSEESVNNDISSWTKGRSGEALSLLKKRFS<br>HRPVQEKFVCLNCGFETHADEQAALNIARSWLFLRSQEYKKYQTNKTTG<br>NTDKRAFVETWQSFYRKKLKEVWKPAVTSPKKKRKVPPPLSPSLSPLLSPS<br>LSPL (SEQ ID NO: 256) |
| 288 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTMSSGFACSQCCQPLYVYKLEQVNDKG<br>KPHTNYFGRCNVSEHERLILLSPHKPEANDELVTYSLGKFGQRALDFYSIH<br>VTRESNHPVKPLEQIGGNSCASGPVGKALSDACMGAVASFLTKYQDIILEH<br>QKVIKKNEKRLANLKDIASANGLAFPKITLPPQPHTKEGIEAYNNVVAQIVI<br>WVNLNLWQKLKIGRDEAKPLQRLKGFPSFPLVERQANEVDWWDMVCNV<br>KKLINEKKEDGKVFWQNLAGYKRQEALRPYLSSEEDRKKGKKFARYQFG<br>DLLLHLEKKHGEDWGKVYDEAWERIDKKVEGLSKHIKLEEERRSEDAQS<br>KAALTDWLRAKASFVIEGLKEADKDEFCRCELKLQKWYGDLRGKPFAIE<br>AENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDL<br>LSLETGSLKLANGRVIEKTLYNRRTRQDEPALFVALTFERREVLDSSNIKP<br>MNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAM<br>LIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQIT<br>YYNRYKRQNVVKDLSVELDRLSEESVNNDISSWTKGRSGEALSLLKKRFS<br>HRPVQEKFVCLNCGFETHADEQAALNIARSWLFLRSQEYKKYQTNKTTG<br>NTDKRAFVETWQSFYRKKLKEVWKPAVTSPKKKRKVPPPRGKGGKGLG<br>KGGAKRHRK (SEQ ID NO: 257) |
| 290 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKGK<br>PHTNYFGRCNVSEHERLILLSPHKPEANDELVTYSLGKFGQRALDFYSIHV<br>TRESNHPVKPLEQIGGNSCASGPVGKALSDACMGAVASFLTKYQDIILEHQ<br>KVIKKNEKRLANLKDIASANGLAFPKITLPPQPHTKEGIEAYNNVVAQIVI<br>WVNLNLWQKLKIGRDEAKPLQRLKGFPSFPLVERQANEVDWWDMVCNV<br>KKLINEKKEDGKVFWQNLAGYKRQEALRPYLSSEEDRKKGKKFARYQFG<br>DLLLHLEKKHGEDWGKVYDEAWERIDKKVEGLSKHIKLEEERRSEDAQS<br>KAALTDWLRAKASFVIEGLKEADKDEFCRCELKLQKWYGDLRGKPFAIE<br>AENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDL<br>LSLETGSLKLANGRVIEKTLYNRRTRQDEPALFVALTFERREVLDSSNIKP |

TABLE 8-continued

CasX 278-280, 285-288, 290, 291, 293, 300, 492, and 493 sequences

| Construct | Amino Acid Sequence |
|---|---|
| | MNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAM<br>LIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQIT<br>YYNRYKRQNVVKDLSVELDRLSEESVNNDISSWTKGRSGEALSLLKKRFS<br>HRPVQEKFVCLNCGFETHADEQAALNIARSWLFLRSQEYKKYQTNKTTG<br>NTDKRAFVETWQSFYRKKLKEVWKPAVTSPKKKRKVPPPSRRRKANPTK<br>LSENAKKLAKEVEN (SEQ ID NO: 258) |
| 291 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKGK<br>PHTNYFGRCNVSEHERLILLSPHKPEANDELVTYSLGKFGQRALDFYSIHV<br>TRESNHPVKPLEQIGGNSCASGPVGKALSDACMGAVASFLTKYQDIILEHQ<br>KVIKKNEKRLANLKDIASANGLAFPKITLPPQPHTKEGIEAYNNVVAQIVI<br>WVNLNLWQKLKIGRDEAKPLQRLKGFPSFPLVERQANEVDWWDMVCNV<br>KKLINEKKEDGKVFWQNLAGYKRQEALRPYLSSEEDRKKGKKFARYQFG<br>DLLLHLEKKHGEDWGKVYDEAWERIDKKVEGLSKHIKLEEERRSEDAQS<br>KAALTDWLRAKASFVIEGLKEADKDEFCRCELKLQKWYGDLRGKPFAIE<br>AENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDL<br>LSLETGSLKLANGRVIEKTLYNRRTRQDEPALFVALTFERREVLDSSNIKP<br>MNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAM<br>LIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQIT<br>YYNRYKRQNVVKDLSVELDRLSEESVNNDISSWTKGRSGEALSLLKKRFS<br>HRPVQEKFVCLNCGFETHADEQAALNIARSWLFLRSQEYKKYQTNKTTG<br>NTDKRAFVETWQSFYRKKLKEVWKPAVTSPKKKRKVPPPPAAKRVKLD<br>(SEQ ID NO: 259) |
| 293 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKGK<br>PHTNYFGRCNVSEHERLILLSPHKPEANDELVTYSLGKFGQRALDFYSIHV<br>TRESNHPVKPLEQIGGNSCASGPVGKALSDACMGAVASFLTKYQDIILEHQ<br>KVIKKNEKRLANLKDIASANGLAFPKITLPPQPHTKEGIEAYNNVVAQIVI<br>WVNLNLWQKLKIGRDEAKPLQRLKGFPSFPLVERQANEVDWWDMVCNV<br>KKLINEKKEDGKVFWQNLAGYKRQEALRPYLSSEEDRKKGKKFARYQFG<br>DLLLHLEKKHGEDWGKVYDEAWERIDKKVEGLSKHIKLEEERRSEDAQS<br>KAALTDWLRAKASFVIEGLKEADKDEFCRCELKLQKWYGDLRGKPFAIE<br>AENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDL<br>LSLETGSLKLANGRVIEKTLYNRRTRQDEPALFVALTFERREVLDSSNIKP<br>MNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAM<br>LIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQIT<br>YYNRYKRQNVVKDLSVELDRLSEESVNNDISSWTKGRSGEALSLLKKRFS<br>HRPVQEKFVCLNCGFETHADEQAALNIARSWLFLRSQEYKKYQTNKTTG<br>NTDKRAFVETWQSFYRKKLKEVWKPAVTSPKKKRKVPPPKRSFSKAF<br>(SEQ ID NO: 260) |
| 300 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKGK<br>PHTNYFGRCNVSEHERLILLSPHKPEANDELVTYSLGKFGQRALDFYSIHV<br>TRESNHPVKPLEQIGGNSCASGPVGKALSDACMGAVASFLTKYQDIILEHQ<br>KVIKKNEKRLANLKDIASANGLAFPKITLPPQPHTKEGIEAYNNVVAQIVI<br>WVNLNLWQKLKIGRDEAKPLQRLKGFPSFPLVERQANEVDWWDMVCNV<br>KKLINEKKEDGKVFWQNLAGYKRQEALRPYLSSEEDRKKGKKFARYQFG<br>DLLLHLEKKHGEDWGKVYDEAWERIDKKVEGLSKHIKLEEERRSEDAQS<br>KAALTDWLRAKASFVIEGLKEADKDEFCRCELKLQKWYGDLRGKPFAIE<br>AENSILDISGFSKQYNCAFIWQKDGVKKLNLYLIINYFKGGKLRFKKIKPE<br>AFEANRFYTVINKKSGEIVPMEVNFNFDDPNLIILPLAFGKRQGREFIWNDL<br>LSLETGSLKLANGRVIEKTLYNRRTRQDEPALFVALTFERREVLDSSNIKP<br>MNLIGIDRGENIPAVIALTDPEGCPLSRFKDSLGNPTHILRIGESYKEKQRTI<br>QAKKEVEQRRAGGYSRKYASKAKNLADDMVRNTARDLLYYAVTQDAM<br>LIFENLSRGFGRQGKRTFMAERQYTRMEDWLTAKLAYEGLSKTYLSKTL<br>AQYTSKTCSNCGFTITSADYDRVLEKLKKTATGWMTTINGKELKVEGQIT<br>YYNRYKRQNVVKDLSVELDRLSEESVNNDISSWTKGRSGEALSLLKKRFS<br>HRPVQEKFVCLNCGFETHADEQAALNIARSWLFLRSQEYKKYQTNKTTG<br>NTDKRAFVETWQSFYRKKLKEVWKPAVTSPKKKRKVPPPKRGINDRNFW<br>RGENERKTR (SEQ ID NO: 261) |

TABLE 8-continued

CasX 278-280, 285-288, 290, 291, 293, 300, 492, and 493 sequences

| Construct | Amino Acid Sequence |
|---|---|
| 492 | MAPKKKRKVSRMQEIKRINKIRRRLVKDSNTKKAGKTGPMKTLLVRVMT<br>PDLRERLENLRKKPENIPQPISNTSRANLNKLLTDYTEMKKAILHVYWEEF<br>QKDPVGLMSRVAQPAPKNIDQRKLIPVKDGNERLTSSGFACSQCCQPLYV<br>YKLEQVNDKGKPHTNYFGRCNVSEHERLILLSPHKPEANDELVTYSLGKF<br>GQRALDFYSIHVTRESNHPVKPLEQIGGNSCASGPVGKALSDACMGAVAS<br>FLTKYQDIILEHQKVIKKNEKRLANLKDIASANGLAFPKITLPPQPHTKEGI<br>EAYNNVVAQIVIWVNLNLWQKLKIGRDEAKPLQRLKGFPSFPLVERQANE<br>VDWWDMVCNVKKLINEKKEDGKVFWQNLAGYKRQEALRPYLSSEEDR<br>KKGKKFARYQFGDLLLHLEKKHGEDWGKVYDEAWERIDKKVEGLSKHI<br>KLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYF<br>KGGKLRFKKIKPEAFEANRFYTVINKKSGEIVPMEVNFNFDDPNLIILPLAF<br>GKRQGREFIWNDLLSLETGSLKLANGRVIEKTLYNRRTRQDEPALFVALTF<br>ERREVLDSSNIKPMNLIGIDRGENIPAVIALTDPEGCPLSRFKDSLGNPTHIL<br>RIGESYKEKQRTIQAKKEVEQRRAGGYSRKYASKAKNLADDMVRNTARD<br>LLYYAVTQDAMLIFENLSRGFGRQGKRTFMAERQYTRMEDWLTAKLAY<br>EGLSKTYLSKTLAQYTSKTCSNCGFTITSADYDRVLEKLKKTATGWMTTI<br>NGKELKVEGQITYYNRYKRQNVVKDLSVELDRLSEESVNNDISSWTKGRS<br>GEALSLLKKRFSHRPVQEKFVCLNCGFETHADEQAALNIARSWLFLRSQE<br>YKKYQTNKTTGNTDKRAFVETWQSFYRKKLKEVWKPAVTSPKKKRKVP<br>PPPKKKRKV (SEQ ID NO: 262) |
| 493 | MAPKKKRKVSRMQEIKRINKIRRRLVKDSNTKKAGKTGPMKTLLVRVMT<br>PDLRERLENLRKKPENIPQPISNTSRANLNKLLTDYTEMKKAILHVYWEEF<br>QKDPVGLMSRVAQPAPKNIDQRKLIPVKDGNERLTSSGFACSQCCQPLYV<br>YKLEQVNDKGKPHTNYFGRCNVSEHERLILLSPHKPEANDELVTYSLGKF<br>GQRALDFYSIHVTRESNHPVKPLEQIGGNSCASGPVGKALSDACMGAVAS<br>FLTKYQDIILEHQKVIKKNEKRLANLKDIASANGLAFPKITLPPQPHTKEGI<br>EAYNNVVAQIVIWVNLNLWQKLKIGRDEAKPLQRLKGFPSFPLVERQANE<br>VDWWDMVCNVKKLINEKKEDGKVFWQNLAGYKRQEALRPYLSSEEDR<br>KKGKKFARYQFGDLLLHLEKKHGEDWGKVYDEAWERIDKKVEGLSKHI<br>KLEEERRSEDAQSKAALTDWLRAKASFVIEGLKEADKDEFCRCELKLQK<br>WYGDLRGKPFAIEAENSILDISGFSKQYNCAFIWQKDGVKKLNLYLIINYF<br>KGGKLRFKKIKPEAFEANRFYTVINKKSGEIVPMEVNFNFDDPNLIILPLAF<br>GKRQGREFIWNDLLSLETGSLKLANGRVIEKTLYNRRTRQDEPALFVALTF<br>ERREVLDSSNIKPMNLIGIDRGENIPAVIALTDPEGCPLSRFKDSLGNPTHIL<br>RIGESYKEKQRTIQAKKEVEQRRAGGYSRKYASKAKNLADDMVRNTARD<br>LLYYAVTQDAMLIFENLSRGFGRQGKRTFMAERQYTRMEDWLTAKLAY<br>EGLSKTYLSKTLAQYTSKTCSNCGFTITSADYDRVLEKLKKTATGWMTTI<br>NGKELKVEGQITYYNRYKRQNVVKDLSVELDRLSEESVNNDISSWTKGRS<br>GEALSLLKKRFSHRPVQEKFVCLNCGFETHADEQAALNIARSWLFLRSQE<br>YKKYQTNKTTGNTDKRAFVETWQSFYRKKLKEVWKPAVTSPKKKRKVP<br>PPPAAKRVKLD (SEQ ID NO: 263) |

TABLE 9

Nuclear localization sequence list

| CasX | NLS | DNA Sequence | Amino Acid Sequence |
|---|---|---|---|
| 278, 279, 280, 492, 493 | SV40 | CCAAAGAAGAAGCGGAAGG TC (SEQ ID NO: 264) | PKKKRKV (SEQ ID NO: 176) |
| 285 | SynthNLS3 | CACAAGAAGAAACATCCAGA CGCATCAGTCAACTTTAGCG AGTTCAGTAAA (SEQ ID NO: 265) | HKKKHPDASVNFSE FSK (SEQ ID NO: 207) |
| 286 | SynthNLS4 | CAGCGCCCTGGGCCTTACGA TAGGCCGCAAAGACCCGGAC CGTATGATCGCCCT (SEQ ID NO: 266) | QRPGPYDRPQRPGP YDRP (SEQ ID NO: 208) |
| 287 | SynthNLS5 | CTCAGCCCGAGTCTTAGTCC ACTGCTTTCCCCGTCCCTGTC TCCACTG (SEQ ID NO: 267) | LSPSLSPLLSPSLSPL (SEQ ID NO: 209) |
| 288 | SynthNLS6 | CGGGGCAAGGGTGGCAAGG GGCTTGGCAAGGGGGGGCA AGAGGCACAGGAAG (SEQ ID NO: 268) | RGKGGKGLGKGGA KRHRK (SEQ ID NO: 210) |

TABLE 9-continued

Nuclear localization sequence list

| CasX | NLS | DNA Sequence | Amino Acid Sequence |
|---|---|---|---|
| 290 | EGL-13 | AGCCGCCGCAGAAAAGCCAA TCCTACAAAACTGTCAGAAA ATGCGAAAAAACTTGCTAAG GAGGTGGAAAAC (SEQ ID NO: 269) | SRRRKANPTKLSEN AKKLAKEVEN (SEQ ID NO: 203) |
| 291 | c-Myc | CCTGCCGCAAAGCGAGTGAA ATTGGAC (SEQ ID NO: 270) | PAAKRVKLD (SEQ ID NO: 178) |
| 293 | Nucleolar RNA Helicase II | AAGCGGTCCTTCAGTAAGGC CTTT (SEQ ID NO: 271) | KRSFSKAF (SEQ ID NO: 199) |
| 300 | Influenza A protein | AAACGGGGAATAAACGACC GGAACTTCTGGCGCGGGGAA AACGAGCGCAAAACCCGA (SEQ ID NO: 272) | KRGINDRNFWRGEN ERKTR (SEQ ID NO: 197) |

Example 5: Design and Generation of CasX Constructs 387,395,485-491, and 494

In order to generate CasX 395, CasX 485, CasX 486, CasX 487, the codon optimized CasX 119 (based on the CasX 37 construct of Example 2, encoding Planctomycetes CasX SEQ ID NO: 2, with a A708K substitution and a [P793] deletion with fused NLS, and linked guide and non-targeting sequences), CasX 435, CasX 438, and CasX 484 (each based on CasX 119 construct of Example 2 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector comprising a KanR marker, colE1 ori, and CasX with fused NLS (pStx1) using standard cloning methods. Gibson primers were designed to amplify the CasX SEQ ID NO: 1 Helical I domain from amino acid 192-331 in its own vector to replace this corresponding region (aa 193-332) on CasX 119, CasX 435, CasX 438, and CasX 484 in pStx1 respectively. The Helical I domain from CasX SEQ ID NO: I was amplified with primers oIC768 and oIC784 using Q5 DNA polymerase according to the manufacturer's protocol. The destination vector containing the desired CasX variant was amplified with primers oIC765 and oIC764 using Q5 DNA polymerase according to the manufacturer's protocol. The two fragments were purified by gel extraction from a 1% agarose gel using Zymoclean™ Gel DNA Recovery Kit according to the manufacturer's protocol. The insert and backbone fragments were then pieced together using Gibson Assembly® (New England BioLabs Cat #E2621S) following the manufacturer's protocol. Assembled products in the pStx1 staging vector were transformed into chemically-competent Turbo Competent E. coli bacterial cells, plated on LB-Agar plates (LB: Teknova Cat #L9315, Agar: Quartzy Cat #214510) containing kanamycin and incubated at 37° C. Individual colonies were picked and miniprepped using Qiagen spin Miniprep Kit following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly.

Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent E. coli (NEB Cat #C29841), plated on LB-Agar plates (LB: Teknova Cat #L9315, Agar: Quartzy Cat #214510) containing carbenicillin and incubated at 37° C. Individual colonies were picked and miniprepped using Qiagen spin Miniprep Kit following the manufacturer's protocol. The resultant plasmids were sequenced using Sanger sequencing to ensure correct ligation.

In order to generate CasX 488, CasX 489, CasX 490, and CasX 491 (sequences in Table 10), the codon optimized CasX 119 (based on the CasX 37 construct of Example 2, encoding Planctomycetes CasX SEQ ID NO: 2, with a A708K substitution and a [P793] deletion with fused NLS, and linked guide and non-targeting sequences), CasX 435, CasX 438, and CasX 484 (each based on CasX119 construct of Example 2 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector that was made up of a KanR marker, colE1 ori, and STX with fused NLS (pStx1) using standard cloning methods. Gibson primers were designed to amplify the CasX Stx1 NTSB domain from amino acid 101-191 and Helical 1 domain from amino acid 192-331 in its own vector to replace this similar region (aa 103-332) on CasX 119. CasX 435, CasX 438, and CasX 484 in pStx1 respectively. The NTSB and Helical I domain from CasX SEQ ID NO: I were amplified with primers oIC766 and oIC784 using Q5 DNA polymerase according to the manufacturer's protocol. The destination vector containing the desired CasX variant was amplified with primers oIC762 and oIC765 using Q5 DNA polymerase according to the manufacturer's protocol. The two fragments were purified by gel extraction from a 1% agarose gel using Zymoclean™ Gel DNA Recovery Kit according to the manufacturer's protocol. The insert and backbone fragments were then pieced together using Gibson Assembly® (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and miniprepped using Qiagen spin Miniprep Kit following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly. Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C29841), plated on LB-Agar plates (LB: Teknova Cat #L9315, Agar: Quartzy Cat #214510) containing carbenicillin and incubated at 37° C. Individual colonies were picked and miniprepped using Qiagen spin Miniprep Kit and following the manufacturer's protocol. The resultant plasmids were sequenced using Sanger sequencing to ensure correct ligation.

In order to generate CasX 387 and CasX 494 (sequences in Table 10), the codon optimized CasX 119 (based on the CasX 37 construct of Example 2, encoding Planctomycetes CasX SEQ ID NO: 2, with a A708K substitution and a [P793] deletion with fused NLS, and linked guide and non-targeting sequences) and CasX 484 (based on CasX119 construct of Example 2 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector that was made up of a KanR marker, colE1 on, and STX with fused NLS (pStx1) using standard cloning methods. Gibson primers were designed to amplify the CasX Stx1 NTSB domain from amino acid 101-191 in its own vector to replace this similar region (aa 103-192) on CasX 119 and CasX 484 in pStx1 respectively. The NTSB domain from CasX Stx1 was amplified with primers oIC766 and oIC767 using Q5 DNA polymerase according to the manufacturer's protocol. The destination vector containing the desired CasX variant was amplified with primers oIC763 and oIC762 using Q5 DNA polymerase according to the manufacturer's protocol. The two fragments were purified by gel extraction from a 1% agarose gel using Zymoclean™ Gel DNA Recovery Kit according to the manufacturer's protocol. The insert and backbone fragments were then pieced together using Gibson Assembly® (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and miniprepped using Qiagen spin Miniprep Kit following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C29841), plated on LB-Agar plates (LB: Teknova Cat #L9315, Agar: Quartzy Cat #214510) containing carbenicillin and incubated at 37° C. Individual colonies were picked and miniprepped using Qiagen spin Miniprep Kit and following the manufacturer's protocol. The resultant plasmids were sequenced using Sanger sequencing to ensure correct ligation. Sequences of the resulting constructs are listed in Table 10.

TABLE 10

Sequences of CasX 395 and 485-491

| Construct | DNA Sequence | Amino Acid Sequence |
|---|---|---|
| CasX 387 | (SEQ ID NO: 283) | MAPKKKRKVSRQEIKRINKIRRRLVKDSNTKKAGKTGPMKTLL VRVMTPDLRERLENLRKKPENIPQPISNTSRANLNKLLTDYTEM KKAILHVYWEEFQKDPVGLMSRVAQPASKKIDQNKLKPEMDE KGNLTTAGFACSQCGQPLFVYKLEQVSEKGKAYTNYFGRCNV AEHEKLILLAQLKPEKDSDEAVTYSLGKFGQRALDFYSIHVTRE SNHPVKPLEQIGGNSCASGPVGKALSDACMGAVASFLTKYQDII LEHQKVIKKNEKRLANLKDIASANGLAFPKITLPPQPHTKEGIEA YNNVVAQIVIWVNLNLWQKLKIGRDEAKPLQRLKGFPSFPLVE RQANEVDWWDMVCNVKKLINEKKEDGKVFWQNLAGYKRQE ALRPYLSSEEDRKKGKKFARYQFGDLLLHLEKKHGEDWGKVY DEAWERIDKKVEGLSKHIKLEEERRSEDAQSKAALTDWLRAKA SFVIEGLKEADKDEFCRCELKLQKWYGDLRGKPFAIEAENSILDI SGFSKQYNCAFIWQKDGVKKLNLYLIINYFKGGKLRFKKIKPEA FEANRFYTVINKKSGEIVPMEVNFNFDDPNLIILPLAFGKRQGRE FIWNDLLSLETGSLKLANGRVIEKTLYNRRTRQDEPALFVALTF ERREVLDSSNIKPMNLIGIDRGENIPAVIALTDPEGCPLSRFKDSL GNPTHILRIGESYKEKQRTIQAKKEVEQRRAGGYSRKYASKAK NLADDMVRNTARDLLYYAVTQDAMLIFENLSRGFGRQGKRTF |

TABLE 10-continued

Sequences of CasX 395 and 485-491

| Construct | DNA Sequence | Amino Acid Sequence |
|---|---|---|
| | | MAERQYTRMEDWLTAKLAYEGLSKTYLSKTLAQYTSKTCSNC
GFTITSADYDRVLEKLKKTATGWMTTINGKELKVEGQITYYNR
YKRQNVVKDLSVELDRLSEESVNNDISSWTKGRSGEALSLLKK
RFSHRPVQEKFVCLNCGFETHADEQAALNIARSWLFLRSQEYK
KYQTNKTTGNTDKRAFVETWQSFYRKKLKEVWKPAVTSPKKK
RKV (SEQ ID NO: 273) |
| CasX 395 | (SEQ ID NO: 284) | MAPKKKRKVSRQEIKRINKIRRRLVKDSNTKKAGKTGPMKTLL
VRVMTPDLRERLENLRKKPENIPQPISNTSRANLNKLLTDYTEM
KKAILHVYWEEFQKDPVGLMSRVAQPAPKNIDQRKLIPVKDGN
ERLTSSGFACSQCCQPLYVYKLEQVNDGKPHTNYFGRCNVSE
HERLILLSPHKPEANDELVTYSLGKFGQRALDFYSIHVTKESTHP
VKPLAQIAGNRYASGPVGKALSDACMGTIASFLSKYQDIIIEHQ
KVVKGNQKRLESLRELAGKENLEYPSVTLPPQPHTKEGVDAYN
EVIARVRMWVNLNLWQKLKLSRDDAKPLLRLKGFPSFPLVERQ
ANEVDWWDMVCNVKKLINEKKEDGKVFWQNLAGYKRQEAL
RPYLSSEEDRKKGKKFARYQFGDLLLHLEKKHGEDWGKVYDE
AWERIDKKVEGLSKHIKLEEERRSEDAQSKAALTDWLRAKASF
VIEGLKEADKDEFCRCELKLQKWYGDLRGKPFAIEAAENSILDIS
GFSKQYNCAFIWQKDGVKKLNLYLIINYFKGGKLRFKKIKPEAF
EANRFYTVINKKSGEIVPMEVNFNFDDPNLIILPLAFGKRQGREF
IWNDLLSETGSLKLANGRVIEKTLYNRRTRQDEPALFVALTFE
RREVLDSSNIKPMNLIGIDRGENIPAVIALTDPEGCPLSRFKDSLG
NPTHILRIGESYKEKQRTIQAKKEVEQRRAGGYSRKYASKAKN
LADDMVRNTARDLLYYAVTQDAMLIFENLSRGFGRQGKRTFM
AERQYTRMEDWLTAKLAYEGLSKTYLSKTLAQYTSKTCSNCG
FTITSADYDRVLEKLKKTATGWMTTINGKELKVEGQITYYNRY
KRQNVVKDLSVELDRLSEESVNNDISSWTKGRSGEALSLLKKR
FSHRPVQEKFVCLNCGFETHADEQAALNIARSWLFLRSQEYKK
YQTNKTTGNTDKRAFVETWQSFYRKKLKEVWKPAVTSPKKKR
KVTSPKKKRKV (SEQ ID NO: 274) |
| CasX 485 | (SEQ ID NO: 285) | MAPKKKRKVSRQEIKRINKIRRRLVKDSNTKKAGKTGPMKTLL
VRVMTPDLRERLENLRKKPENIPQPISNTSRANLNKLLTDYTEM
KKAILHVYWEEFQKDPVGLMSRVAQPAPKNIDQRKLIPVKDGN
ERLTSSGFACSQCCQPLYVYKLEQVNDGKPHTNYFGRCNVSE
HERLILLSPHKPEANDELVTYSLGKFGQRALDFYSIHVTKESTHP
VKPLAQIAGNRYASGPVGKALSDACMGTIASFLSKYQDIIIEHQ
KVVKGNQKRLESLRELAGKENLEYPSVTLPPQPHTKEGVDAYN
EVIARVRMWVNLNLWQKLKLSRDDAKPLLRLKGFPSFPLVERQ
ANEVDWWDMVCNVKKLINEKKEDGKVFWQNLAGYKRQEAL
RPYLSSEEDRKKGKKFARYQLGDLLLHLEKKHGEDWGKVYDE
AWERIDKKVEGLSKHIKLEEERRSEDAQSKAALTDWLRAKASF
VIEGLKEADKDEFCRCELKLQKWYGDLRGKPFAIEAAENSILDIS
GFSKQYNCAFIWQKDGVKKLNLYLIINYFKGGKLRFKKIKPEAF
EANRFYTVINKKSGEIVPMEVNFNFDDPNLIILPLAFGKRQGREF
IWNDLLSETGSLKLANGRVIEKTLYNRRTRQDEPALFVALTFE
RREVLDSSNIKPMNLIGVDRGENIPAVIALTDPEGCPLSRFKDSL
GNPTHILRIGESYKEKQRTIQAKKEVEQRRAGGYSRKYASKAK
NLADDMVRNTARDLLYYAVTQDAMLIFENLSRGFGRQGKRTF
MAERQYTRMEDWLTAKLAYEGLSKTYLSKTLAQYTSKTCSNC
GFTITSADYDRVLEKLKKTATGWMTTINGKELKVEGQITYYNR
RKRQNVVKDLSVELDRLSEESVNNDISSWTKGRSGEALSLLKK
RFSHRPVQEKFVCLNCGFETHADEQAALNIARSWLFLRSQEYK
KYQTNKTTGNTDKRAFVETWQSFYRKKIKEVWKPAVTSPKKK
RKV (SEQ ID NO: 275) |
| CasX 486 | (SEQ ID NO: 286) | MAPKKKRKVSRQEIKRINKIRRRLVKDSNTKKAGKTGPMKTLL
VRVMTPDLRERLENLRKKPENIPQPISNTSRANLNKLLTDYTEM
KKAILHVYWEEFQKDPVGLMSRVAQPAPKNIDQRKLIPVKDGN
ERLTSSGFACSQCCQPLYVYKLEQVNDGKPHTNYFGRCNVSE
HERLILLSPHKPEANDELVTYSLGKFGQRALDFYSIHVTKESTHP
VKPLAQIAGNRYASGPVGKALSDACMGTIASFLSKYQDIIIEHQ
KVVKGNQKRLESLRELAGKENLEYPSVTLPPQPHTKEGVDAYN
EVIARVRMWVNLNLWQKLKLSRDDAKPLLRLKGFPSFPLVERQ
ANEVDWWDMVCNVKKLINEKKEDGKVFWQNLAGYKRQEAL
RPYLSSEEDRKKGKKFARYQLGDLLKHLEKKHGEDWGKVYDE
AWERIDKKVEGLSKHIKLEEERRSEDAQSKAALTDWLRAKASF
VIEGLKEADKDEFCRCELKLQKWYGDLRGKPFAIEAAENSILDIS
GFSKQYNCAFIWQKDGVKKLNLYLIINYFKGGKLRFKKIKPEAF
EANRFYTVINKKSGEIVPMEVNFNFDDPNLIILPLAFGKRQGREF
IWNDLLSETGSLKLANGRVIEKTLYNRRTRQDEPALFVALTFE
RREVLDSSNIKPMNLIGVDRGENIPAVIALTDPEGCPLSRFKDSL
GNPTHILRIGESYKEKQRTIQAKKEVEQRRAGGYSRKYASKAK
NLADDMVRNTARDLLYYAVTQDAMLIFENISRGFGRQGKRTF |

TABLE 10-continued

Sequences of CasX 395 and 485-491

| Construct | DNA Sequence | Amino Acid Sequence |
|---|---|---|
| | | MAERQYTRMEDWLTAKLAYEGLSKTYLSKTLAQYTSKTCSNC GFTITSADYDRVLEKLKKTATGWMTTINGKELKVEGQITYYNR RKRQNVVKDLSVELDRLSEESVNNDISSWTKGRSGEALSLLKK RFSHRPVQEKFVCLNCGFETHADEQAALNIARSWLFLRSQEYK KYQTNKTTGNTDKRAFVETWQSFYRKKLKEVWKPAVTSPKKK RKV (SEQ ID NO: 276) |
| CasX 487 | (SEQ ID NO: 287) | MAPKKKRKVSRQEIKRINKIRRRLVKDSNTKKAGKTGPMKTLL VRVMTPDLRERLENLRKKPENIPQPISNTSRANLNKLLTDYTEM KKAILHVYWEEFQKDPVGLMSRVAQPAPKNIDQRKLIPVKDGN ERLTSSGFACSQCCQPLYVYKLEQVNDGKPHTNYFGRCNVSE HERLILLSPHKPEANDELVTYSLGKFGQRALDFYSIHVTKESTHP VKPLAQIAGNRYASGPVGKALSDACMGTIASFLSKYQDIIIEHQ KVVKGNQKRLESLRELAGKENLEYPSVTLPPQPHTKEGVDAYN EVIARVRMWVNLNLWQKLKLSRDDAKPLLRLKGFPSFPLVERQ ANEVDWWDMVCNVKKLINEKKEDGKVFWQNLAGYKRQEAL RPYLSSEEDRKKGKKFARYQLGDLLLHLEKKHGEDWGKVYDE AWERIDKKVEGLSKHIKLEEERRSEDAQSKAALTDWLRAKASF VIEGLKEADKDEFCRCELKLQKWYGDLRGKPFAIEAENSILDIS GFSKQYNCAFIWQKDGVKKLNLYLIINYFKGGKLRFKKIKPEAF EANRFYTVINKKSGEIVPMEVNFNFDDPNLIILPLAFGKRQGREF IWNDLLSLETGSLKLANGRVIEKTLYNRRTRQDEPALFVALTFE RREVLDSSNIKPMNLIGVDRGENIPAVIALTDPEGCPLSRFKDSL GNPTHILRIGESYKEKQRTIQAKKEVEQRRAGGYSRKYASKAK NLADDMVRNTARDLLYYAVTQDAMLIFENLSRGFGRQGKRTF MAERQYTRMEDWLTAKLAYEGLSKTYLSKTLAQYTSKTCSNC GFTITSADYDRVLEKLKKTATGWMTTINGKELKVEGQITYYNR YKRQNVVKDLSVELDRLSEESVNNDISSWTKGRSGEALSLLKK RFSHRPVQEKFVCLNCGFETHADEQAALNIARSWLFLRSQEYK KYQTNKTTGNTDKRAFVETWQSFYRKKLKEVWKPAVTSPKKK RKV (SEQ ID NO: 277) |
| CasX 488 | (SEQ ID NO: 288) | MAPKKKRKVSRQEIKRINKIRRRLVKDSNTKKAGKTGPMKTLL VRVMTPDLRERLENLRKKPENIPQPISNTSRANLNKLLTDYTEM KKAILHVYWEEFQKDPVGLMSRVAQPASKKIDQNKLKPEMDE KGNLTTAGFACSQCGQPLFVYKLEQVSEKGKAYTNYFGRCNV AEHEKLILLAQLKPEKDSDEAVTYSLGKFGQRALDFYSIHVTKE STHPVKPLAQIAGNRYASGPVGKALSDACMGTIASFLSKYQDIII EHQKVVKGNQKRLESLRELAGKENLEYPSVTLPPQPHTKEGVD AYNEVIARVRMWVNLNLWQKLKLSRDDAKPLLRLKGFPSFPL VERQANEVDWWDMVCNVKKLINEKKEDGKVFWQNLAGYKR QEALRPYLSSEEDRKKGKKFARYQFGDLLLHLEKKHGEDWGK VYDEAWERIDKKVEGLSKHIKLEEERRSEDAQSKAALTDWLRA KASFVIEGLKEADKDEFCRCELKLQKWYGDLRGKPFAIEAENSI LDISGFSKQYNCAFIWQKDGVKKLNLYLIINYFKGGKLRFKKIK PEAFEANRFYTVINKKSGEIVPMEVNFNFDDPNLIILPLAFGKRQ GREFIWNDLLSLETGSLKLANGRVTEKTLYNRRTRQDEPALFVA LTFERREVLDSSNIKPMNLIGIDRGENIPAVIALTDPEGCPLSRFK DSLGNPTHILRIGESYKEKQRTIQAKKEVEQRRAGGYSRKYASK AKNLADDMVRNTARDLLYYAVTQDAMLIFENLSRGFGRQGKR TFMAERQYTRMEDWLTAKLAYEGLSKTYLSKTLAQYTSKTCS NCGFTITSADYDRVLEKLKKTATGWMTTINGKELKVEGQITYY NRYKRQNVVKDLSVELDRLSEESVNNDISSWTKGRSGEALSLL KKRFSHRPVQEKFVCLNCGFETHADEQAALNIARSWLFLRSQE YKKYQTNKTTGNTDKRAFVETWQSFYRKKLKEVWKPAVTSPK KKRKV (SEQ ID NO: 278) |
| CasX 489 | (SEQ ID NO: 289) | MAPKKKRKVSRQEIKRINKIRRRLVKDSNTKKAGKTGPMKTLL VRVMTPDLRERLENLRKKPENIPQPISNTSRANLNKLLTDYTEM KKAILHVYWEEFQKDPVGLMSRVAQPASKKIDQNKLKPEMDE KGNLTTAGFACSQCGQPLFVYKLEQVSEKGKAYTNYFGRCNV AEHEKLILLAQLKPEKDSDEAVTYSLGKFGQRALDFYSIHVTKE STHPVKPLAQIAGNRYASGPVGKALSDACMGTIASFLSKYQDIII EHQKVVKGNQKRLESLRELAGKENLEYPSVTLPPQPHTKEGVD AYNEVIARVRMWVNLNLWQKLKLSRDDAKPLLRLKGFPSFPL VERQANEVDWWDMVCNVKKLINEKKEDGKVFWQNLAGYKR QEALRPYLSSEEDRKKGKKFARYQLGDLLLHLEKKHGEDWGK VYDEAWERIDKKVEGLSKHIKLEEERRSEDAQSKAALTDWLRA KASFVIEGLKEADKDEFCRCELKLQKWYGDLRGKPFAIEAENSI LDISGISKQYNCAFIWQKDGVKKINLYLIINYFKGGKLRFKKIK PEAFEANRFYTVINKKSGEIVPMEVNFNFDDPNLIILPLAFGKRQ GREFIWNDLLSLETGSLKLANGRVIEKTLYNRRTRQDEPALFVA LTFERREVLDSSNIKPMNLIGVDRGENIPAVIALTDPEGCPLSRF KDSLGNPTHILRIGESYKEKQRTIQAKKEVEQRRAGGYSRKYAS KAKNLADDMVRNTARDLLYYAVTQDAMLIFENLSRGFGRQGK |

TABLE 10-continued

Sequences of CasX 395 and 485-491

| Construct | DNA Sequence | Amino Acid Sequence |
|---|---|---|
| | | RTFMAERQYTRMEDWLTAKLAYEGLSKTYLSKTLAQYTSKTC SNCGFTITSADYDRVLEKLKKTATGWMTTINGKELKVEGQITY YNRRKRQNVVKDLSVELDRLSEESVNNDISSWTKGRSEALSL LKKRFSHRPVQEKFVCLNCGFETHADEQAALNIARSWLFLRSQ EYKKYQTNKTTGNTDKRAFVETWQSFYRKKLKEVWKPAVTSP KKKRKV (SEQ ID NO: 279) |
| CasX 490 | (SEQ ID NO: 290) | MAPKKKRKVSRQEIKRINKIRRRLVKDSNTKKAGKTGPMKTLL VRVMTPDLRERLENLRKKPENIPQPISNTSRANLNKLLTDYTEM KKAILHVYWEEFQKDPVGLMSRVAQPASKKIDQNKLKPEMDE KGNLTTAGFACSQCGQPLFVYKLEQVSEKGKAYTNYFGRCNV AEHEKLILLAQLKPEKDSDEAVTYSLGKFGQRALDFYSIHVTKE STHPVKPLAQIAGNRYASGPVGKALSDACMGTIASFLSKYQDIII EHQKVVKGNQKRLESLRELAGKENLEYPSVTLPPQPHTKEGVD AYNEVIARVRMWVNLNLWQKLKLSRDDAKPLLRLKGFPSFPL VERQANEVDWWDMVCNVKKLINEKKEDGKVFWQNLAGYKR QEALRPYLSSEEDRKKGKKFARYQLGDLLKHLEKKHGEDWGK VYDEAWERIDKKVEGLSKHIKLEEERRSEDAQSKAALTDWLRA KASFVIEGLKEADKDEFCRCELKLQKWYGDLRGKPFAIEAENSI LDISGFSKQYNCAFIWQKDGVKKLNLYLIINYFKGGKLRFKKIK PEAFEANRFYTVINKKSGEIVPMEVNFNFDDPNLIILPLAFGKRQ GREFIWNDLLSLETGSLKLANGRVIEKTLYNRRTRQDEPALFVA LTFERREVLDSSNIKPMNLIGVDRGENIPAVIALTDPEGCPLSRF KDSLGNPTHILRIGESYKEKQRTIQAKKEVEQRRAGGYSRKYAS KAKNLADDMVRNTARDLLYYAVTQDAMLIFENLSRGFGRQGK RTFMAERQYTRMEDWLTAKLAYEGLSKTYLSKTLAQYTSKTC SNCGFTITSADYDRVLEKLKKTATGWMTTINGKELKVEGQITY YNRRKRQNVVKDLSVELDRLSEESVNNDISSWTKGRSEALSL LKKRFSHRPVQEKFVCLNCGFETHADEQAALNIARSWLFLRSQ EYKKYQTNKTTGNTDKRAFVETWQSFYRKKLKEVWKPAVTSP KKKRKV (SEQ ID NO: 280) |
| CasX 491 | (SEQ ID NO: 291) | MAPKKKRKVSRQEIKRINKIRRRLVKDSNTKKAGKTGPMKTLL VRVMTPDLRERLENLRKKPENIPQPISNTSRANLNKLLTDYTEM KKAILHVYWEEFQKDPVGLMSRVAQPASKKIDQNKLKPEMDE KGNLTTAGFACSQCGQPLFVYKLEQVSEKGKAYTNYFGRCNV AEHEKLILLAQLKPEKDSDEAVTYSLGKFGQRALDFYSIHVTKE STHPVKPLAQIAGNRYASGPVGKALSDACMGTIASFLSKYQDIII EHQKVVKGNQKRLESLRELAGKENLEYPSVTLPPQPHTKEGVD AYNEVIARVRMWVNLNLWQKLKLSRDDAKPLLRLKGFPSFPL VERQANEVDWWDMVCNVKKLINEKKEDGKVFWQNLAGYKR QEALRPYLSSEEDRKKGKKFARYQLGDLLLHLEKKHGEDWGK VYDEAWERIDKKVEGLSKHIKLEEERRSEDAQSKAALTDWLRA KASFVIEGLKEADKDEFCRCELKLQKWYGDLRGKPFAIEAENSI LDISGFSKQYNCAFIWQKDGVKKLNLYLIINYFKGGKLRFKKIK PEAFEANRFYTVINKKSGEIVPMEVNFNFDDPNLIILPLAFGKRQ GREFIWNDLLSLETGSLKLANGRVIEKTLYNRRTRQDEPALFVA LTFERREVLDSSNIKPMNLIGVDRGENIPAVIALTDPEGCPLSRF KDSLGNPTHILRIGESYKEKQRTIQAKKEVEQRRAGGYSRKYAS KAKNLADDMVRNTARDLLYYAVTQDAMLIFENLSRGFGRQGK RTFMAERQYTRMEDWLTAKLAYEGLSKTYLSKTLAQYTSKTC SNCGFTITSADYDRVLEKLKKTATGWMTTINGKELKVEGQITY YNRYKRQNVVKDLSVELDRLSEESVNNDISSWTKGRSEALSL LKKRFSHRPVQEKFVCLNCGFETHADEQAALNIARSWLFLRSQ EYKKYQTNKTTGNTDKRAFVETWQSFYRKKLKEVWKPAVTSP KKKRKV (SEQ ID NO: 281) |
| CasX 494 | (SEQ ID NO: 292) | MAPKKKRKVSRQEIKRINKIRRRLVKDSNTKKAGKTGPMKTLL VRVMTPDLRERLENLRKKPENIPQPISNTSRANLNKLLTDYTEM KKAILHVYWEEFQKDPVGLMSRVAQPASKKIDQNKLKPEMDE KGNLTTAGFACSQCGQPLFVYKLEQVSEKGKAYTNYFGRCNV AEHEKLILLAQLKPEKDSDEAVTYSLGKFGQRALDFYSIHVTRE SNHPVKPLEQIGGNSCASGPVGKALSDACMGAVASFLTKYQDII LEHQKVIKKNEKRLANLKDIASANGLAFPKITLPPQPHTKEGIEA YNNVVAQIVIWVNLNLWQKLKIGRDEAKPLQRLKGFPSFPLVE RQANEVDWWDMVCNVKKLINEKKEDGKVFWQNLAGYKRQE ALRPYLSSEEDRKKGKKFARYQLGDLLLHLEKKHGEDWGKVY DEAWERIDKKVEGLSKHIKLEEERRSEDAQSKAALTDWLRAKA SFVIEGLKEADKDEFCRCELKLQKWYGDLRGKPFAIEAENSILDI SGFSKQYNCAFIWQKDGVKKLNLYLIINYFKGGKLRFKKIKPEA FEANRFYTVINKKSGEIVPMEVNFNFDDPNLIILPLAFGKRQGRE FIWNDLLSLETGSLKLANGRVIEKTLYNRRTRQDEPALFVALTF ERREVLDSSNIKPMNLIGVDRGENIPAVIALTDPEGCPLSRFKDS LGNPTHILRIGESYKEKQRTIQAKKEVEQRRAGGYSRKYASKA KNLADDMVRNTARDLLYYAVTQDAMLIFENLSRGFGRQGKRT |

TABLE 10-continued

Sequences of CasX 395 and 485-491

| Construct | DNA Sequence | Amino Acid Sequence |
|---|---|---|
| | | FMAERQYTRMEDWLTAKLAYEGLSKTYLSKTLAQYTSKTCSN CGFTITSADYDRVLEKLKKTATGWMTTINGKELKVEGQITYYN RYKRQNVVKDLSVELDRLSEESVNNDISSWTKGRSGEALSLLK KRFSHRPVQEKFVCLNCGFETHADEQAALNIARSWLFLRSQEY KKYQTNKTTGNTDKRAFVETWQSFYRKKLKEVWKPAVTSPKK KRKV (SEQ ID NO: 282) |

Example 6: Generation of RNA Guides

For the generation of RNA single guides and spacers, templates for in vitro transcription were generated by performing PCR with Q5 polymerase (NEB M0491) according to the recommended protocol, with template oligos for each backbone and amplification primers with the T7 promoter and the spacer sequence. The DNA primer sequences for the T7 promoter, guide and spacer for guides and spacers are presented in Table 11, below. The template oligos, labeled "backbone fwd" and "backbone rev" for each scaffold, were included at a final concentration of 20 nM each, and the amplification primers (T7 promoter and the unique spacer primer) were included at a final concentration of 1 uM each. The sg2, sg32, sg64, and sg174 guides correspond to SEQ ID NOS: 5, 2104, 2106, and 2238, respectively, with the exception that sg2, sg32, and sg64 were modified with an additional 5' G to increase transcription efficiency (compare sequences in Table 11 to Table 2). The 7.37 spacer targets beta2-microglobulin (B2M). Following PCR amplification, templates were cleaned and isolated by phenol-chloroform-isoamyl alcohol extraction followed by ethanol precipitation.

In vitro transcriptions were carried out in buffer containing 50 mM Tris pH 8.0, 30 mM $MgCl_2$, 0.01% Triton X-100, 2 mM spermidine, 20 mM DTT, 5 mM NTPs, 0.5 µM template, and 100 µg/mL T7 RNA polymerase. Reactions were incubated at 37° C. overnight. 20 units of DNase I (Promega #M6101) were added per 1 mL of transcription volume and incubated for one hour. RNA products were purified via denaturing PAGE, ethanol precipitated, and resuspended in IX phosphate buffered saline. To fold the sgRNAs, samples were heated to 70° C. for 5 min and then cooled to room temperature. The reactions were supplemented to 1 mM final $MgCl_2$ concentration, heated to 50° C. for 5 min and then cooled to room temperature. Final RNA guide products were stored at −80° C.

TABLE 11

Sequences for generation of guide RNA

| Primer | Primer sequence | RNA product |
|---|---|---|
| T7 promoter primer | GAAATTAATACGACTCACTATA (SEQ ID NO: 293) | Used for all |
| sg2 backbone fwd | GAAATTAATACGACTCACTATAGGTACTGG CGCTTTTATCTCATTACTTTGAGAGCCATCA CCAGCGACTATGTCGTATGGGTAAAG (SEQ ID NO: 294) | GGUACUGGCGCUU UUAUCUCAUUACU UUGAGAGCCAUCA CCAGCGACUAUGU |
| sg2 backbone rev | CTTTGATGCTTCTTATTTATCGGATTTCTCTC CGATAAATAAGCGCTTTACCCATACGACAT AGTCGCTGGTGATGGC (SEQ ID NO: 295) | CGUAUGGGUAAA GCGCUUAUUUAUC GGAGAGAAAUCCG |
| sg2.7.37 spacer primer | CGGAGCGAGACATCTCGGCCCTTTGATGCT TCTTATTTATCGGATTTCTCTCCG (SEQ ID NO: 296) | AUAAAUAAGAAG CAUCAAAGGGCCG AGAUGUCUCGCUC CG (SEQ ID NO: 306) |
| sg32 backbone fwd | GAAATTAATACGACTCACTATAGGTACTGG CGCTTTTATCTCATTACTTTGAGAGCCATCA CCAGCGACTATGTCGTATGGGTAAAGCGC (SEQ ID NO: 297) | GGUACUGGCGCUU UUAUCUCAUUACU UUGAGAGCCAUCA CCAGCGACUAUGU |
| sg32 backbone rev | CTTTGATGCTTCCCTCCGAAGAGGGCGCTTT ACCCATACGACATAG (SEQ ID NO: 298) | CGUAUGGGUAAA GCGCCCUCUUCGG |
| sg32.7.37 spacer primer | CGGAGCGAGACATCTCGGCCCTTTGATGCT TCCCTCCGAAGAG (SEQ ID NO: 299) | AGGGAAGCAUCAA AGGGCCGAGAUGU CUCG (SEQ ID NO: 307) |
| sg64 backbone fwd | GAAATTAATACGACTCACTATAGGTACTGG CGCCTTTATCTCATTACTTTGAGAGCCATCA CCAGCGACTATGTCGTATGGGTAAAGCGC (SEQ ID NO: 300) | GGUACUGGCGCCU UUAUCUCAUUACU UUGAGAGCCAUCA CCAGCGACUAUGU |
| sg64 backbone rev | CTTTGATGCTTCTTACGGACCGAAGTCCGTA AGCGCTTTACCCATACGACATAG (SEQ ID NO: 301) | CGUAUGGGUAAA GCGCUUACGGACU UCGGUCCGUAAGA |

TABLE 11-continued

Sequences for generation of guide RNA

| Primer | Primer sequence | RNA product |
|---|---|---|
| sg64.7.37 spacer primer | CGGAGCGAGACATCTCGGCCCTTTGATGCT TCTTACGGACCGAAG (SEQ ID NO: 302) | AGCAUCAAAGGGC CGAGAUGUCUCGC UCCG (SEQ ID NO: 308) |
| sg174 backbone fwd | GAAATTAATACGACTCACTATAACTGGCGC TTTTATCTGATTACTTTGAGAGCCATCACCA GCGACTATGTCGTAGTGGGTAAAGCT (SEQ ID NO: 303) | ACUGGCGCUUUUA UCUgAUUACUUUG AGAGCCAUCACCA GCGACUAUGUCGU |
| sg174 backbone rev | CTTTGATGCTCCCTCCGAAGAGGGAGCTTT ACCCACTACGACATAGTCGC (SEQ ID NO: 304) | AgUGGGUAAAGCU CCCUCUUCGGAGG GAGCAUCAAAGGG |
| sg174.7.37 spacer primer | CGGAGCGAGACATCTCGGCCCTTTGATGCT CCCTCC (SEQ ID NO: 305) | CCGAGAUGUCUCG CUCCG (SEQ ID NO: 309) |

Example 7: RNP Assembly

Purified wild-type and RNP of CasX and single guide RNA (sgRNA) were either prepared immediately before experiments or prepared and snap-frozen in liquid nitrogen and stored at −80° C. for later use. To prepare the RNP complexes, the CasX protein was incubated with sgRNA at 1:1.2 molar ratio. Briefly, sgRNA was added to Buffer #1 (25 mM NaPi, 150 mM NaCl, 200 mM trehalose, 1 mM $MgCl_2$), then the CasX was added to the sgRNA solution, slowly with swirling, and incubated at 37° C. for 10 min to form RNP complexes. RNP complexes were filtered before use through a 0.22 µm Costar 8160 filters that were pre-wet with 200 µl Buffer #1. If needed, the RNP sample was concentrated with a 0.5 ml Ultra 100-Kd cutoff filter, (Millipore part #UFC510096), until the desired volume was obtained. Formation of competent RNP was assessed as described in Example 11.

Example 8: Assessing Binding Affinity to the Guide RNA

Purified wild-type and improved CasX will be incubated with synthetic single-guide RNA containing a 3' Cy7.5 moiety in low-salt buffer containing magnesium chloride as well as heparin to prevent non-specific binding and aggregation. The sgRNA will be maintained at a concentration of 10 pM, while the protein will be titrated from 1 pM to 100 µM in separate binding reactions. After allowing the reaction to come to equilibrium, the samples will be run through a vacuum manifold filter-binding assay with a nitrocellulose membrane and a positively charged nylon membrane, which bind protein and nucleic acid, respectively. The membranes will be imaged to identify guide RNA, and the fraction of bound vs unbound RNA will be determined by the amount of fluorescence on the nitrocellulose vs nylon membrane for each protein concentration to calculate the dissociation constant of the protein-sgRNA complex. The experiment will also be carried out with improved variants of the sgRNA to determine if these mutations also affect the affinity of the guide for the wild-type and mutant proteins. We will also perform electromobility shift assays to qualitatively compare to the filter-binding assay and confirm that soluble binding, rather than aggregation, is the primary contributor to protein-RNA association.

Example 9: Assessing Binding Affinity to the Target DNA

Purified wild-type and improved CasX will be complexed with single-guide RNA bearing a targeting sequence complementary to the target nucleic acid. The RNP complex will be incubated with double-stranded target DNA containing a PAM and the appropriate target nucleic acid sequence with a 5' Cy7.5 label on the target strand in low-salt buffer containing magnesium chloride as well as heparin to prevent non-specific binding and aggregation. The target DNA will be maintained at a concentration of 1 nM, while the RNP will be titrated from 1 pM to 100 µM in separate binding reactions. After allowing the reaction to come to equilibrium, the samples will be run on a native 5% polyacrylamide gel to separate bound and unbound target DNA. The gel will be imaged to identify mobility shifts of the target DNA, and the fraction of bound vs unbound DNA will be calculated for each protein concentration to determine the dissociation constant of the RNP-target DNA ternary complex.

Example 10: Assessing Differential PAM Recognition In Vitro

Purified wild-type and engineered CasX variants will be complexed with single-guide RNA bearing a fixed targeting sequence. The RNP complexes will be added to buffer containing $MgCl_2$ at a final concentration of 100 nM and incubated with 5' Cy7.5-labeled double-stranded target DNA at a concentration of 10 nM. Separate reactions will be carried out with different DNA substrates containing different PAMs adjacent to the target nucleic acid sequence. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the rate of cleavage of the non-canonical PAMs by the CasX variants will be determined.

Example 11: CasX:gNA In Vitro Cleavage Assays

1. Determining Cleavage-Competent Fractions for Protein Variants Compared to Wild-Type Reference CasX The ability of CasX variants to form active RNP compared to reference CasX was determined using an n vitro cleavage assay. The beta-2 microglobulin (B2M) 7.37 target for the cleavage assay was created as follows. DNA oligos with the sequence (SEQ ID NO: 310)
TGAAGCTGACAGCATTCGGGCCGAGATGTCTCGCTCCGTGGCCTT AGCTGTGCTCGCGCT (non-target strand, NTS) and (SEQ ID NO: 311)
TGAAGCTGACAGCATTCGGGCCGAGATGTCTCGCTCCGTGGCCTT AGCTGTGCTCGCGCT (target strand, TS)

were purchased with 5' fluorescent labels (LI-COR IRDye 700 and 800, respectively), dsDNA targets were formed by mixing the oligos in a 1:1 ratio in 1× cleavage buffer (20 mM Tris HCl pH 7.5, 150 mM NaCl, 1 mM TCEP, 5% glycerol, 10 mM $MgCl_2$), heating to 95° C. for 10 minutes, and allowing the solution to cool to room temperature.

CasX RNPs were reconstituted with the indicated CasX and guides (see graphs) at a final concentration of 1 µM with 1.5-fold excess of the indicated guide unless otherwise specified in 1× cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. The 7.37 target was used, along with sgRNAs having spacers complementary to the 7.37 target.

Figure 18:
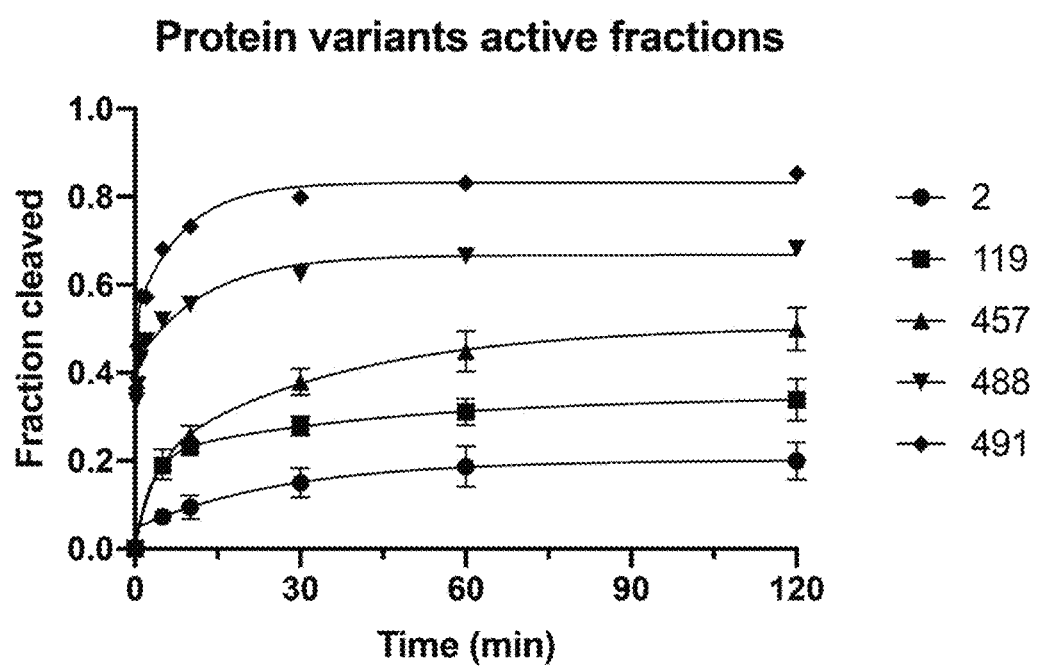
FIG. 18 is a graph of the results of an assay for the quantification of active fractions of RNP formed by sgRNA174 and the CasX variants, as described in Example 11. Equimolar amounts of RNP and target were co-incubated and the amount of cleaved target was determined at the indicated timepoints. Mean and standard deviation of three independent replicates are shown for each timepoint. The biphasic fit of the combined replicates is shown. "2" refers to the reference CasX protein of SEQ ID NO:2.

Cleavage reactions were prepared with final RNP concentrations of 100 nM and a final target concentration of 100 nM. Reactions were carried out at 37° C., and initiated by the addition of the 7.37 target DNA. Aliquots were taken at 5, 10, 30, 60, and 120 minutes and quenched by adding to 95% formamide, 20 mM EDTA. Samples were denatured by heating at 95° C. for 10 minutes and run on a 10% urea-PAGE gel. The gels were either imaged with a LI-COR Odyssey CLx and quantified using the LI-COR Image Studio software or imaged with a Cytiva Typhoon and quantified using the Cytiva IQTL software. The resulting data were plotted and analyzed using Prism. We assumed that CasX acts essentially as a single-turnover enzyme under the assayed conditions, as indicated by the observation that sub-stoichiometric amounts of enzyme fail to cleave a greater-than-stoichiometric amount of target even under extended time-scales and instead approach a plateau that scales with the amount of enzyme present. Thus, the fraction of target cleaved over long time-scales by an equimolar amount of RNP is indicative of what fraction of the RNP is properly formed and active for cleavage. The cleavage traces were fit with a biphasic rate model, as the cleavage reaction clearly deviates from monophasic under this concentration regime, and the plateau was determined for each of three independent replicates. The mean and standard deviation were calculated to determine the active fraction (Table 12). The graph is shown in FIG. 18.

Apparent active (competent) fractions were determined for RNPs formed for CasX2+guide 174+7.37 spacer, CasX119+guide 174+7.37 spacer, CasX457+guide 174+7.37 spacer, CasX488+guide 174+7.37 spacer, and CasX491+guide 174+7.37 spacer. The determined active fractions are shown in Table 12. All CasX variants had higher active fractions than the wild-type CasX2, indicating that the engineered CasX variants form significantly more active and stable RNP with the identical guide under tested conditions compared to wild-type CasX. This may be due to an increased affinity for the sgRNA, increased stability or solubility in the presence of sgRNA, or greater stability of a cleavage-competent conformation of the engineered CasX: sgRNA complex. An increase in solubility of the RNP was indicated by a notable decrease in the observed precipitate formed when CasX457, CasX488, or CasX491 was added to the sgRNA compared to CasX2.

Figure 19:
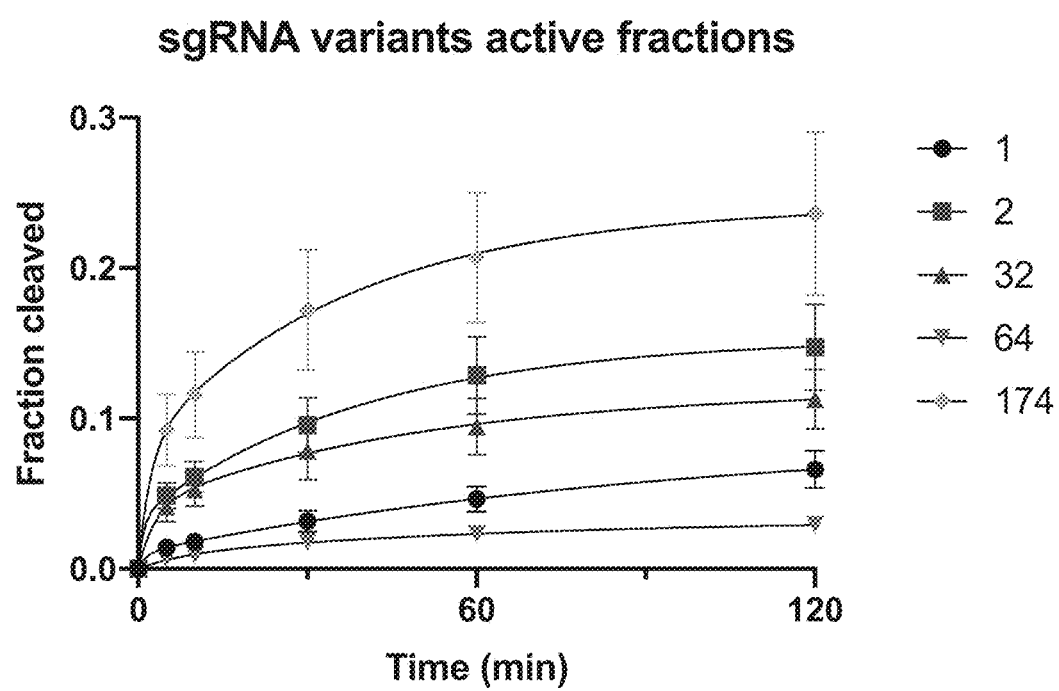
FIG. 19 shows the quantification of active fractions of RNP formed by CasX2 (reference CasX protein of SEQ ID NO:2) and the modified sgRNAs, as described in Example 11. Equimolar amounts of RNP and target were co-incubated and the amount of cleaved target was determined at the indicated timepoints. Mean and standard deviation of three independent replicates are shown for each timepoint. The biphasic fit of the combined replicates is shown.

2. In vitro Cleavage Assays—Determining $k_{cleave}$ for CasX Variants Compared to Wild-Type Reference CasX Cleavage-competent fractions were also determined using the same protocol for CasX2.2.7.37, CasX2.32.7.37, CasX2.64.7.37, and CasX2.174.7.37 to be 16±3%, 13±3%, 5±2%, and 22±5%, as shown in FIG. 19 and Table 12.

Figure 20:
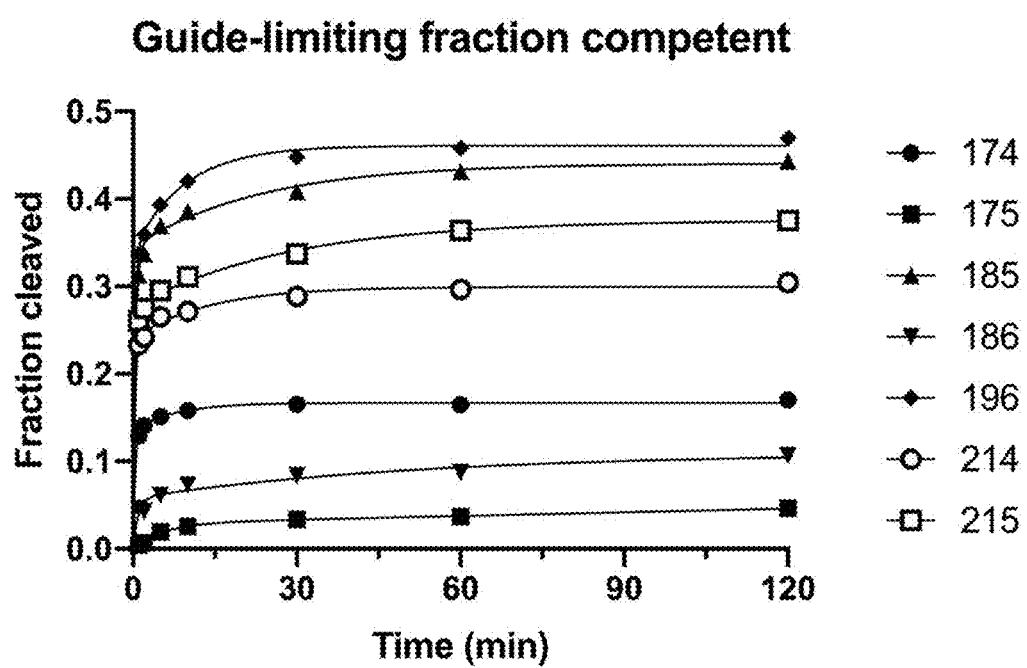
FIG. 20 shows the quantification of active fractions of RNP formed by CasX 491 and the modified sgRNAs under guide-limiting conditions, as described in Example 11. Equimolar amounts of RNP and target were co-incubated and the amount of cleaved target was determined at the indicated timepoints. The biphasic fit of the data is shown.

A second set of guides were tested under different conditions to better isolate the contribution of the guide to RNP formation. 174, 175, 185, 186, 196, 214, and 215 guides with 7.37 spacer were mixed with CasX491 at final concentrations of 1 µM for the guide and 1.5 µM for the protein, rather than with excess guide as before. Results are shown in FIG. 20 and Table 12. Many of these guides exhibited additional improvement over 174, with 185 and 196 achieving 44% and 46% competent fractions, respectively, compared with 17% for 174 under these guide-limiting conditions.

The data indicate that both CasX variants and sgRNA variants are able to form a higher degree of active RNP with guide RNA compare to wild-type CasX and wild-type sgRNA.

The apparent cleavage rates of CasX variants 119, 457, 488, and 491 compared to wild-type reference CasX were determined using an in vitro fluorescent assay for cleavage of the target 7.37.

CasX RNPs were reconstituted with the indicated CasX (see FIG. 21) at a final concentration of 1 µM with 1.5-fold excess of the indicated guide in 1× cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. Cleavage reactions were set up with a final RNP concentration of 200 nM and a final target concentration of 10 nM. Reactions were carried out at 37° C. except where otherwise noted and initiated by the addition of the target DNA. Aliquots were taken at 0.25, 0.5, 1, 2, 5, and 10 minutes and quenched by adding to 95% formamide, 20 mM EDTA. Samples were denatured by heating at 95° C. for 10 minutes and run on a 10% urea-PAGE gel. The gels were imaged with a LI-COR Odyssey CLx and quantified using the LI-COR Image Studio software or imaged with a Cytiva Typhoon and quantified using the Cytiva IQTL software. The resulting data were plotted and analyzed using Prism, and the apparent first-order rate constant of non-target strand cleavage ($k_{cleave}$) was determined for each CasX:sgRNA combination replicate individually. The mean and standard deviation of three replicates with independent fits are presented in Table 12, and the cleavage traces are shown in FIG. 22.

Figure 21:
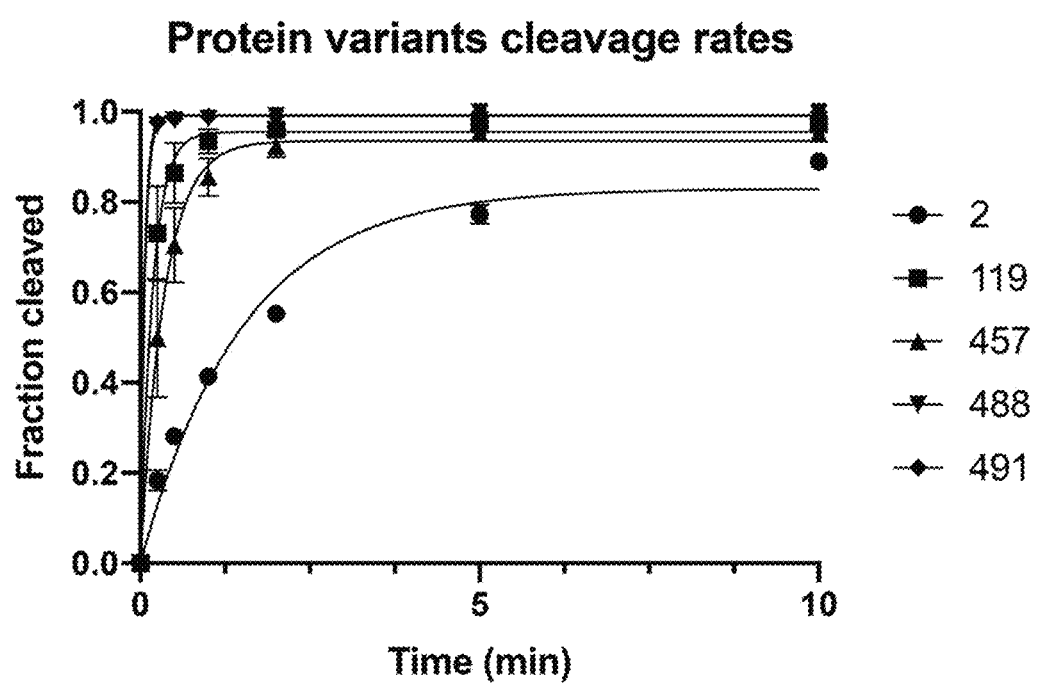
FIG. 21 shows the quantification of cleavage rates of RNP formed by sgRNA174 and the CasX variants, as described in Example 11. Target DNA was incubated with a 20-fold excess of the indicated RNP and the amount of cleaved target was determined at the indicated time points. Mean and standard deviation of three independent replicates are shown for each timepoint, except for 488 and 491 where a single replicate is shown. The monophasic fit of the combined replicates is shown.
Figure 22:
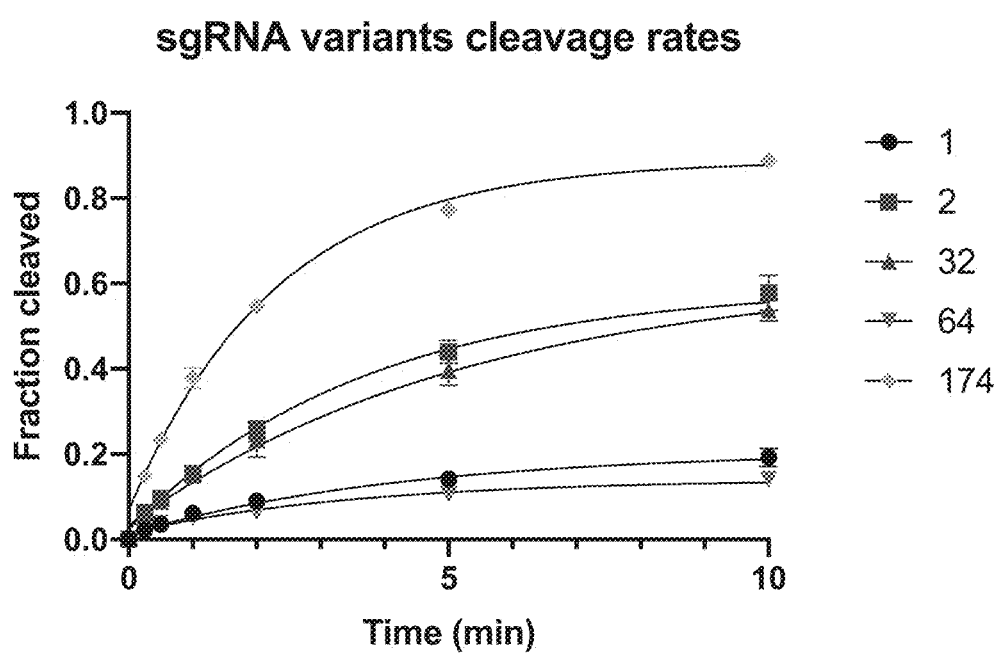
FIG. 22 shows the quantification of cleavage rates of RNP formed by CasX2 and the sgRNA variants, as described in Example 11. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.

Apparent cleavage rate constants were determined for wild-type CasX2, and CasX variants 119, 457, 488, and 491 with guide 174 and spacer 7.37 utilized in each assay (see Table 12 and FIG. 21). All CasX variants had improved cleavage rates relative to the wild-type CasX2. CasX457 cleaved more slowly than 119, despite having a higher competent fraction as determined above. CasX488 and CasX491 had the highest cleavage rates by a large margin: as the target was almost entirely cleaved in the first time-point, the true cleavage rate exceeds the resolution of this assay, and the reported $k_{cleave}$ should be taken as a lower bound.

The data indicate that the CasX variants have a higher level of activity, with $k_{cleave}$ rates reaching at least 30-fold higher compared to wild-type CasX2.

3. In Vitro Cleavage Assays: Comparison of Guide Variants to Wild-Type Guides

Cleavage assays were also performed with wild-type reference CasX2 and reference guide 2 compared to guide variants 32, 64, and 174 to determine whether the variants improved cleavage. The experiments were performed as described above. As many of the resulting RNPs did not approach full cleavage of the target in the time tested, we determined initial reaction velocities ($V_0$) rather than first-order rate constants. The first two timepoints (15 and 30 seconds) were fit with a line for each CasX:sgRNA combination and replicate. The mean and standard deviation of the slope for three replicates were determined.

Figure 23:
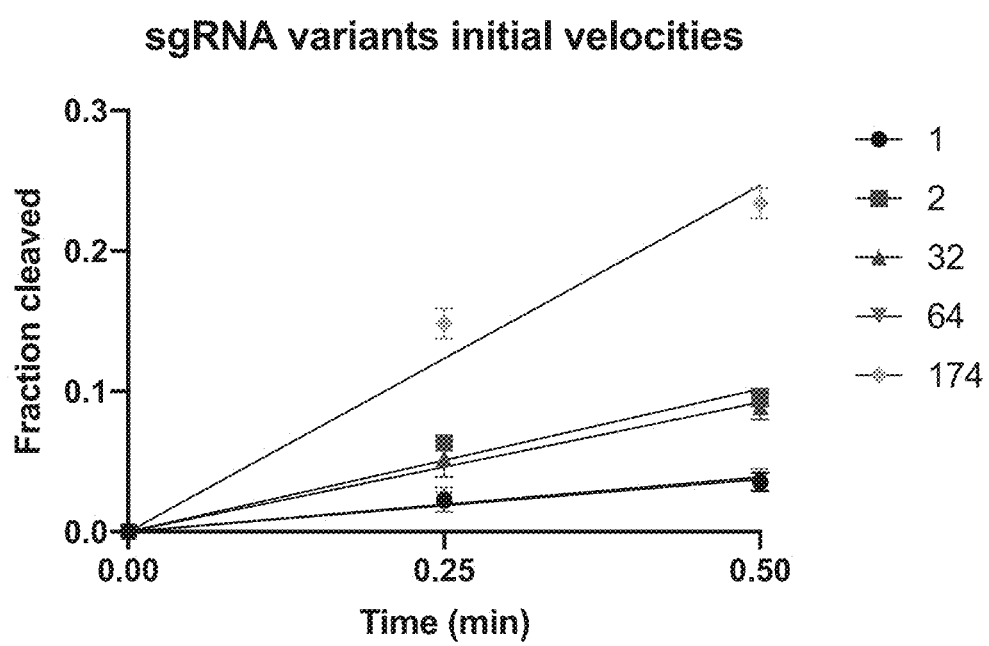
FIG. 23 shows the quantification of initial velocities of RNP formed by CasX2 and the sgRNA variants, as described in Example 11. The first two time-points of the previous cleavage experiment were fit with a linear model to determine the initial cleavage velocity.

Under the assayed conditions, the W for CasX2 with guides 2, 32, 64, and 174 were 20.4±1.4 nM/min, 18.4±2.4 nM/min, 7.8±1.8 nM/min, and 49.3±1.4 nM/mm (see Table 12 and FIG. 22 and FIG. 23). Guide 174 showed substantial improvement in the cleavage rate of the resulting RNP (~2.5-fold relative to 2, see FIG. 23), while guides 32 and 64 performed similar to or worse than guide 2. Notably, guide 64 supports a cleavage rate lower than that of guide 2 but performs much better in vivo (data not shown). Some of the sequence alterations to generate guide 64 likely improve in vivo transcription at the cost of a nucleotide involved in triplex formation. Improved expression of guide 64 likely explains its improved activity in vivo, while its reduced stability may lead to improper folding in vitro.

Additional experiments were carried out with guides 174, 175, 185, 186, 196, 214, and 215 with spacer 7.37 and CasX491 to determine relative cleavage rates. To reduce cleavage kinetics to a range measurable with our assay, the cleavage reactions were incubated at 10° C. Results are in FIG. 24 and Table 12. Under these conditions, 215 was the only guide that supported a faster cleavage rate than 174, 196, which exhibited the highest active fraction of RNP under guide-limiting conditions, had kinetics essentially the same as 174, again highlighting that different variants result in improvements of distinct characteristics.

The data support that, under the conditions of the assay, use of the majority of the guide variants with CasX results in RNP with a higher level of activity than one with the wild-type guide, with improvements in initial cleavage velocity ranging from ~2-fold to >6-fold. Numbers in Table 12 indicate, from left to right, CasX variant, sgRNA scaffold, and spacer sequence of the RNP construct. In the RNP construct names in the table below, CasX protein variant, guide scaffold and spacer are indicated from left to right.

TABLE 12

Results of cleavage and RNP formation assays

| RNP Construct | $k_{cleave}$* | Initial velocity* | Competent fraction |
|---|---|---|---|
| 2.2.7.37 | | 20.4 ± 1.4 nM/min | 16 ± 3% |
| 2.32.7.37 | | 18.4 ± 2.4 nM/min | 13 ± 3% |
| 2.64.7.37 | | 7.8 ± 1.8 nM/min | 5 ± 2% |
| 2.174.7.37 | 0.51 ± 0.01 min$^{-1}$ | 49.3 ± 1.4 nM/min | 22 ± 5% |
| 119.174.7.37 | 6.29 ± 2.11 min$^{-1}$ | | 35 ± 6% |
| 457.174.7.37 | 3.01 ± 0.90 min$^{-1}$ | | 53 ± 7% |
| 488.174.7.37 | 15.19 min$^{-1}$ | | 67% |
| 491.174.7.37 | 16.59 min$^{-1}$/ 0.293 min$^{-1}$ (10° C.) | | 83%/17% (guide-limited) |
| 491.175.7.37 | 0.089 min$^{-1}$ (10° C.) | | 5% (guide-limited) |
| 491.185.7.37 | 0.227 min$^{-1}$ (10° C.) | | 44% (guide-limited) |
| 491.186.7.37 | 0.099 min$^{-1}$ (10° C.) | | 11% (guide-limited) |
| 491.196.7.37 | 0.292 min$^{-1}$ (10° C.) | | 46% (guide-limited) |
| 491.214.7.37 | 0.284 min$^{-1}$ (10° C.) | | 30% (guide-limited) |

TABLE 12-continued

Results of cleavage and RNP formation assays

| RNP Construct | $k_{cleave}$* | Initial velocity* | Competent fraction |
|---|---|---|---|
| 491.215.7.37 | 0.398 min$^{-1}$ (10° C.) | | 38% (guide-limited) |

*Mean and standard deviation

Example 12: Identification of Nicking Variants

Purified modified CasX variants will be complexed with single-guide RNA bearing a fixed targeting sequence. The RNP complexes will be added to buffer containing $MgCl_2$ at a final concentration of 100 nM and incubated with double-stranded target DNA with a 5' fluorescein label on the target strand and a 5' Cy5 label on the non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. Efficient cleavage of one strand but not the other would be indicative that the variant possessed single-strand nickase activity.

Example 13: Assessing Improved Expression and Solubility Characteristics of CasX Variants for RNP Production Wild-type and modified CasX variants will be expressed in BL21 (DE3) *E. coli* under identical conditions. All proteins will be under the control of an IPTG-inducible T7 promoter. Cells will be grown to an OD of 0.6 in TB media at 37° C., at which point the growth temperature will be reduced to 16° C., and expression will be induced by the addition of 0.5 mM IPTG. Cells will be harvested following 18 hours of expression. Soluble protein fractions will be extracted and analyzed on an SDS-PAGE gel. The relative levels of soluble CasX expression will be identified by Coomassie staining. The proteins will be purified in parallel according to the protocol above, and final yields of pure protein will be compared. To determine the solubility of the purified protein, the constructs will be concentrated in storage buffer until the protein begins to precipitate. Precipitated protein will be removed by centrifugation and the final concentration of soluble protein will be measured to determine the maximum solubility for each variant. Finally, the CasX variants will be complexed with single guide RNA and concentrated until precipitation begins. Precipitated RNP will be removed by centrifugation and the final concentration of soluble RNP will be measured to determine the maximum solubility of each variant when bound to guide RNA.

Example 14: Assays Used to Measure sgNA and CasX Protein Activity

Several assays were used to carry out initial screens of CasX protein and sgNA Deep Mutational Evolution (DME) libraries and modified mutants, and to measure the activity of select protein and sgNA variants relative to CasX reference sgNAs and proteins.

*E. coli* CRISPRi Screen:
Briefly, biological triplicates of dead CasX DME Libraries on a chloramphenicol (CM) resistant plasmid with a GFP gNA on a carbenicillin (Carb) resistant plasmid were transformed (at >5× library size) into MG1655 with genetically integrated and constitutively expressed GFP and RFP. Cells were grown overnight in EZ-RDM+Carb, CM and Anhydrotetracycline (aTc) inducer. E. coli were FACS sorted based on gates for the top 1% of GFP but not RFP repression, collected, and resorted immediately to further enrich for highly functional CasX molecules. Double sorted libraries were then grown out and DNA was collected for deep sequencing on a highseq. This DNA was also re-transformed onto plates and individual clones were picked for further analysis.

E. coli Toxin Selection:

Briefly carbenicillin resistant plasmid containing an arabinose inducible toxin were transformed into E. coli cells and made electrocompetent. Biological triplicates of CasX DME Libraries with a toxin targeted gNA on a chloramphenicol resistant plasmid were transformed (at >5× library size) into said cells and grown in LB+CM and arabinose inducer. E. coli that cleaved the toxin plasmid survived in the induction media and were grown to mid log and plasmids with functional CasX cleavers were recovered. This selection was repeated as needed. Selected libraries were then grown out and DNA was collected for deep sequencing on a highseq. This DNA was also re-transformed onto plates and individual clones were picked for further analysis and testing.

Figure 25:
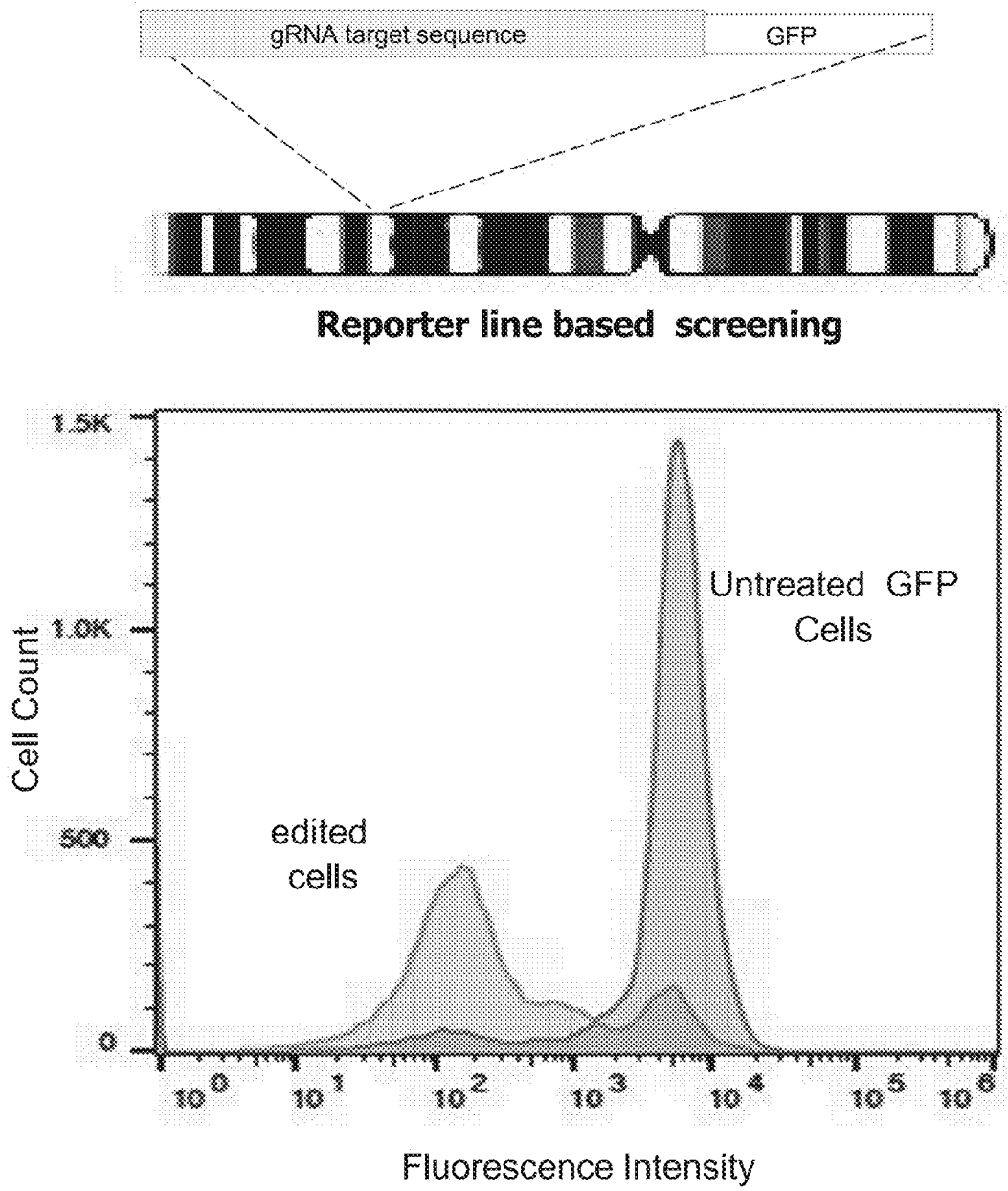
FIG. 25 is a diagram and an example fluorescence activated cell sorting (FACS) plot illustrating an exemplary method for assaying the effectiveness of a reference CasX protein or single guide RNA (sgRNA), or variants thereof, as described in Example 14. A reporter (e.g., GFP reporter) coupled to a gRNA target sequence, complementary to the gRNA spacer, is integrated into a reporter cell line. Cells are transformed or transfected with a CasX protein and/or sgRNA variant, with the spacer motif of the sgRNA complementary to and targeting the gRNA target sequence of the reporter. Ability of the CasX:sgRNA ribonucleoprotein complex to cleave the target sequence is assayed by FACS. Cells that lose reporter expression indicate occurrence of CasX:sgRNA ribonucleoprotein complex-mediated cleavage and indel formation.

Lentiviral Based Screen EGFP Screen:

Lentiviral particles were produced in HEK293 cells at a confluency of 70%-90% at time of transfection. Cells were transfected using polyethylenimine based transfection of plasmids containing a CasX DME library. Lentiviral vectors were co-transfected with the lentiviral packaging plasmid and the VSV-G envelope plasmids for particle production. Media was changed 12 hours post-transfection, and virus harvested at 36-48 hours post-transfection. Viral supernatants were filtered using 0.45 mm membrane filters, diluted in cell culture media if appropriate, and added to target cells HEK cells with an Integrated GFP reporter. Polybrene was supplemented to enhance transduction efficiency, if necessary. Transduced cells were selected for 24-48 hours post-transduction using puromycin and grown for 7-10 days. Cells were then sorted for GFP disruption & collected for highly functional CasX sgNA or protein variants (see FIG. 25). Libraries were then Amplified via PCR directly from the genome and collected for deep sequencing on a highseq. This DNA could also be re-cloned and re-transformed onto plates and individual clones were picked for further analysis.

Example 15: Assaying Editing Efficiency of an HEK EGFP Reporter

To assay the editing efficiency of CasX reference sgNAs and proteins and variants thereof, EGFP HEK293T reporter cells were seeded into 96-well plates and transfected according to the manufacturer's protocol with Lipofectamine™ 3000 (Life Technologies) and 100-200 ng plasmid DNA encoding a reference or CasX variant protein, P2A-puromycin fusion and the reference or variant sgNA. The next day cells were selected with 1.5 pg/ml puromycin for 2 days and analyzed by fluorescence-activated cell sorting (FACS) 7 days after selection to allow for clearance of EGFP protein from the cells. EGFP disruption via editing was traced using an Attune NxT Flow Cytometer and high-throughput autosampler.

Example 16: Cleavage Efficiency of CasX Reference sgRNA

The reference CasX sgRNA of SEQ ID NO:4 (below) is described in WO 2018064371 and U.S. Ser. No. 10/570,415B2, the contents of which are incorporated herein by reference:

(SEQ ID NO: 4)
ACAUCUGGCGCGUUUAUUCCAUUACUUUGGAGCCAGUCCCAGCGACUAU

GUCGUAUGGACGAAGCGCUUAUUUAUCGGAGAGAAACCGAUTAAGUAAA

ACGCAUCAAAG.

It was found that alterations to the sgRNA reference sequence of SEQ ID NO:4, producing SEQ ID NO:5 (below) were able to improve CasX cleavage efficiency. The sequence (SEQ ID NO: 5)
UACUGGCGCUUUUAUCUCAUUACUUUGAGAGCCAUCACCAGCGACUA

UGUCGUAUGGGUAAGCGCUUAUUUAUCGGAGAGAAAUCCGAUAAAUA

AGAAGCAUCAAAG.

To assay the editing efficiency of CasX reference sgRNAs and variants thereof, EGFP HEK293T reporter cells were seeded into 96-well plates and transfected according to the manufacturer's protocol with Lipofectamine™ 3000 (Life Technologies) and 100-200 ng plasmid DNA encoding a reference CasX protein, P2A-puromycin fusion and the sgRNA. The next day cells were selected with 1.5 pg/ml puromycin for 2 days and analyzed by fluorescence-activated cell sorting (FACS) 7 days after selection to allow for clearance of EGFP protein from the cells. EGFP disruption via editing was traced using an Attune NxT Flow Cytometer and high-throughput autosampler.

When testing cleavage of an EGFP reporter by CasX reference and sgNA variants, the following spacer target sequences were used: E6 (TGTGGTCGGGGTAGCGGCTG (SEQ ID NO: 17)) and E7 (TCAAGTCCGC-CATGCCCGAA (SEQ ID NO: 18)).

Figure 26:
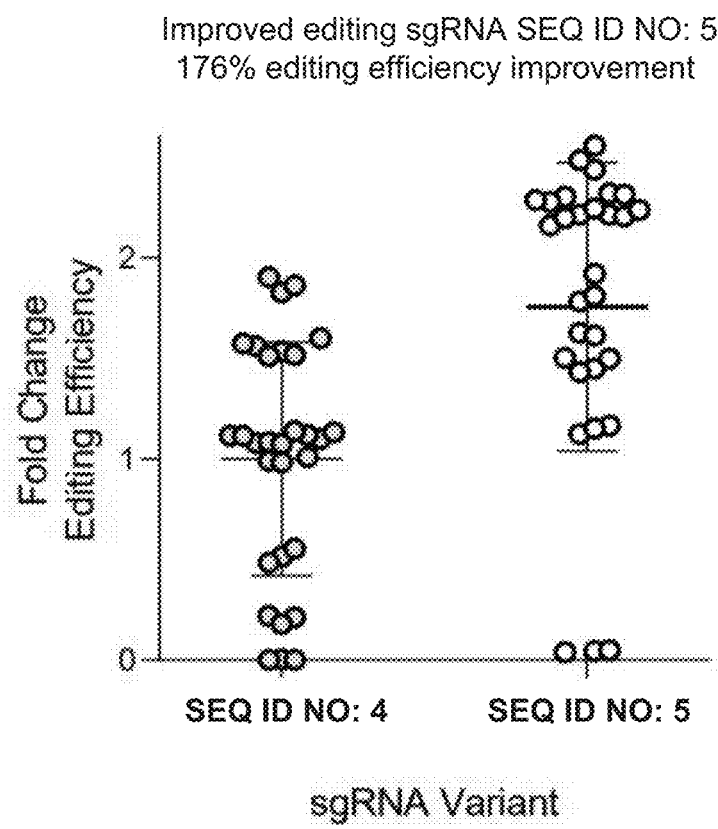
FIG. 26 shows results of gene editing in an EGFP disruption assay, as described in Example 16. Editing was measured by indel formation and GFP disruption in HEK293 cells carrying a GFP reporter.
Figure 27:
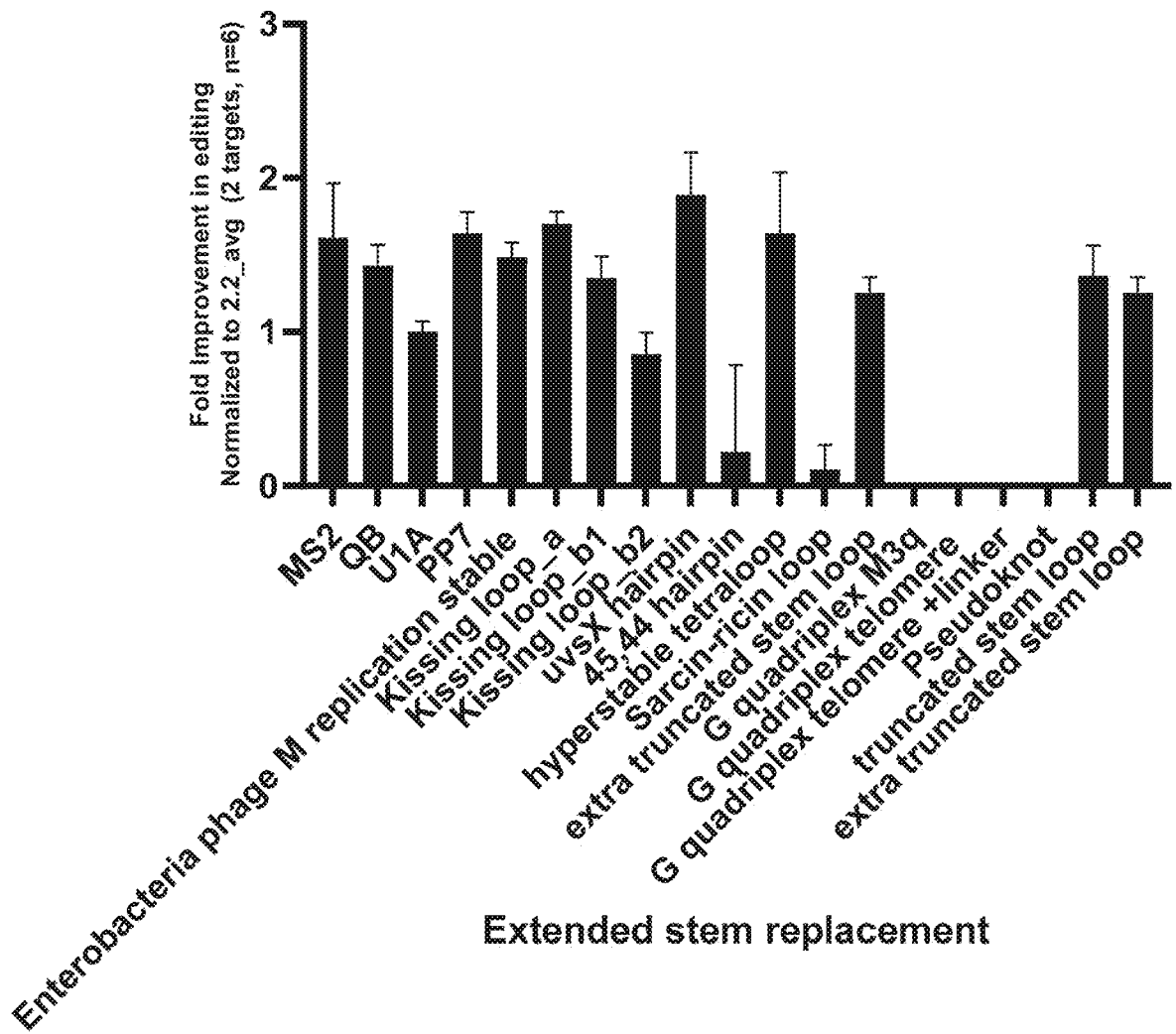
FIG. 27 shows results of gene editing in an EGFP disruption assay where further editing improvements were obtained in the sgRNA scaffold of SEQ ID NO:5 by swapping the extended stem loop sequence (indicated in the X-axis) for additional sequences to generate the scaffolds whose sequences are shown in Table 2, as described in Example 17.

An example of the increased cleavage efficiency of the sgRNA of SEQ ID NO:5 compared to the sgRNA of SEQ ID NO:4 is shown in FIG. 26. Editing efficiency of SEQ ID NO: 5 was improved 176% compared to SEQ ID NO: 4. Accordingly, SEQ ID NO: 5 was chosen as reference sgRNA for DME and additional sgNA variant design, described below.

Example 17: Design, Creation and Evaluation of gNA Variants with Improved Target Cleavage Guide nucleic acid (gNA) variants were designed and tested in order to assess improvements in cleavage activity relative to reference gNAs. These guides were discovered via DME or rational design and replacement or addition of guide parts such as the extended stem or the addition of ribozymes at the termini, as described herein.

Experimental design: All guides were tested In HEK293T or a HEK293T reporter line as follows. Mammalian cells were maintained in a 37° C. incubator, at 5% C02. HEK293T Human kidney cells and derivatives thereof were grown in Dulbecco's Modified Eagle Medium (DMEM; Corning Cellgro, #10-013-CV) supplemented with 10% fetal bovine serum (FBS; Seradigm, #1500-500), and 100 Units/ml penicillin and 100 mg/ml streptomycin (100×-Pen- Strep; GIBCO #15140-122), and can additionally include sodium pyruvate (100×, Thermofisher #11360070), Non-essential amino acids (100× Thermofisher #11140050). HEPES buffer (100× Thermofisher #15630080), and 2-mercaptoethanol (1000× Thermofisher #21985023). Cells were seeded at 20-30 thousand cells per well into 96-well plates and transfected using 0.25-1 uL of Lipofectamine™ 3000 (Thermo Fisher Scientific #L3000008), 50-500 ng of a plasmid containing CasX and the reference or variant CasX guide targeting the reporter or target gene following the manufacturer's protocol. 24-72 hours later the media was changed and 0.3-3.0 ug/ml puromycin (Sigma #P8833) was added to select for transformation. 24-96 hours following selection the cells were analyzed by flow cytometry and gated for the appropriate forward and side scatter, selected for single cells and then gated for green fluorescent protein (GFP) or antibody reporter expression (Attune Nxt Flow Cytometer, Thermo Fisher Scientific) to quantify the expression levels of fluorophores. At least 10,000 events were collected for each sample. For the HEK293T-GFP genome editing reporter cell line, flow cytometry was used to quantify the percentage of GFP-negative (edited) cells and the number of cells with GFP disruption for each variant was compared to the reference guide to generate a fold change measurement.

Figure 24:
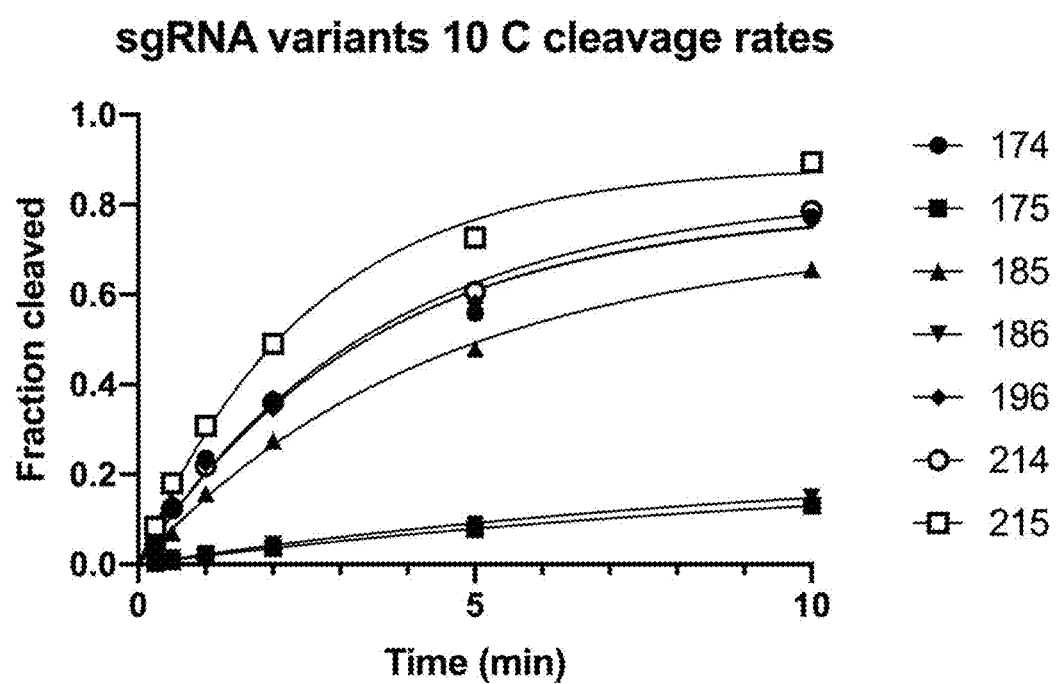
FIG. 24 shows the quantification of cleavage rates of RNP formed by CasX491 and the sgRNA variants, as described in Example 11. Target DNA was incubated with a 20-fold excess of the indicated RNP at 10° C., and the amount of cleaved target was determined at the indicated time points. The monophasic fit of the timepoints is shown.
Figure 28:
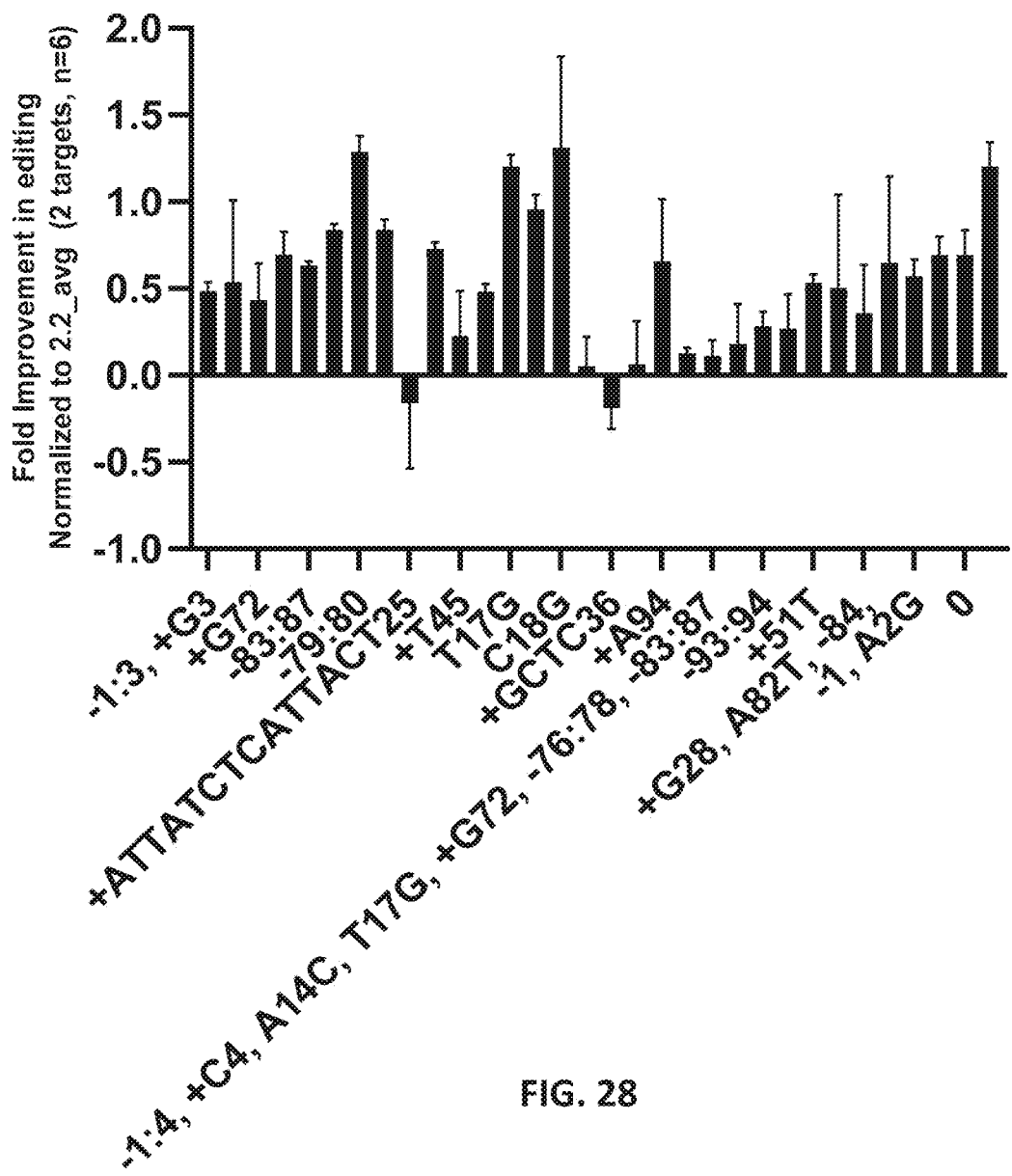
FIG. 28 is a graph showing the fold improvement of sgRNA variants (ATTATCTCATTACT; SEQ ID NO: 27301) generated by DME mutations normalized to SEQ ID NO:5 as the CasX reference sgRNA, as described in Example 17.
Figure 29:
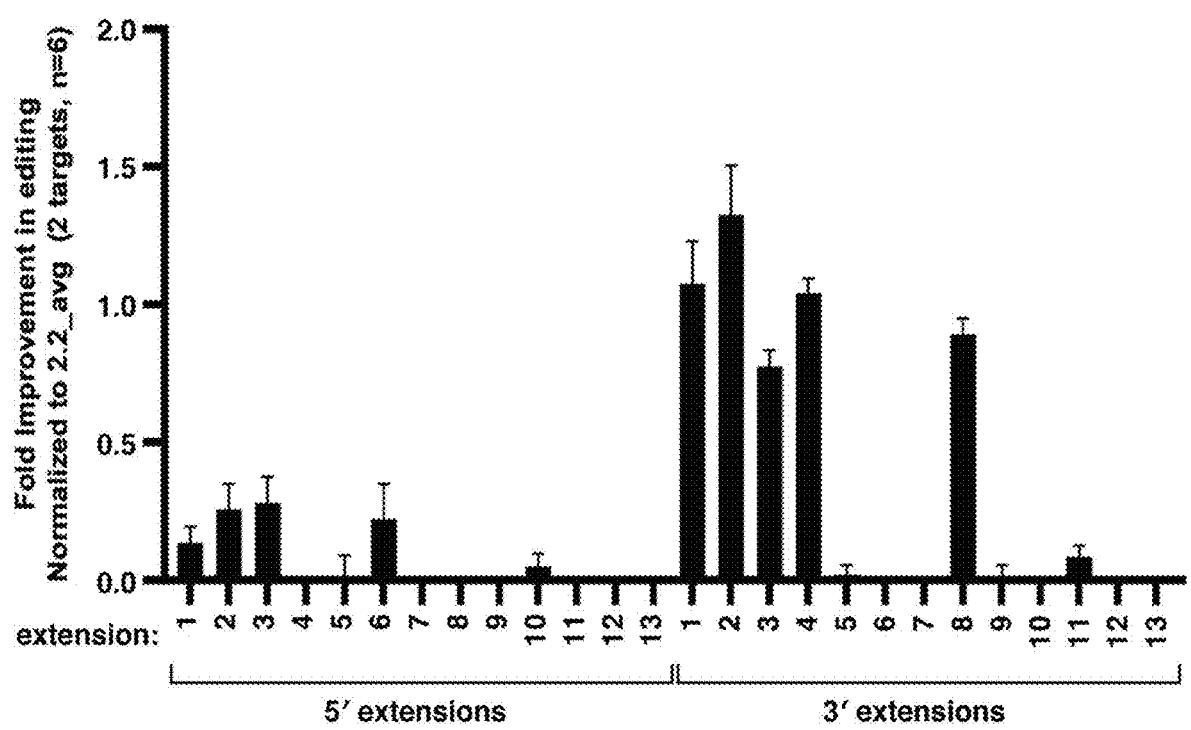
FIG. 29 is a graph showing the fold improvement normalized to the SEQ ID NO:5 reference CasX sgRNA of variants created by both combining (stacking) scaffold stem mutations showing improved cleavage, DME mutations showing improved cleavage, and using ribozyme appendages showing improved cleavage (the appendages and their sequences are listed in Table 13 in Example 17). The resulting sgRNA variants yield 2-fold or greater improvement in cleavage compared to SEQ ID NO:5 in this assay. EGFP editing assays were performed with spacer target sequences of E6 (TGTGGTCGGGGTAGCGGCTG (SEQ ID NO: 17)) and E7(TCAAGTCCGCCATGCCCGAA (SEQ ID NO: 18)) described in Example 16.

Results: Results from the sgNA variants generated via DME were measured and compared to the reference gNA of SEQ ID NO: 4. These results are presented in FIG. 28, with most variants showing improvements from 0.1 to nearly 1.5-fold compared to the reference gNA. Results of the variants generated via rational design and replacement or addition of guide parts (such as the extended stem or the addition of ribozymes at the termini) are shown in FIGS. 28 and 24 respectively; again showing improvements with many of the constructs. The additions to the variants, along with their encoding sequences, portrayed by number in FIG. 29 are listed in Table 13, below. We observed that single mutations such as the C18G improve guide activity when compared to the reference. Additionally, rationally swapping in different stem loops for the extended stem loop, such as MS2, QB, PP7, UvsX, etc. improved activity when compared to the reference guide, as does truncating the original extended stem loop. Finally, we demonstrate that while most ribozymes disrupt activity, the addition of a 3' HDV to the reference guide RNA can improve activity up to 20-50%.

TABLE 13

Extensions added to 3' and 5' ends of gNA

| Exten. Numb. | Extension Name | Extension Encoding Sequence |
| --- | --- | --- |
| 1 | HDV antigenomic ribozyme | GGGTCGGCATGGCATCTCCACCTCCTCGCGGTCCGACCT GGGCATCCGAAGGAGGACGCACGTCCACTCGGATGGCT AAGGGAGAGCCA (SEQ ID NO: 312) |
| 2 | HDV genomic ribozyme | GGCCGGCATGGTCCCAGCCTCCTCGCTGGCGCCGGCTGG GCAACATTCCGAGGGGACCGTCCCCTCGGTAATGGCGA ATGGGACCC (SEQ ID NO: 313) |
| 3 | HDV ribozyme (v1) | GATGGCCGGCATGGTCCCAGCCTCCTCGCTGGCGCCGGC TGGGCAACACCTTCGGGTGGCGAATGGGAC (SEQ ID NO: 314) |
| 4 | HDV ribozyme (v2) | TTTTGGCCGGCATGGTCCCAGCCTCCTCGCTGGCGCCGG CTGGGCAACATGCTTCGGCATGGCGAATGGGACCCCGG G (SEQ ID NO: 315) |
| 5 | Hatchet | CATTCCTCAGAAAATGACAAACCTGTGGGGCGTAAGTA GATCTTCGGATCTATGATCGTGCAGACGTTAAAATCAGG T (SEQ ID NO: 316) |
| 6 | env25 pistol ribozyme (with CUUCGG loop) | CGTGGTTAGGGCCACGTTAAATAGTTGCTTAAGCCCTAA GCGTTGATCTTCGGATCAGGTGCAA (SEQ ID NO: 317) |
| 7 | HH15 Minimal Hammerhead ribozyme | GGGAGCCCCGCTGATGAGGTCGGGGAGACCGAAAGGGA CTTCGGTCCCTACGGGGCTCCC (SEQ ID NO: 318) |
| 8 | sTRSV WT viral Hammerhead ribozyme | CCTGTCACCGGATGTGCTTTCCGGTCTGATGAGTCCGTG AGGACGAAACAGG (SEQ ID NO: 319) |
| 9 | Hammerhead ribozyme | CGACTACTGATGAGTCCGTGAGGACGAAACGAGTAAGC TCGTCTAGTCGCGTGTAGCGAAGCA (SEQ ID NO: 320) |
| 10 | Hammerhead ribozyme, smaller scar | CGACTACTGATGAGTCCGTGAGGACGAAACGAGTAAGC TCGTCTAGTCG (SEQ ID NO: 321) |
| 11 | Hammerhead ribozyme, guide scaffold scar | CCAGTACTGATGAGTCCGTGAGGACGAAACGAGTAAGC TCGTCTACTGGCGCTTTTATCTCAT (SEQ ID NO: 322) |
| 12 | Twisted Sister 1 | ACCCGCAAGGCCGACGGCATCCGCCGCCGCTGGTGCAA GTCCAGCCGCCCCTTCGGGGCGGGCGCTCATGGGTAAC (SEQ ID NO: 323) |

TABLE 13-continued

Extensions added to 3' and 5' ends of gNA

| Exten. Numb. | Extension Name | Extension Encoding Sequence |
|---|---|---|
| 13 | Env-9 Twister | GGCAATAAAGCGGTTACAAGCCCGCAAAAATAGCAGAG TAATGTCGCGATAGCGCGGCATTAATGCAGCTTTATTG (SEQ ID NO: 324) |
| 14 | RBMX recruiting motif | CCACCCCCACCACCACCCCCACCCCCACCACCACCC (SEQ ID NO: 325) |

The results support the conclusion that DME and rational design can be used to improve the performance of the gNAs and that many of these variant RNAs can now be used with the targeting sequences as a component of the CasX:gNA systems described herein to edit target nucleic acid sequences.

Example 18: CasX Edits P23 RHO in an Allele-Specific Manner

The goal of this experiment was to show that CasX variant 119 and scaffold variants 64 and 174 can edit the human RHO locus around amino acid residue P23, while native CasX variant 2 and scaffold 2 cannot. HEK293T cells with both wild-type alleles should be editable by the WT CasX spacer (11.1, having the sequence AAGGGGCTGCGTAC-CACACC, SEQ ID NO: 367), but not by the mutant CasXspacer (11.2 having the sequence AAGTGGCTGCGTACCACACC, SEQ ID NO: 368). This experiment additionally demonstrates the ability of CasX spacers to distinguish between on-target and off-target alleles that differ by a single nucleotide.

Materials and Methods:

HEK293T cells were seeded at 20-40 k cells/well in a 96 well plate in 100 µL of Fibroblast (FB) medium and cultured in a 37° C. incubator with 5% C02. The following day, confluence of seeded cells was checked to ensure that cells were at ~75% confluence at time of transfection. If cells were at the right confluence, transfection was carried out. Each CasX and guide construct (119.174, see Table for sequence) was transfected into the HEK293T cells at 100-500 ng per well using Lipofectamine™ 3000 following the manufacturer's protocol, using 3 wells per construct as replicates. SaCas9 and SpyCas9 targeting RHO were used as benchmarking controls. For each Cas protein type, a non-targeting plasmid was used as a negative control. Cells were selected for successful transfection with puromycin at 0.3-3 pg/ml for 24-48 hours followed by 24-48 hours of recovery in FB medium. A subset of cells for each sample from the experiment was lysed, and the genome was extracted using a Quick extract solution following the manufacturer's protocol. Editing was analyzed using a T7E1 assay. Briefly, the genomic locus at the targeted edit site was amplified using primers (e.g., a 500 bp region around the intended target) using a PCR program on a thermocycler. The PCR amplicon was then hybridized following a hybridization program on a thermocycler, and then treated with T7 Endonuclease for 30 mins at 37° C. The sample was then analyzed on a 2% agarose gel to visualize the DNA bands.

Figure 30:
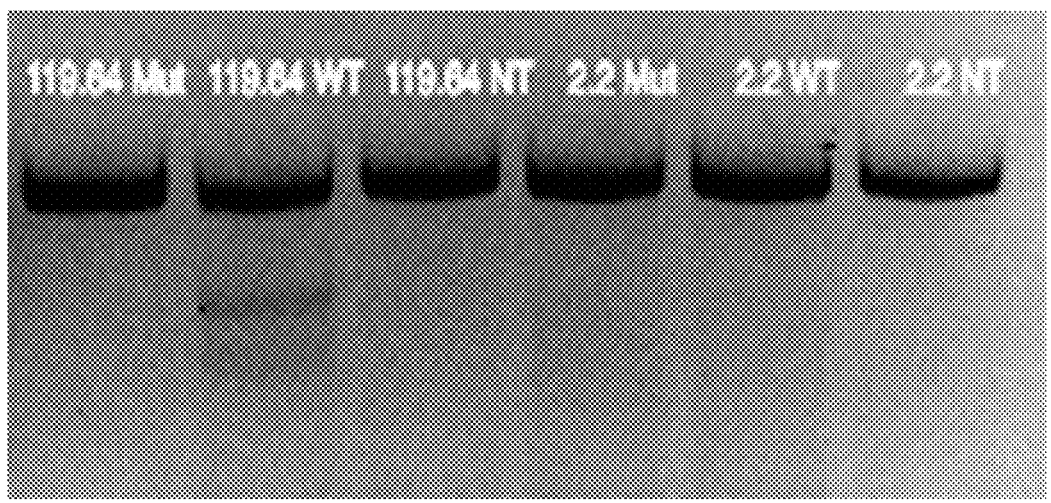
FIG. 30 shows a gel image from the T7E1 assay demonstrating allele-specific editing by CasX variant 119 and scaffold 64 at the WIT RHO P23 locus in HEK293T cells, as described in Example 18. Genomic DNA from HEK293T cells lipofected with CasX and guide constructs are: (from left to right in the gel) CasX 119 and guide scaffold 64 with spacer targeting mutant allele, CasX 119 and guide scaffold 64 with spacer targeting WT allele (demonstrating editing), CasX 119 and guide scaffold 64 with non-targeting spacer. CasX 2 and guide scaffold 2 with spacer targeting mutant allele, CasX 2 and guide scaffold 2 with spacer targeting WT allele, CasX 2 and guide scaffold 2 with non-targeting spacer) were assayed for editing at the RHO locus by a T7E1 assay.

Results:

As shown in FIG. 30, results from the T7E1 assay performed to assess editing demonstrated that the CasX construct, 119.64, was able to edit the WT RHO locus in HEK293T cells when targeted to the P23 locus using a spacer that targets the WT sequence (119.64.WT, second lane). A CasX construct with a spacer that targets the mutant sequence (119.64.Mut), or a non-targeting sequence (119.64.NT), was not able to edit the WT locus in these cells.

Figure 31:
FIG. 31 shows a gel image of the T7E1 assay results assessing editing by CasX, SaCas9 and SpyCa9 at the WT RHO P23 locus in HEK293T cells, as described in Example 18.
Figure 32:
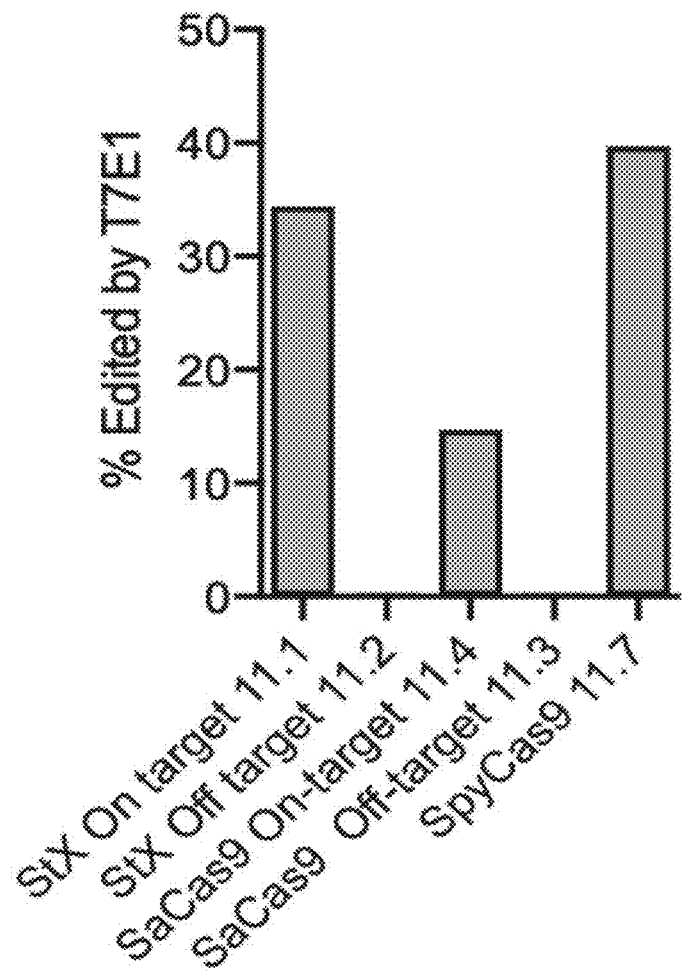
FIG. 32 is a graph with the quantification of the editing results of the gel in FIG. 31, as described in Example 18.

FIG. 31 (T7E1 gel) and FIG. 32 (quantification of gel) shows that CasX variant 119 and scaffold variant 174 with spacer 11.1 was able to edit the on-target wild type RHO locus at 34.4% efficiency, while CasX variant and scaffold 174 with the off-target spacer 11.2 showed no activity at the WT locus. In comparison, the on-target SaCas9 construct showed 14.7% editing. SpyCas9 showed 39.9% efficiency at editing the RHO locus in general, but not at the P23H locus due to the absence of a nearby PAM.

This example demonstrates that CasX with appropriate guides was able to edit the P23 RHO locus in an allele-specific manner, and that the engineered CasX variant 119 and scaffold 64 (as opposed to native CasX variant 2 and scaffold 2) was able to edit P23 RHO locus at a non-canonical CTCN PAM. Additionally, CasX variant 119 and scaffold 174 maintains the ability to edit P23 RHO locus in an allele-specific manner, and edits on target with higher efficiency than SaCas9. SpyCas9 cannot edit allele-specifically at the P23 RHO locus due to unavailability of a PAM sequence. Thus, CasX is uniquely positioned to edit the P23 RHO locus in an allele-specific manner.

Example 19. Engineered CasX Variants Edit P23 RHO in an Allele Specific Manner

The purpose of this experiment was to assess the ability of engineered CasX variants to edit the human P23 RHO locus in an allele-specific manner. The ability to edit on target with high specificity and minimum off target activity is important for an allele-specific therapeutic approach to address AdRP.

Materials and Methods:

An ARPE19 dual reporter cell line (WT.RHO.GFP mut.RHO.mscarlet) was first generated by knocking into ARPE19 cells a transgene cassette that constitutively expresses exon 1 of the human RHO gene linked to GFP and exon 1 of the human P23H.RHO gene linked to mscarlet. The modified cells were expanded by serial passage every 3-5 days and maintained in Fibroblast (FB) medium, consisting of Dulbecco's Modified Eagle Medium (DMEM: Corning Cellgro, #10-013-CV) supplemented with 10% fetal bovine serum (FBS; Seradigm, #1500-500), and 100 Units/mL penicillin and 100 mg/mL streptomycin (100×-Pen-Strep; GIBCO #15140-122), and can additionally include sodium pyruvate (100×, Thermofisher #11360070), non-essential amino acids (100× Thermofisher #11140050). HEPES buffer (100× Thermofisher #15630080), and 2-mercaptoethanol (1000× Thermofisher #21985023). The cells were incubated at 37° C., and 5% CO2. After 1-2 weeks, GFP+/mscarlet+ cells were bulk sorted into FB medium. The reporter lines were expanded by serial passage every 3-5 days and maintained in FB medium in an incubator at 37° C., and 5% CO2. Reporter clones were generated by a limiting dilution method. The clonal lines were characterized via flow cytometry, genomic sequencing, and functional modification of the RHO locus using a previously validated RHO targeting CasX molecule. The optimal reporter lines were identified as ones that i) had single copies of WTRHO.GFP and mutRHO.mscarlet correctly integrated per cell, ii) maintained doubling times equivalent to unmodified cells, and iii) resulted in reduction in GFP/mscarlet fluorescence upon disruption of the RHO gene when assayed using the methods described below.

ARPE19 dual reporter cells, constructed using cell line generation methods described above were used for this experiment. Cells were seeded at 20-40 k cells/well in a 96 well plate in 100 µL of FB medium and cultured in a 37° C. incubator with 5% CO2. The following day, lentiviral vectors packaging each CasX and guide construct (spacer sequences were 11.1 and 11.2) were used to transduce cells at a high multiplicity of infection (MOI 300), using 3 wells per construct as replicates. A lentivirus packaging a non-targeting construct (spacer 11.2) was used as a negative control. Cells were selected for successful transduction with puromycin at 0.3-3 µg/ml for 24-48 hours followed by recovery in FB medium. Edited cells were analyzed by flow cytometry 14 days after transduction. Briefly, cells were sequentially gated for live cells, single cells, and fraction of GFP-negative and mscarlet-negative cells.

Figure 33:
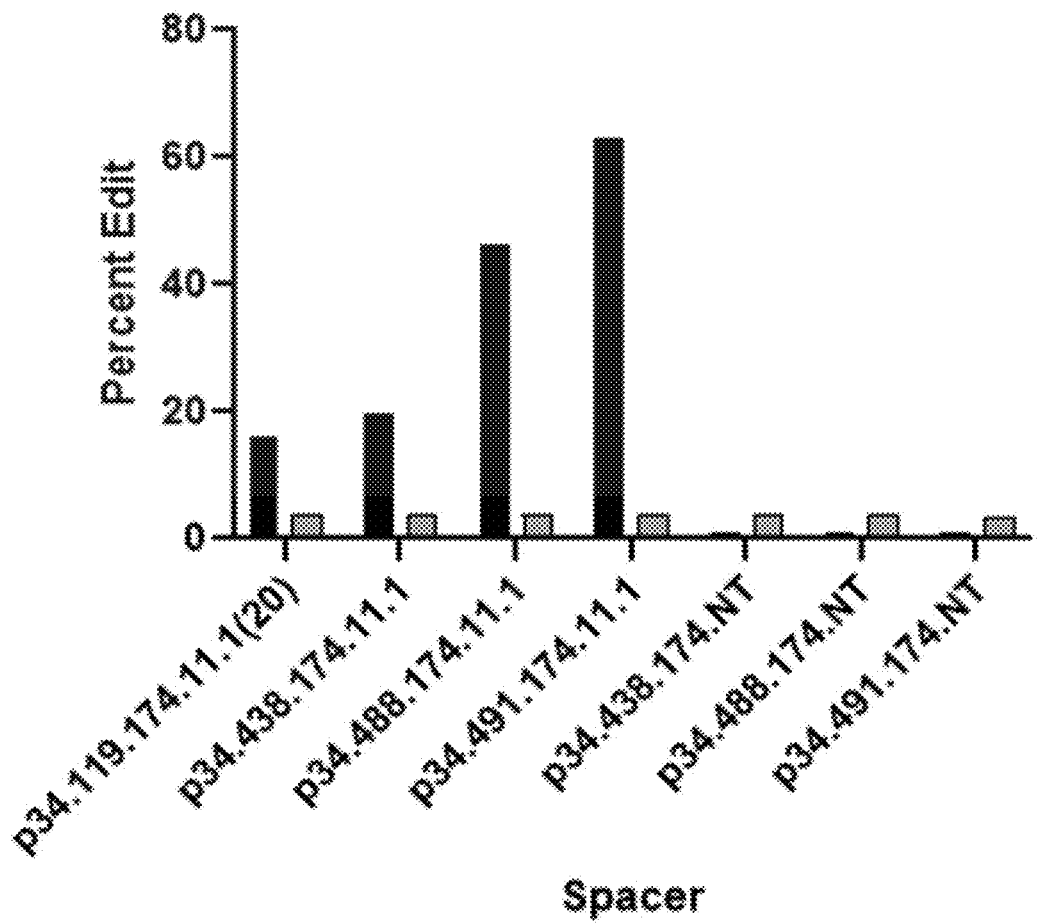
FIG. 33 shows results of an editing experiment in which CasX protein variants 119, 438, 488, and 491 with scaffold 174 were used to edit the RHO locus in ARPE19 dual reporter cells (WT.RHO-GFP P23H.RHO-mscarlet) cells in an allele-specific manner, as described in Example 19. ARPE19 dual reporter cells were transduced at MOI 300 with lentivirus packaging CasX constructs with spacer 11.1 targeting the WT.RHO allele, and editing was analyzed at the WT allele (GFP– cells, black bars) and the mutant allele (mscarlet-cells, gray bars) by flow cytometry 14 days post-transduction. Data are presented as average editing from n=3 replicates.
Figure 34:
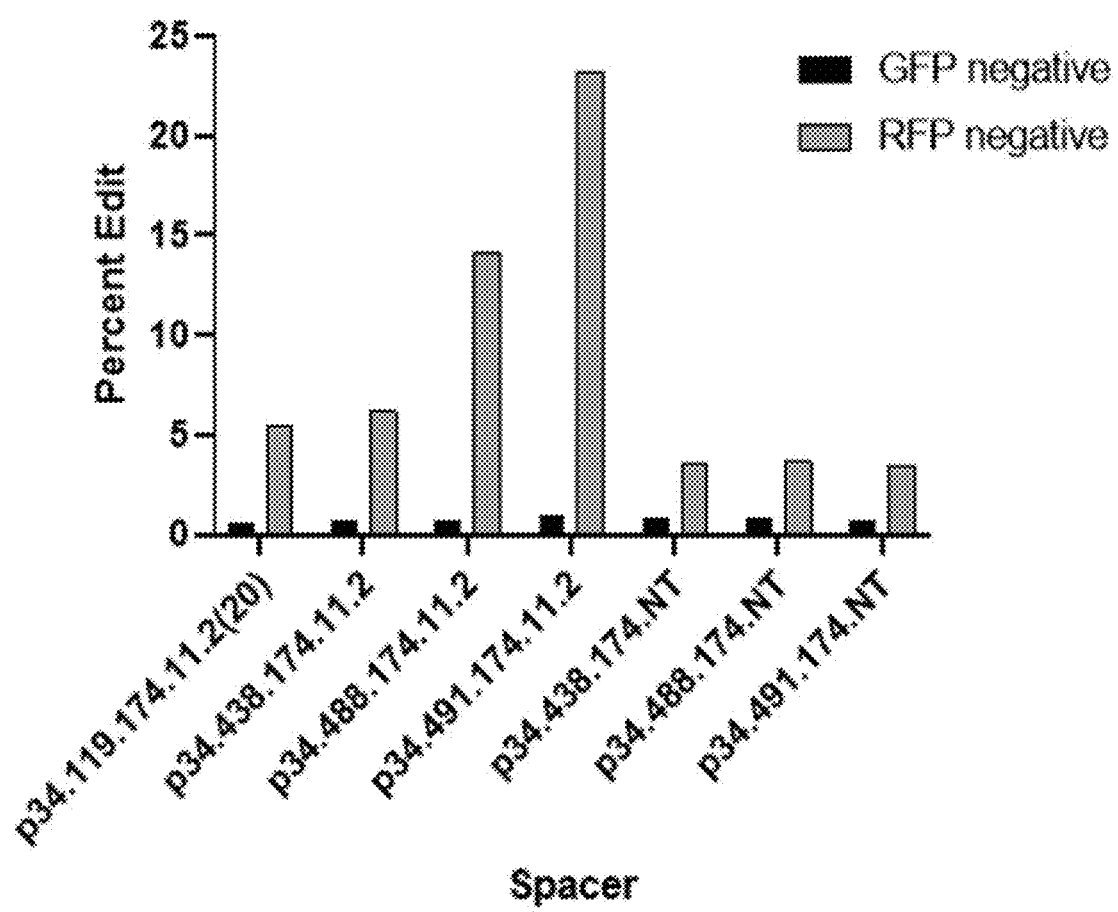
FIG. 34 shows results of an editing experiments in which CasX protein variants 119, 438, 488, and 491 with scaffold 174 edit the RHO locus in ARPE 19 dual reporter cells (WT.RHO-GFP P23H.RHO-mscarlet) cells in an allele-specific manner, as described in Example 19. ARPE19 dual reporter cells were transduced at MOI 300 with lentivirus packaging CasX constructs with spacer 11.2 targeting the mut.RHO allele, and editing was analyzed at the WT allele (GFP– cells, black bars) and the mutant allele (mscarlet-cells, gray bars) by flow cytometry 14 days post-transduction. Data are presented as average editing from n=3 replicates.

Results:

The graph in FIG. 33 shows that CasX variants 119, 438, 488 and 491 and scaffold 174 with spacer 11.1 targeting the WT RHO allele are able to edit on target with minimal off-target activity at the mutant RHO allele. Improved CasX variants show increasingly higher levels of editing on target (GFP– cells, black bars), with no appreciable gain in off-target activity at the P23 RHO locus (mscarlet– cells, gray bars). Similarly, the graph in FIG. 34 shows that CasX variants 119, 438, 488 and 491 and scaffold 174 with spacer 11.2 targeting the mutant RHO allele are able to edit on target with minimal off-target activity at the WT RHO allele. The CasX variants show increasingly higher levels of editing on target at the mutant RHO locus (mscarlet-cells, gray bars)(491>488>438>119), with no appreciable gain in off-target activity at the WT RHO locus (GFP– cells, black bars).

Under conditions of the assays, the results demonstrates that improved, engineered CasX variants edit the P23 RHO locus at higher efficiencies while maintaining allele-specificity.

Example 20: CasX Edits the RHO Gene at Many Different Loci in HEK293T Cells

The purpose of the experiment was to demonstrate the ability of CasX to edit the human RHO locus using the CasX variants 438, 488 and 491, guide 174 variant, and spacers (See Table 1 for sequences) targeting exon 1 of the human RHO gene.

Materials and Methods:

To facilitate assessment of editing outcomes, a HEK293T dual reporter cell line was first generated by knocking into HEK293T cells two transgene cassettes that constitutively expressed exon 1 of the human RHO gene linked to GFP and exon 1 of the human P23H.RHO gene linked to mscarlet. The modified cells were expanded by serial passage every 3-5 days and maintained in Fibroblast (FB) medium, consisting of Dulbecco's Modified Eagle Medium (DMEM; Corning Cellgro, #10-013-CV) supplemented with 10% fetal bovine serum (FBS; Seradigm, #1500-500), and 100 Units/mL penicillin and 100 mg/mL streptomycin (100×-Pen-Strep; GIBCO #15140-122), and can additionally include sodium pyruvate (100×, Thermofisher #11360070), non-essential amino acids (100× Thermofisher #11140050), HEPES buffer (100× Thermofisher #15630080), and 2-mercaptoethanol (1000× Thermofisher #21985023). The cells were incubated at 37° C., and 5% CO2. After 1-2 weeks, GFP+/mscarlet+ cells were bulk sorted into FB medium. The reporter lines were expanded by serial passage every 3-5 days and maintained in FB medium in an incubator at 37° C., and 5% C02. Reporter clones were generated by a limiting dilution method. The clonal lines were characterized via flow cytometry, genomic sequencing, and functional modification of the RHO locus using a previously validated RHO targeting CasX molecule. The optimal reporter lines were identified as ones that i) had a single copies of WTRHO.GFP and mutRHO.mscarlet correctly integrated per cell, ii) maintained doubling times equivalent to unmodified cells, and iii) resulted in reduction in GFP and mscarlet fluorescence upon disruption of the RHO gene when assayed using the methods described below.

Spacers for the guides were chosen based on PAM availability without prior knowledge of potential activity (see Table 14 for sequences). HEK293T dual reporter cells were seeded at 20-40 k cells/well in a 96 well plate in 100 µL of FB medium and cultured in a 37° C. incubator with 5% C02. The following day, cells were transfected at ~75% confluence. Each CasX and guide construct with spacers (see table for spacer and guide sequences) was transfected into the HEK293T dual reporter cells at 100-500 ng per well using Lipofectamine™ 3000 following the manufacturer's protocol, using 3 wells per construct as replicates. A non-targeting plasmid was used as a negative control. Cells were selected for successful transfection with puromycin at 0.3-3 µg/ml for 24-48 hours followed by recovery in FB medium. Edited cells were analyzed by flow cytometry 14 days after transfection. Briefly, cells were sequentially gated for live cells, single cells, and fraction of GFP-negative and/or mscarlet-negative cells.

Figure 35:
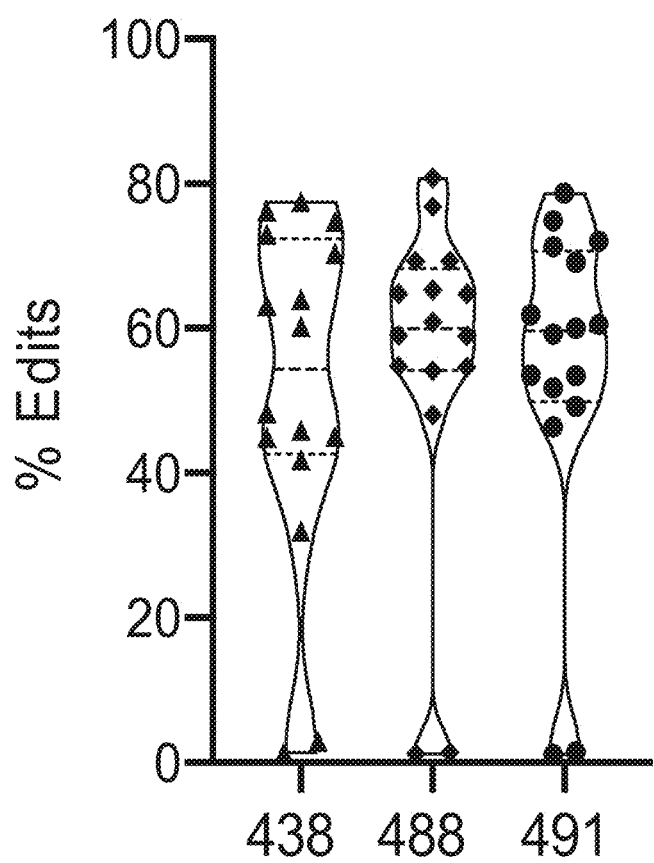
FIG. 35 shows the results of an editing experiment in which CasX protein variants 438, 488, and 491 with scaffold 174 edit the RHO locus in HEK293T dual reporter cells (WT.RHO-GFP P23H.RHO-mscarlet) cells, as described in Example 20. HEK293T dual reporter cells were transduced at MOI 300 with lentivirus packaging CasX constructs targeting the RHO gene and editing was analyzed by flow cytometry 14 days post-transduction. Data are presented as violin plots where each individual data point represents average editing (from n=3 replicates) generated by a single spacer.

Results:

The graph in FIG. 35 shows the results of flow cytometry analysis of Cas-mediated editing at the RHO locus in the HEK293T APRE19 dual dual reporter cells 14 days post-transfection. Eighteen different spacers (indicated by the individual data points) targeting the RHO exon 1 locus were used for each of the different CasX variants (438, 488, and 491) used in this experiment. Each data point is an average measurement of 3 replicates for an individual spacer. The results indicate that CasX and guides with several different spacers were able to edit the RHO locus with an average editing of 20%. The construct with non-targeting spacer resulted in no editing (data not shown).

Under conditions of the assays, the results demonstrate that, under the conditions of the assay, CasX variants 438, 488 and 491 with appropriate guides were able to successfully edit the RHO gene at many different loci in HEK293T dual reporter cells.

TABLE 14

RHO Guide sequences

| SSpacer | SSpacer Sequence | 174 Scaffold Sequence | Scaffold + Spacer Sequence |
|---|---|---|---|
| 11.13 | CAGCATTCT TGGGTGGGA GC (SEQ ID NO: 328) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGCAGCA TTCTTGGGTGGGAGC (SEQ ID NO: 348) |
| 11.14 | TGGGTGGGA GCAGCCACG GG (SEQ ID NO: 329) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGTGGGT GGGAGCAGCCACGGG (SEQ ID NO: 349) |
| 11.15 | TGGCTGTGG CCCTTGTGG CT (SEQ ID NO: 330) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGTGGCT GTGGCCCTTGTGGCT (SEQ ID NO: 350) |
| 11.16 | GTGCCATTC ATGGCTGTG GC (SEQ ID NO: 331 | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGGTGCC ATTCATGGCTGTGGC (SEQ ID NO: 351) |
| 11.17 | ACGTGCCCT TCTCCAATG CG (SEQ ID NO: 332) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGACGTG CCCTTCTCCAATGCG (SEQ ID NO: 352) |
| 11.18 | CCAATGCGA C GGGTGTGG TA (SEQ ID NO: 333) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGCCAAT GCGACGGGTGTGGTA (SEQ ID NO: 353) |
| 11.19 | AGTACCCAC AGTACTACC TG (SEQ ID NO: 334) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGAGTAC CCACAGTACTACCTG (SEQ ID NO: 354) |
| 11.20 | CCATGCTGG CCGCCTACA TG (SEQ ID NO: 335) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGCCATG CTGGCCGCCTACATG (SEQ ID NO: 355) |
| 11.21 | GCTGATCGT GCTGGGCTT CC (SEQ ID NO: 336) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGGCTGA TCGTGCTGGGCTTCC (SEQ ID NO: 356) |
| 11.22 | CCATCAACT TCCTCACGC TC (SEQ ID | ACTGGCGCTTTTATCT GATTACTTTGAGAGC CATCACCAGCGACTA | ACTGGCGCTTTTATCTGAT TACTTTGAGAGCCATCACC AGCGACTATGTCGTAGTGG |

TABLE 14-continued

RHO Guide sequences

| SSpacer | SSpacer Sequence | 174 Scaffold Sequence | Scaffold + Spacer Sequence |
|---|---|---|---|
| | NO: 337) | TGTCGTAGTGGGTAA AGCTCCCTCTTCGGA GGGAGCAT CAAAG (SEQ ID NO: 347) | GTAAAGCTCCCTCTTCGGA GGGAGCATCAAAGCCATC AACTTCCTCACGCTC (SEQ ID NO: 357) |
| 11.23 | TCACGCTCT ACGTCACCG TC (SEQ ID NO: 338) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGTCACG CTCTACGTCACCGTC (SEQ ID NO: 358) |
| 11.24 | TGTGCTGGA CGGTGACGT AG (SEQ ID NO: 339) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGTGTGC TGGACGGTGACGTAG (SEQ ID NO: 359) |
| 11.25 | TGGTCCTAG GTGGCTTCA CC (SEQ ID NO: 340) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGTGGTC CTAGGTGGCTTCACC (SEQ ID NO: 360) |
| 11.26 | CCAGCACCC TCTACACCT CT (SEQ ID NO: 341) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGCCAGC ACCCTCTACACCTCT (SEQ ID NO: 361) |
| 11.27 | TCTTCGGGC CCACAGGAT GC (SEQ ID NO: 342) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGTCTTC GGGCCCACAGGATGC (SEQ ID NO: 362) |
| 11.28 | GGCCCACAG GATGCAATT TG (SEQ ID NO: 343) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGGGCCC ACAGGATGCAATTTG (SEQ ID NO: 363) |
| 11.29 | TTGCCACCC TGGGCGGIA TG (SEQ ID NO: 344) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGTTGCC ACCCTGGGCGGTATG (SEQ ID NO: 364) |
| 11.1 | AAGGGGCT GCGTACCAC ACC (SEQ ID NO: 345) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGAAGGG GCTGCGTACCACACC (SEQ ID NO: 365) |

TABLE 14-continued

RHO Guide sequences

| SSpacer | SSpacer Sequence | 174 Scaffold Sequence | Scaffold + Spacer Sequence |
|---|---|---|---|
| 11.2 | AAGTGGG CTGCGTAC CACACC (SEQ ID NO: 346) | ACTGGCGCTTTTATCT GATTACTTTGAGAGC CATCACCAGCGACTA TGTCGTAGTGGGTAA AGCTCCCTCTTCGGA GGGAGCATCAAAG (SEQ ID NO: 347) | ACTGGCGCTTTTATCTGAT TACTTTGAGAGCCATCACC AGCGACTATGTCGTAGTGG GTAAAGCTCCCTCTTCGGA GGGAGCATCAAAGAAGTG GGCTGCGTACCACACC (SEQ ID NO: 366) |

Example 21: CasX Targeted to P23 RHO Shows No Detectable Editing at Predicted Off-Target Locations in the Human Genome A key aspect to evaluate targeted RNP of CasX and guide RNA is to ensure specific cleavage at on-target sites in the genome, with limited or no detectable edits at possible off-targets. The purpose of these experiments was to evaluate whether we could detect off-target editing of the RNP targeted to the human RHO P23H spacer (see Table 15 for spacer sequences).

To achieve this goal, a set of predicted off targets for the human RHO P23H spacer (11.2) in the human genome were generated computationally, and then assessed for detectable editing when treated with a targeted CasX RNP.

Materials and Methods:

Off-Target Site Prediction

Off-targets of the spacer sequence 11.2 were predicted for the entire human genome (hg38). Off-targets were required to have a competent PAM (here, TTC or CTC), and sufficient similarity to the spacer 11.2 sequence. A position-weight-matrix (PWM) was generated to model the PAM-spacer sequence, with a requirement for more stringent sequence matching in the PAM and in the PAM-proximal region of the spacer. Every sequence across the genome was compared to this PWM to generate a score. A score threshold was determined to include every single and double mutation within the spacer sequence, the large majority of triple and quadruple mutants (excluding only those sequences with all mutations occurring in the 7 PAM-proximal nucleotides), and a subset of higher order mutations (5 or more mutations). Regions of the genome with a score greater than or equal to the score threshold were identified for the experiments.

Cell Treatment

HEK293T cells were seeded at 20-40 k cells/well in a 96 well plate in 100 µL of Fibroblast (FB) medium and cultured in a 37° C. incubator with 5% CO2. The following day, confluence of seeded cells was checked to ensure that cells were at ~75% confluence at time of transfection. If cells were at the right confluence, transfection was carried out. Each CasX and guide construct (119.174, see Table 15 for spacer sequences) was transfected into the HEK293T cells at 100-500 ng per well using Lipofectamine™ 3000 following the manufacturer's protocol, using 3 wells per construct as replicates. SaCas9 and SpyCas9 targeting RHO were used as benchmarking controls. For each Cas protein type, a non-targeting plasmid was used as a negative control. Cells were selected for successful transfection with puromycin at 0.3-3 µg/ml for 24-48 hours followed by 24-48 hours of recovery in FB medium. A subset of cells for each sample from the experiment was lysed, and the genome was extracted using a Quick extract solution following the manufacturer's protocol.

An ARPE19 dual reporter cell line (WT.RHO.GFP mut.RHO.mscarlet) was first generated by knocking into ARPE19 cells a transgene cassette that constitutively expresses exon 1 of the human RHO gene linked to GFP and exon 1 of the human P23H.RHO gene linked to mscarlet. The modified cells were expanded by serial passage every 3-5 days and maintained in Fibroblast (FB) medium, consisting of Dulbecco's Modified Eagle Medium (DMEM: Corning Cellgro, #10-013-CV) supplemented with 10% fetal bovine serum (FBS; Seradigm, #1500-500), and 100 Units/mL penicillin and 100 mg/mL streptomycin (100×-Pen-Strep: GIBCO #15140-122), and can additionally include sodium pyruvate (100×, Thermofisher #11360070), non-essential amino acids (100× Thermofisher #11140050). HEPES buffer (100× Thermofisher #15630080), and 2-mercaptoethanol (1000× Thermofisher #21985023). The cells were incubated at 37° C., and 5% CO2. After 1-2 weeks, GFP+ cells were bulk sorted into FB medium. The reporter lines were expanded by serial passage every 3-5 days and maintained in FB medium in an incubator at 37° C., and 5% CO2. Reporter clones were generated by a limiting dilution method. The clonal lines were characterized via flow cytometry, genomic sequencing, and functional modification of the RHO locus using a previously validated RHO targeting CasX molecule. The optimal reporter lines were identified as ones that i) had a single copy of GFP correctly integrated per cell, ii) maintained doubling times equivalent to unmodified cells, and iii) resulted in reduction in GFP fluorescence upon disruption of the RHO gene when assayed using the methods described below.

ARPE19 dual reporter cells, constructed using cell line generation methods described above, were used for this experiment. Cells were seeded at 20-40 k cells/well in a 96 well plate in 100 µL of FB medium and cultured in a 37° C. incubator with 5% CO2. The following day, lentiviral vectors packaging each CasX and guide construct (e.g., see table for sequences) were used to transduce cells at a high multiplicity of infection (MOI 300), using 3 wells per construct as replicates. A lentivirus packaging a non-targeting construct was used as a negative control. Cells were selected for successful transduction with puromycin at 0.3-3 µg/ml for 24-48 hours followed by recovery in FB medium. Cells from the experiment were lysed, and the genome was extracted using a Quick extract solution following the manufacturer's protocol.

NGS Prep and Analysis

Genomic DNA was amplified via PCR with primers specific to the target genomic location of interest to form a target amplicon. These primers contain additional sequence at the 5' ends to introduce Illumina read and 2 sequences (see table for sequences). Typical PCR conditions would be: 1× Kapa Hifi buffer, 300 nM dNTPs, 300 nM each primer, 0.75 ul of Kapa Hifi Hotstart DNA polymerase in a 50 d reaction. On a thermal cycler, cycle for 95° C. for 5 min; then 16-25 cycles of 98° C. for 15 s, 60° C. for 20 s, 72° C. for 1 min; with a final extension of 2 min at 72° C. Amplified DNA product was purified with Ampure XP DNA cleanup kit, with elution in 30 µl of water.

A second PCR step was done with indexing adapters to allow multiplexing on the Illumina platform. 20 µl of the purified product from the previous step was combined with 1× Kapa GC buffer, 300 nM dNTPs, 200 nM each primer, 0.75 ul of Kapa Hifi Hotstart DNA polymerase in a 50 µl reaction. On a thermal cycler, cycle for 95° C. for 5 min; then 18 cycles of 98° C. for 15 s, 65° C. for 15 s, 72° C. for 30 s; with a final extension of 2 min at 72° C. Amplified DNA product was purified with Ampure XP DNA cleanup kit, with elution in 30 µl of water. Quality and quantification of the amplicon was assessed using a Fragment Analyzer DNA analyzer kit (Agilent, dsDNA 35-1500 bp). Amplicons were sequenced on the Illumina Miseq™ according to the manufacturer's instructions.

Raw fastq files from sequencing were processed as follows: (1) The sequences were trimmed for quality and for adapter sequences; (2) the sequences from read 1 and read 2 were merged into a single insert sequence: (3) each sequence was quantified for containing an insertion or deletion (indel) relative to the reference sequence, in a window around the 3' end of the spacer (30 bp window centered at −3 bp from 3' end of spacer). The activity of the StX molecule was quantified as the total percent of reads that contain an indel for each sample.

Results:

Two different experiments were conducted to test for off-target cleavage by X-editing RNP. In brief, two different cell lines were each edited by CasX RNP targeted to the human WT or P23H RHO Locus (using spacers 11.1 and 11.2 respectively), or were treated with an non-targeting control RNP (NT). The genomic DNA from each cell experiment was isolated and prepped for NGS sequencing by targeted amplification of the RHO locus ("On-target") and 8 other loci across the genome that were predicted to be off-targets, based on having a competent PAM (TTC or CTC) and were sufficiently similar to spacer 11.2.

Figure 36:
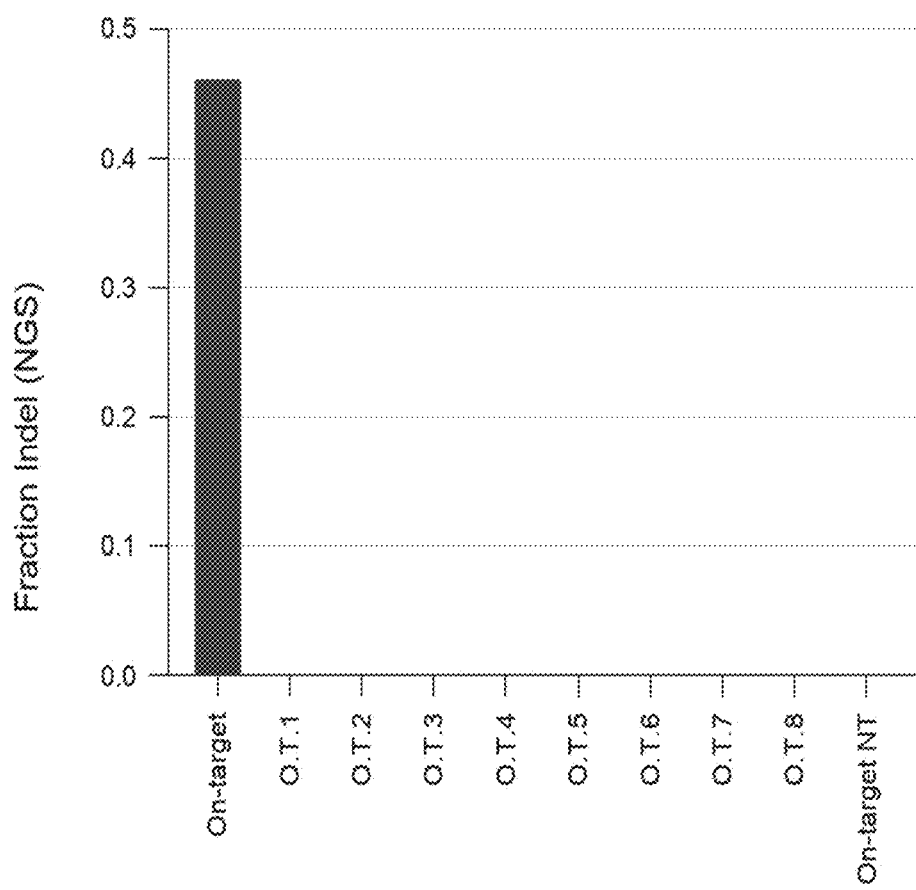
FIG. 36 shows results of editing in the HEK293 cell line, treated by transfection of p34.119.174.11.1 (or NT-last bar), assessing for indel formation, as described in Example 21.
Figure 37:
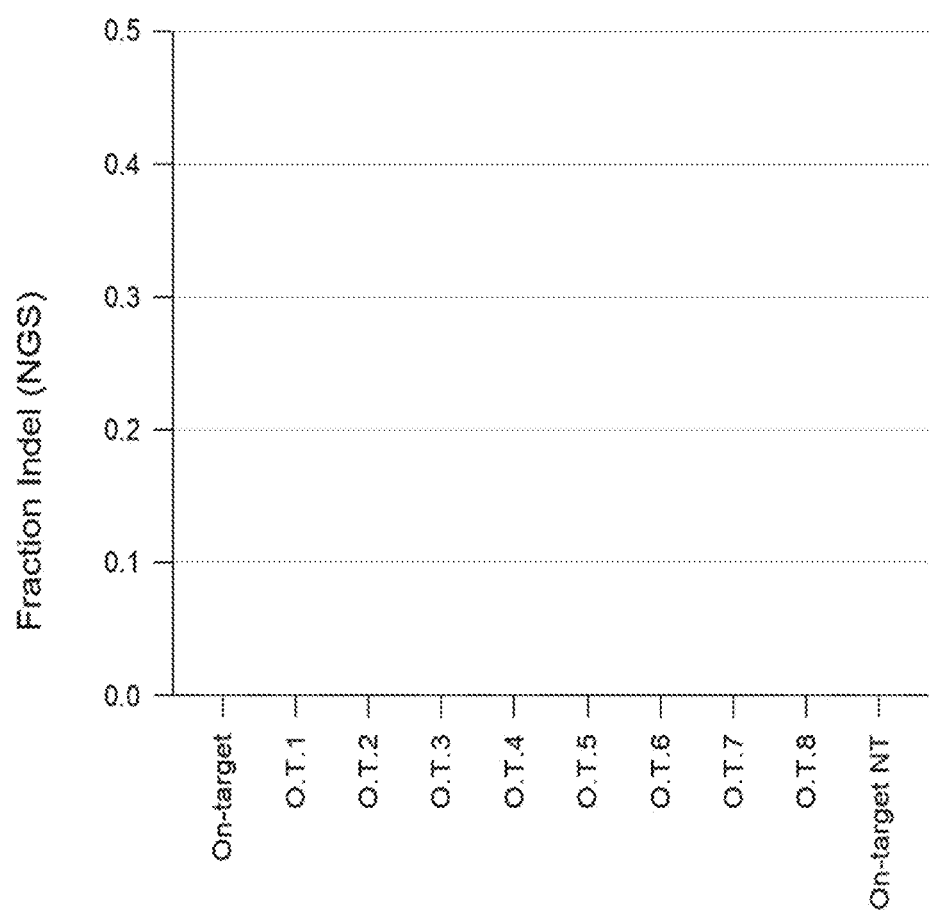
FIG. 37 shows results of editing in the HEK293 cell line, treated by transfection of p34.119.174.11.2 (or NT—last bar), assessing for indel formation, as described in Example 21.

In the first experiment (FIG. 36), a HEK293T cell line was treated with XE-119.174.11.1, XE-119.174.11.2, or XE-119.174.NT by transfection. None of the predicted off-target sites of spacer 11.2 showed any detectable indel formation when treated with RNP targeted with spacers 11.1 (targeting the WT RHO exon 1) or 11.2 (targeting the P23H mutation in Rho Exon 1; FIG. 37). The on-target site of the RHO exon 1 was appreciably edited by spacer 11.1, with approximately 45% of cells showing indel formation. No editing was observed by spacer 11.2 at the WT RHO Exon1 (FIG. 37), which was expected given that this cell type does not contain a P23H mutated allele.

Figure 38:
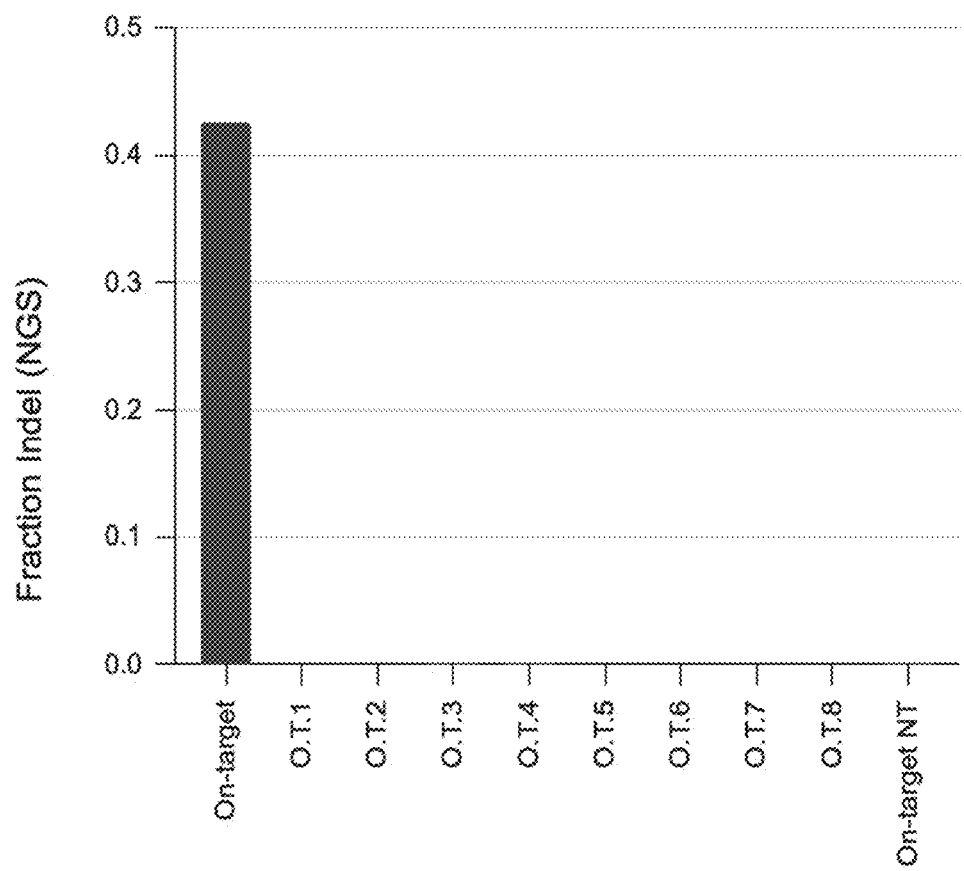
FIG. 38 shows results of editing in the ARPE cell line (with P23H dual reporter), treated by lentiviral delivery of p56.491.174.11.1 (or NT—last bar), assessing for indel formation, as described in Example 21.

In the second experiment (FIG. 38), an ARPE-derived cell line was treated with XE-491.174.11.1 or XE-119.174.NT by lentiviral transduction. None of the predicted off-target sites of spacer 11.2 showed any detectable indel formation when treated with RNP targeted with spacer 11.1. The on-target site of the RHO exon 1 was appreciably edited by spacer 11.1, with approximately 42% of cells showing indel formation.

Under conditions of the assay, the results show consistent editing of the on-target site and undetected editing at off-target sites, across multiple cell types and delivery modalities. Thus, the CasX-RNP targeted to Rho are highly specific with no evidence of genotoxicity.

TABLE 15

Sequences for on target at the P23 RHO locus, and predicted off-targets in the human genome

| Spacer | PAM | Sequence | SEQ ID NO: |
|---|---|---|---|
| On-target, 11.1 | CTC | AAGGGGCTGCGTACCACACC | 367 |
| On-target, 11.2 | CTC | AAGTGGCTGCGTACCACACC | 368 |
| O.T.1 | CTC | AAGTGGCTGCCCTCCACAGA | 369 |
| O.T.2 | TTC | AAGTGGCTGCATTCTACACC | 370 |
| O.T.3 | TTC | AAGTGGCTATGAACAACAGC | 371 |
| O.T.4 | CTC | AAGTGGCTGCCAGCCACCCC | 372 |
| O.T.5 | TTC | AAGTGGCTGCTGACAGCACT | 373 |
| O.T.6 | TTC | AAGTGGCTGCCTCCCTCAGT | 374 |
| O.T.7 | TTC | AAGTGGCTGTGAACCATGGC | 375 |
| O.T.8 | TTC | AAGTGGCTGCTTATCTAAGC | 376 |

Example 22: CasX Edits the P23 RHO Locus in Vivo in C57BL/6J Mice

The purpose of this experiment was to demonstrate the ability of CasX to edit in vivo the endogenous RHO locus in the mouse retina, with a spacer targeting the P23 residue at a therapeutically relevant level, to generate proof-of-concept data that will justify and inform experiments in the P23H mouse disease model. Here, we assessed whether CasX variant 491 and guide variant 174, and a spacer targeting the P23 locus of the mouse RHO gene can generate significant, detectable in the retina when injected subretinally, and evaluate efficacy and safety of two different viral doses (1.0e+9 and 1.0e+10 vg). Rescue of 10% of rod photoreceptors can restore vision in cases of AdRP. Therefore, editing 10% of the RHO loci in rod photoreceptors in the retina may provide a therapeutic benefit in a disease context by reducing the levels of the mutant rhodopsin protein and preventing rod photoreceptor degeneration.

Materials and Methods:

Generation of AAV Plasmids and Viral Vectors

The CasX variant 491 under the control of the CMV promoter and RNA guide variant 174/spacer 11.30 (AAGGGGCCCGCACCACGCC (SEQ ID NO: 377), targeting mouse RHO exon 1 at P23 residues) under the U6 promoter were cloned into a pAAV plasmid flanked with AAV2 ITR AAV.491.174.11.30 vectors were produced in HEK293 cells using the triple-transfection method.

Subretinal Injections

C57BL/6J mice were obtained from the Jackson Laboratories and maintained in a normal 12 hours light/dark cycle. Subretinal injections were performed on 5-6 weeks old mice. Mice were anesthetized with isoflurane inhalation. Proparacaine (0.5%) was applied topically on the cornea and the eyes were dilated with drops of tropicamide (1%) and phenylephrine (2.5%). Eyes were kept lubricated with genteal gel during the surgery. Under a surgical microscope, an ultrafine 30½-gauge disposable needle was passed through the sclera, at the equator and next to the limbus, to create a small hole into the vitreous cavity. Using a blunt-end needle, 1-1.5 µL of virus was injected directly into the subretinal space, between the RPE and retinal layer. Each experimental group (n=5) were injected in one eye with 1e+9 vg or 1e+10 viral genome (vg)/eye, and the contralateral eye injected with the AAV formulation buffer.

NGS Analysis 3 weeks post-injection, animals were sacrificed and the eyes enucleated in fresh PBS. Whole retinae were isolated from the eye cups and processed for gDNA extraction using the DNeasy Blood & Tissue Kit (Qiagen) according to the manufacturer's instructions. Amplicons were amplified from 200 ng of gDNA with a set of primers (Fwd 5'-

(SEQ ID NO: 378)
(Fwd 5'-
ACACTCTTTCCCTACACGACGCTCTTCCGATCTNNNNNNNNGCAGCCTTGG

TCTCTGTCTACG-3;

(SEQ ID NO: 379)
Rev 5'-
GTGACTGGAGTTCAGACGTGTGCTCTTCCGATCTGCCCCAGTCTCTCTGC

TCATACC-3')

targeting the mouse RHO, exon 1 locus, bead-purified (Beckman coulter, Agencourt Ampure XP) and then re-amplified to incorporate illumina adapter sequence. Specifically, these primers contained an additional sequence at the 5' ends to introduce Illumina read and 2 sequences as well as a 16 nt random sequence that functions as a unique molecular identifier (UMI). Quality and quantification of the amplicon was assessed using a Fragment Analyzer DNA analyzer kit (Agilent, dsDNA 35-1500 bp). Amplicons were sequenced on the Illumina Miseq™ according to the manufacturer's instructions. Raw fastq files from sequencing were processed as follows: (1) the sequences were trimmed for quality and for adapter sequences using the program cutadapt (v. 2.1); (2) the sequences from read 1 and read 2 were merged into a single insert sequence using the program flash2 (v2.2.00); and (3) the consensus insert sequences were run through the program CRISPResso2 (v 2.0.29), along with the expected amplicon sequence and the spacer sequence. This program quantifies the percent of reads that were modified in a window around the 3' end of the spacer (30 bp window centered at −3 bp from 3' end of spacer). The activity of the CasX molecule was quantified as the total percent of reads that contain insertions, substitutions and/or deletions anywhere within this window.

Immunohistology

Mice were euthanized 3-4 weeks post-injection. Enucleated eyes were placed in 10% formalin overnight at 4° C. Retinae were dissected out from the eye cups, rinsed in PBS thoroughly and immersed in 15%-30% sucrose gradient. Tissues were embedded in optimal cutting temperature (OCT), froze on dry ice before being transferred to −80'C storage. 20 µM sections were cut using a cryostat. The sections were blocked for ≥1 hour at room temperature in blocking buffer (2% normal goat serum, 1% BSA, 0, 1% Triton-X 100) before antibody labeling. The antibodies used were anti-mouse HA (abcam, 1:500) and Alexa Fluor 488 rabbit anti-mouse (Invitrogen, 1:2000). Sections were counterstained with DAPI to label nuclei, mounted on slides and imaged on a fluorescent microscope.

Figure 39:
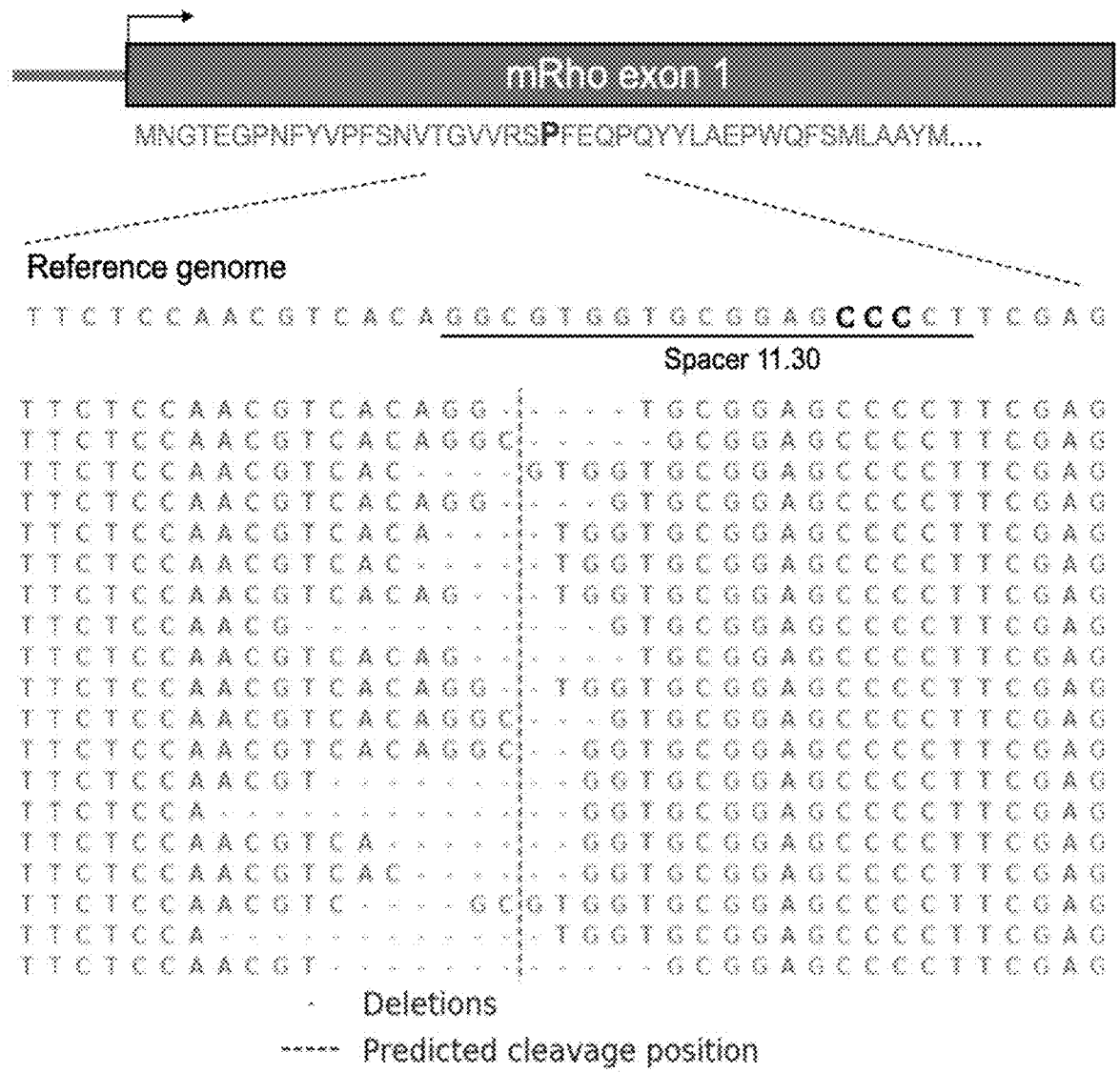
FIG. 39 is an illustration of reference mRHO exon 1 locus (SEQ ID NOs: 27280 and 27281) and target amino acid residue P23 (CCC) sequence (highlighted in bold), showing spacer 11.30 target sequence and expected CasX-mediated cleavage, as described in Example 22. The most common predicted edits quantified in CRISPResso edits (substitution/deletions (SEQ ID NOs: 27282-27300)) are displayed under the reference genome).
Figure 40:
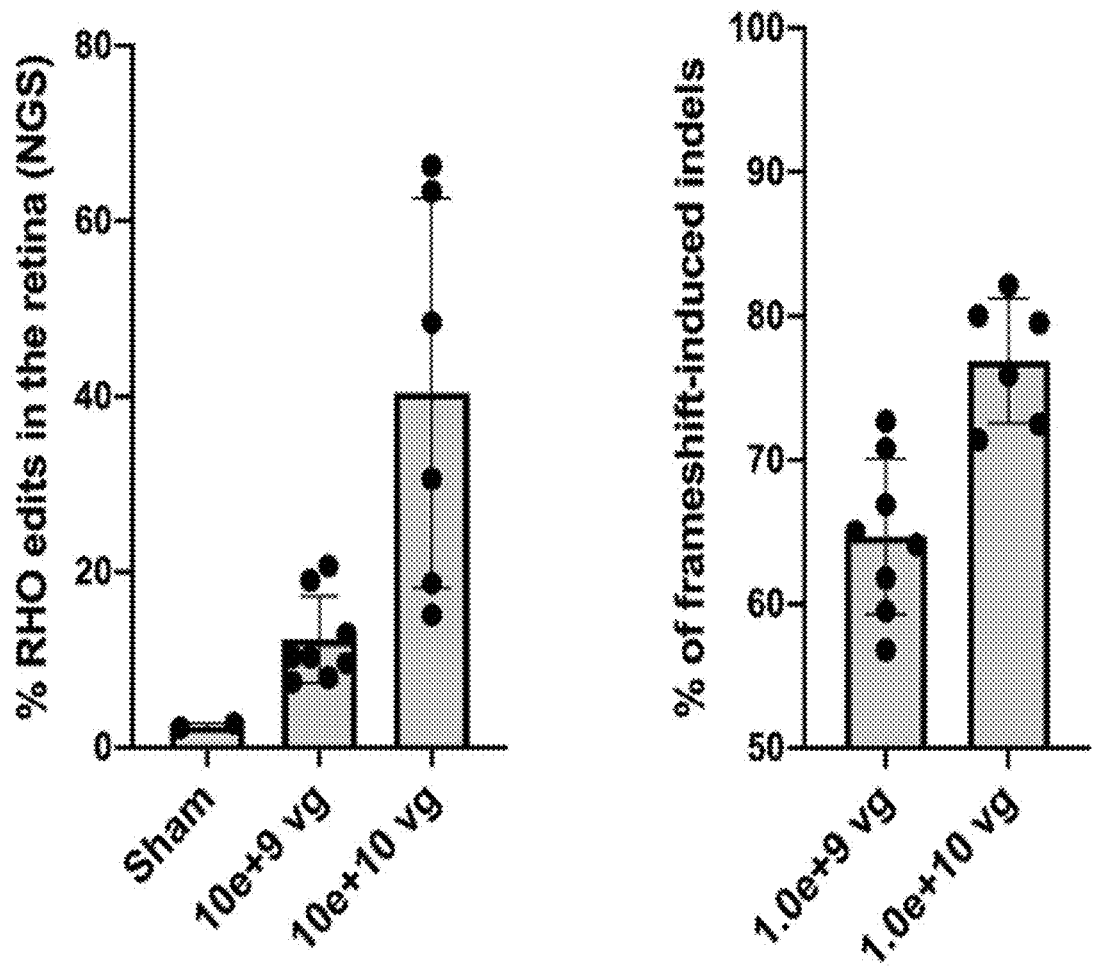
FIG. 40 shows results of in vivo AAV CasX-mediated editing of the mRHO P23 locus in retinae in C57BL6J (n=6-8) mice, as described in Example 22. Retinae were harvested 3 weeks post-injection, gDNA extracted, amplified and indel rates analyzed via NGS and CRISPResso analysis. Left panel shows the quantification in % of total indels detected by NGS at the mouse P23 RHO locus in AAV-CasX or sham-injected retinae compared to the mouse reference genome. Right panel shows the fraction (%) of edits predicted to lead to frameshift mutations in RHO protein. Data are presented as average of NGS readouts of editing outcomes from the entire retina, from six to eight animals per experimental cohort.

Results:

We assessed the ability of CasX to edit the P23 RHO locus in the mouse retina. Two therapeutically relevant doses, 1.0e+9 and 1.0E+10 vg of AAV-CasX.491.174.11.30 were administered in the subretinal space of 5-6 weeks old C57BL/6J mice. Three weeks post-injections, retinae were harvested and editing levels quantified via NGS and the CRISPResso analysis pipeline. The spacer 11.30 targets the WT P23 genomic locus (FIG. 39) located at the beginning of the first exon of RHO. Overexpression of CasX-491.174.11.30 led to significant, dose-dependent, editing of mRHO exon 1 locus in treated—compared to sham-injected retinae (FIG. 40). The left panel shows the quantification in % of total indels detected by NGS at the mouse P23 RHO locus in AAV-CasX or sham-injected retinae compared to the mouse reference genome. The right panel shows the fraction (%) of edits predicted to lead to frameshift mutations in RHO protein. Data are presented as average of NGS readouts of editing outcomes from the entire retina, from six to eight animals per experimental cohort. The highest AAV dose, 1e+10 vg/eye, increased indels rate by 4-fold compared to the 1.0e+9 vg dose, with 40.3±22% versus 12.3±5% RHO editing detected respectively. The majority of indels generated by CasX.491 were deletions (left panel), predicted to translate to a high frequency of frameshift-mutations (64.7 versus 76.9% for 1.0e+9 and 1.0e+10 vg/dose respectively), and hypothetically high levels of RHO protein knock down. These results suggest that with a spacer driving allele-specific target of mutant P23H locus in the P23H+/− mouse model, CasX could efficiently editing 10% of rod photoreceptor, with the majority of edits translating to a knocking-down the mutant P23H Rho and significantly delay photoreceptor degeneration.

Figure 41:
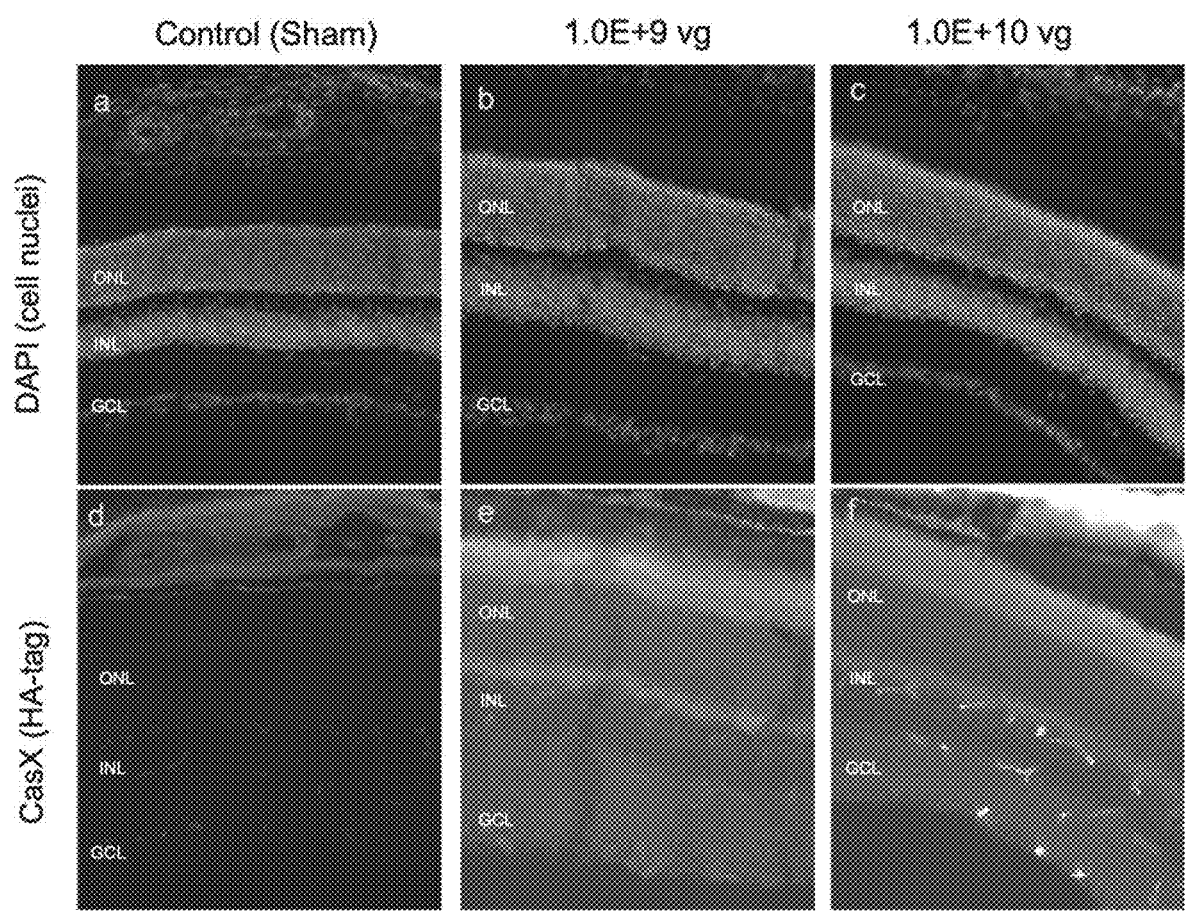
FIG. 41 shows representative fluorescence imaging of retinas from AAV-CasX treated mice or negative controls and stained, as described in Example 22. Cell nuclei were counterstained with DAPI (top row.

Immunohistochemistry performed on injected retinal cross-sectioned confirmed CasX expression in the photoreceptors layers, but also showed spread of the virus to the inner layers as show in in FIGS. 41A-F. The treatment groups were 1.0e+9 vg of AAV-CasX (FIG. 41B and e), 1.0e+10 vg AAV-CasX (FIG. 41 c and f); or PBS (FIGS. 41A and 41D). Levels of HA-tagged CasX was assessed by Anti-HA antibody staining (lower panels of FIGS. 41E, and 41F) in the photoreceptor cell bodies in the located in the outer nuclear layer (ONL) as well as outer segments, in retinas injected with both the 1e9 vg (FIGS. 41B and 41E) and 1e10 vg (FIGS. 41C and 41F). The control retinas that received a sham (FIGS. 41A and 41C) injection only showed background levels of signal for HA staining (FIG. 41D) in the RPE/sclera and had no detectable level in the ONL/INL layer. Additionally, gross histological analysis showed that the retinal structure was maintained after subretinal administration of AAV packaging CasX constructs.

Under the conditions of the experiments, the results demonstrate proof-of-concept that CasX 491, scaffold 174, and a spacer targeting the mouse P23 RHO locus can achieve therapeutically-relevant levels of edits at the P23 mouse locus when subretinally delivered via AAV in the murine retina.

Example 23: Use of CasX:gNA System to Alleviate Disease Symptoms in a P23H Disease Model The mouse RHO$^{P23H}$ model is a well-established disease model for AdRP. The purpose of this experiment will be to demonstrate that CasX and a guide RNA with a spacer targeting the P23H RHO locus in RHO$^{P23H}$ mice can alleviate disease symptoms by preventing rod photoreceptor degeneration.

Materials and Methods: AAV packaging CasX, guide and a spacer targeting the mouse P23H RHO locus (AAGTFFCTCCGCACCACGCC, SEQ ID NO: 380) will be subretinally administered in 4-6 week old RHO$^{P23H}$ mice at doses ranging from 1e8 viral genomes (vg) to 1e10 vg using injection volumes of 1-1.5 µL. As controls, AAV formulation buffer (e.g., phosphate buffered saline) will be injected in the contralateral eye for experimental animals. As pre-determined time point, for example once before injection and then biweekly starting at 4 weeks post-injection and until 12 weeks post-injection, retinal health and function will be assessed by Optical Coherence Tomography (OCT) and Electroretinography (ERG). Additionally, also at pre-determined time points, for example at 4 weeks post injection and at 12 weeks post injection, a subset of animals will be sacrificed and retinas collected for editing assessment by NGS, WB, and RNAseq.

This experiment is expected to show that the CasX and guide with a spacer targeting the mouse P23H RHO locus, when delivered by subretinal AAV injection to RHO$^{P23H}$ mice, can edit the target genomic locus (as measured by NGS analysis) and result in reduction of the mutant rhodopsin protein (as measured by WB analysis). Immunohistology is expected to show the maintenance of rod photoreceptors and absence of retinal degeneration. RNAseq is expected to show reduction in the transcript levels of mutant RHO, with no detectable effect on the levels of the WT RHO transcript. OCT and ERG is expected to show that retinal integrity and function are maintained in the eyes that receive AAV.CasX, while the sham treated eyes follow the natural progression of retinal degeneration and loss of function.

SEQUENCE LISTING (27301 sequences)

SEQ ID NO: 1 - protein, 986 aa, Unknown
  Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, Unknown
  Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, Unknown
  Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - RNA, 108 nt, Artificial Sequence
  gRNA sequence
acaucuggcgcguuuauuccauuacuuuggagccagucccagcgacuaugucguauggacgaagcgcuuauuuaucggagagaaaccgauaaguaaaacgcaucaaag

SEQ ID NO: 5 - RNA, 108 nt, Artificial Sequence
  gRNA sequence
uacuggcgcuuuuaucucauuacuuugagagccaucaccagcgacuaugucguauggguaaagcgcuuauuuaucggagagaaauccgauaaauaagaagcaucaaag

SEQ ID NO: 6 - RNA, 81 nt, Artificial Sequence
  gRNA sequence
acaucuggcgcguuuauuccauuacuuuggagccagucccagcgacuaugucguauggacgaagcgcuuauuuaucggaga

SEQ ID NO: 7 - RNA, 78 nt, Artificial Sequence
  gRNA sequence
acaucuggcgcguuuauuccauuacuuuggagccagucccagcgacuaugucguauggacgaagcgcuuauuuaucgg

SEQ ID NO: 8 - RNA, 80 nt, Artificial Sequence
  gRNA sequence
uacuggcgcuuuuaucucauuacuuugagagccaucaccagcgacuaugucguauggguaaagcgcuuauuuaucggaga

SEQ ID NO: 9 - RNA, 77 nt, Artificial Sequence
  gRNA sequence
uacuggcgcuuuuaucucauuacuuugagagccaucaccagcgacuaugucguauggguaaagcgcuuauuuaucgg

SEQ ID NO: 10 - RNA, 25 nt, Artificial Sequence
  gRNA sequence
guuuacacacucccucucauagggu

SEQ ID NO: 11 - RNA, 25 nt, Artificial Sequence
  gRNA sequence
guuuacacacucccucucaugaggu

SEQ ID NO: 12 - RNA, 25 nt, Artificial Sequence
  gRNA sequence
uuuuacauacccccucucaugggau

SEQ ID NO: 13 - RNA, 25 nt, Artificial Sequence
  gRNA sequence
guuuacacacucccucucauggggg

SEQ ID NO: 14 - RNA, 20 nt, Artificial Sequence
  gRNA sequence
ccagcgacuaugucguaugg

SEQ ID NO: 15 - RNA, 39 nt, Artificial Sequence
  gRNA sequence
gcgcuuauuuaucggagagaaauccgauaaauaagaagc

SEQ ID NO: 16 - RNA, 74 nt, Artificial Sequence
  gRNA sequence
ggcgcuuuuaucucauuacuuugagagccaucaccagcgacuaugucguauggguaaagcgcuuauuuaucgga

SEQ ID NO: 17 - DNA, 20 bp, Artificial Sequence
  E6 spacer sequence
tgtggtcggggtagcggctg

SEQ ID NO: 18 - DNA, 20 bp, Artificial Sequence
  E7 spacer sequence
tcaagtccgccatgcccgaa

SEQ ID NO: 19 - RNA, 21 nt, Artificial Sequence
  stem loop sequence
  misc_feature (4)..(18): n is any ribonucleotide
  misc_feature (8)..(18): These individual nucleotides may be absent
uuunnnnnnnnnnnnnnnuuu

SEQ ID NO: 20 - RNA, 20 nt, Artificial Sequence
  scaffold stem loop
ccagcgacuaugucguaugg

SEQ ID NO: 21 - RNA, 39 nt, Artificial Sequence; identical to SEQ ID NO: 15
  extended stem loop

SEQ ID NO: 22 - RNA, 81 nt, Unknown; identical to SEQ ID NO: 6
  Deltaproteobacter sp.

SEQ ID NO: 23 - RNA, 78 nt, Unknown; identical to SEQ ID NO: 7
  Deltaproteobacter sp.

SEQ ID NO: 24 - RNA, 23 nt, Unknown
  Deltaproteobacter sp.
ccgauaaguaaaacgcaucaaag

SEQ ID NO: 25 - RNA, 80 nt, Unknown; identical to SEQ ID NO: 8
  Planctomycetes sp.

SEQ ID NO: 26 - RNA, 77 nt, Unknown; identical to SEQ ID NO: 9
  Planctomycetes sp.

SEQ ID NO: 27 - RNA, 26 nt, Unknown
  Planctomycetes sp.
ucuccgauaaauaagaagcaucaaag

SEQ ID NO: 28 - RNA, 25 nt, Unknown
  Candidatus Sungbacteria sp.
guuuacacacucccucucauagggu

SEQ ID NO: 29 - RNA, 25 nt, Unknown
  Candidatus Sungbacteria sp.
guuuacacacucccucucaugaggu

SEQ ID NO: 30 - RNA, 25 nt, Unknown
  Candidatus Sungbacteria sp.
uuuuacauacccccucucaugggau

SEQ ID NO: 31 - RNA, 25 nt, Unknown
  Candidatus Sungbacteria sp.
guuuacacacucccucucauggggg

SEQ ID NO: 32 - RNA, 21 nt, Artificial Sequence
  scaffold stem loop
ccagcgacuaugucguagugg

SEQ ID NO: 33 - protein, 348 aa, Homo sapiens [sequence omitted]

SEQ ID NO: 34 - protein, 348 aa, Homo sapiens
MNGTEGPNFYVPFSNATGVVRSHFEYPQYYLAEPWQFSMLAAYMFLLIVLGFPINFLTLYVTVQHKKLRTPLNYILLNLAVADLFMVLGGFTSTLYTSLHGYFVFGPTGCNLEGFFATLGGEIALWSLVVLAIERYVVVCKPMSNFRFGENHAIMGVAFTWVMALACAAPPLAGWSRYIPEGLQCSCGIDYYTLKPEVNNESFVIYMFVVHFTIPMIIIFFCYGQLVFTVKEAAAQQQESATTQKAEKEVTRMVIIMVIAFLICWVPYASVAFYIFTHQGSNFGPIFMTIPAFFAKSAAIYNPVIYIMMNKQFRNCMLTTICCGKNPLGDDEASATVSKTETSQVAPA

SEQ ID NO: 35 - RNA, 19 nt, Artificial Sequence
  MS2 stem loop
acaugaggauuacccaugu

SEQ ID NO: 36 - RNA, 18 nt, Artificial Sequence
  Qbeta stem loop
ugcaugucuaagacagca

SEQ ID NO: 37 - RNA, 20 nt, Artificial Sequence
  U1 hairpin II stem loop
aauccauugcacuccggauu

SEQ ID NO: 38 - RNA, 12 nt, Artificial Sequence
  Uvsx stem loop
ccucuucggagg

SEQ ID NO: 39 - RNA, 21 nt, Artificial Sequence
  PP7 stem loop
aggaguuucuauggaaacccu

SEQ ID NO: 40 - RNA, 30 nt, Artificial Sequence
  phage replication loop
aggugggacgaccucucggucguccuaucu

SEQ ID NO: 41 - RNA, 19 nt, Artificial Sequence
  kissing loop a
ugcucgcuccguucgagca

SEQ ID NO: 42 - RNA, 21 nt, Artificial Sequence
  kissing loop b1
ugcucgacgcguccucgagca

SEQ ID NO: 43 - RNA, 22 nt, Artificial Sequence
  kissing loop b2
ugcucguuugcggcuacgagca

SEQ ID NO: 44 - RNA, 17 nt, Artificial Sequence
  G quadriplex M3q
agggagggagggagagg

SEQ ID NO: 45 - RNA, 19 nt, Artificial Sequence
  G quadriplex telomere basket
gguuaggguuaggguuagg

SEQ ID NO: 46 - RNA, 25 nt, Artificial Sequence
  Sarcin-ricin loop
cugcucaguacgagaggaaccgcag

SEQ ID NO: 47 - RNA, 78 nt, Artificial Sequence
  pseudoknots
uacacugggaucgcugaauuagagaucggcguccuuucauucuauauacuuuggaguuuuaaaaugucucuaaguaca

SEQ ID NO: 48 - protein, 4 aa, Artificial Sequence
  CXXC zing finger/ribbon domain
  MISC_FEATURE (2)..(3): Xaa is any amino acid
CXXC

SEQ ID NO: 49 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 50 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLRSQEYKKYQTNKTTGNTDKRAFVETWQSFYRKKLKEVWKPAV

SEQ ID NO: 51 - protein, 985 aa, Artificial Sequence
  CasX variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 52 - protein, 986 aa, Artificial Sequence
  CasX variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 53 - protein, 921 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 54 - protein, 920 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 55 - protein, 977 aa, Artificial Sequence
  CasX variant
MQEIKRINKIRRRLVKDSNTKKAGKTGPMKTLLVRVMTPDLRERLENLRKKPENIPQPISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 56 - protein, 986 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57 - protein, 925 aa, Artificial Sequence
  CasX variant
MISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 58 - protein, 975 aa, Artificial Sequence
  CasX variant
MEKRINKIRKKLSADNATKPVSRSGPMKTLLVRVMTDDLKKRLEKRRKKPEVMPQVISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 59 - protein, 982 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 60 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 61 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPA

SEQ ID NO: 62 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 63 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDQLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 64 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFQAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 65 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLIAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 66 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 67 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 68 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 69 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 70 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEKEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 71 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 72 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 73 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 74 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 75 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 76 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGDPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 77 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEFLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 78 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 79 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 80 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 81 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIIIEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFNAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 82 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAKTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 83 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 84 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIMENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 85 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 86 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 87 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 88 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 89 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQVRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 90 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 91 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 92 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 93 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 94 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 95 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 96 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 97 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 98 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 99 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 100 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 101 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 102 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 103 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 104 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 105 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 106 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 107 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 108 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 109 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 110 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 111 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 112 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 113 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 114 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 115 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 116 - protein, 977 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 117 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 118 - protein, 977 aa, Artificial Sequence; identical to SEQ ID NO: 72
  CasX variant

SEQ ID NO: 119 - protein, 977 aa, Artificial Sequence; identical to SEQ ID NO: 72
  CasX variant

SEQ ID NO: 120 - protein, 977 aa, Artificial Sequence; identical to SEQ ID NO: 72
  CasX variant

SEQ ID NO: 121 - protein, 977 aa, Artificial Sequence; identical to SEQ ID NO: 72
  CasX variant

SEQ ID NO: 122 - protein, 977 aa, Artificial Sequence; identical to SEQ ID NO: 72
  CasX variant

SEQ ID NO: 123 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 124 - protein, 977 aa, Artificial Sequence; identical to SEQ ID NO: 72
  CasX variant

SEQ ID NO: 125 - protein, 977 aa, Artificial Sequence; identical to SEQ ID NO: 72
  CasX variant

SEQ ID NO: 126 - protein, 977 aa, Artificial Sequence; identical to SEQ ID NO: 72
  CasX variant

SEQ ID NO: 127 - protein, 977 aa, Artificial Sequence; identical to SEQ ID NO: 72
  CasX variant

SEQ ID NO: 128 - protein, 977 aa, Artificial Sequence; identical to SEQ ID NO: 72
  CasX variant

SEQ ID NO: 129 - protein, 977 aa, Artificial Sequence; identical to SEQ ID NO: 72
  CasX variant

SEQ ID NO: 130 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 131 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 132 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 133 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 134 - protein, 976 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 135 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 136 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 137 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 138 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 139 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 140 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLGVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 141 - protein, 986 aa, Artificial Sequence; identical to SEQ ID NO: 56
  CasX variant

SEQ ID NO: 142 - protein, 978 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 143 - protein, 972 aa, Artificial Sequence
  CasX variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 144 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 145 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 146 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 147 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 148 - protein, 979 aa, Artificial Sequence
  CasX variant
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 149 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 150 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTTQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 151 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKRSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 152 - protein, 977 aa, Artificial Sequence
  CasX variant
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 153 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 154 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAATQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 155 - protein, 977 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 156 - protein, 978 aa, Artificial Sequence
  CasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 157 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 158 - protein, 978 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 159 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 160 - protein, 979 aa, Artificial Sequence
  CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 161 - protein, 84 aa, Artificial Sequence
  chloroplast transit peptide
MASMISSSAVTTVSRASRGQSAAMAPFGGLKSMTGFPVRKVNTDITSITSNGGRVKCMQVWPPIGKKKFETLSYLPPLTRDSRA

SEQ ID NO: 162 - protein, 57 aa, Artificial Sequence
  chloroplast transit peptide
MASMISSSAVTTVSRASRGQSAAMAPFGGLKSMTGFPVRKVNTDITSITSNGGRVKS

SEQ ID NO: 163 - protein, 85 aa, Artificial Sequence
  chloroplast transit peptide
MASSMLSSATMVASPAQATMVAPFNGLKSSAAFPATRKANNDITSITSNGGRVNCMQVWPPIEKKKFETLSYLPDLTDSGGRVNC

SEQ ID NO: 164 - protein, 76 aa, Artificial Sequence
  chloroplast transit peptide
MAQVSRICNGVQNPSLISNLSKSSQRKSPLSVSLKTQQHPRAYPISSSWGLKKSGMTLIGSELRPLKVMSSVSTAC

SEQ ID NO: 165 - protein, 76 aa, Artificial Sequence
  chloroplast transit peptide
MAQVSRICNGVWNPSLISNLSKSSQRKSPLSVSLKTQQHPRAYPISSSWGLKKSGMTLIGSELRPLKVMSSVSTAC

SEQ ID NO: 166 - protein, 72 aa, Artificial Sequence
  chloroplast transit peptide
MAQINNMAQGIQTLNPNSNFHKPQVPKSSSFLVFGSKKLKNSANSMLVLKKDSIFMQLFCSFRISASVATAC

SEQ ID NO: 167 - protein, 69 aa, Artificial Sequence
  chloroplast transit peptide
MAALVTSQLATSGTVLSVTDRFRRPGFQGLRPRNPADAALGMRTVGASAAPKQSRKPHRFDRRCLSMVV

SEQ ID NO: 168 - protein, 77 aa, Artificial Sequence
  chloroplast transit peptide
MAALTTSQLATSATGFGIADRSAPSSLLRHGFQGLKPRSPAGGDATSLSVTTSARATPKQQRSVQRGSRRFPSVVVC

SEQ ID NO: 169 - protein, 57 aa, Artificial Sequence
  chloroplast transit peptide
MASSVLSSAAVATRSNVAQANMVAPFTGLKSAASFPVSRKQNLDITSIASNGGRVQC

SEQ ID NO: 170 - protein, 65 aa, Artificial Sequence
  chloroplast transit peptide
MESLAATSVFAPSRVAVPAARALVRAGTVVPTRRTSSTSGTSGVKCSAAVTPQASPVISRSAAAA

SEQ ID NO: 171 - protein, 72 aa, Artificial Sequence
  chloroplast transit peptide
MGAAATSMQSLKFSNRLVPPSRRLSPVPNNVTCNNLPKSAAPVRTVKCCASSWNSTINGAAATTNGASAASS

SEQ ID NO: 172 - protein, 20 aa, Artificial Sequence
  endosomal escape peptide
  MISC_FEATURE (4)..(4): Xaa is Lys, His or Arg
  MISC_FEATURE (8)..(8): Xaa is Lys, His or Arg
  MISC_FEATURE (11)..(11): Xaa is Lys, His or Arg
  MISC_FEATURE (15)..(15): Xaa is Lys, His or Arg
  MISC_FEATURE (19)..(19): Xaa is Lys, His or Arg
GLFXALLXLLXSLWXLLLXA

SEQ ID NO: 173 - protein, 20 aa, Artificial Sequence
  endosomal escape peptide
GLFHALLHLLHSLWHLLLHA

SEQ ID NO: 174 - protein, 9 aa, Artificial Sequence
  endosomal escape peptide
HHHHHHHHH

SEQ ID NO: 175 - skipped

SEQ ID NO: 176 - protein, 7 aa, Artificial Sequence
  nuclear localization signal
PKKKRKV

SEQ ID NO: 177 - protein, 16 aa, Artificial Sequence
  nuclear localization signal
KRPAATKKAGQAKKKK

SEQ ID NO: 178 - protein, 9 aa, Artificial Sequence
  nuclear localization signal
PAAKRVKLD

SEQ ID NO: 179 - protein, 11 aa, Artificial Sequence
  nuclear localization signal
RQRRNELKRSP

SEQ ID NO: 180 - protein, 38 aa, Artificial Sequence
  nuclear localization signal
NQSSNFGPMKGGNFGGRSSGPYGGGGQYFAKPRNQGGY

SEQ ID NO: 181 - protein, 42 aa, Artificial Sequence
  nuclear localization signal
RMRIZFKNKGKDTAELRRRRVEVSVELRKAKKDEQILKRRNV

SEQ ID NO: 182 - protein, 8 aa, Artificial Sequence
  nuclear localization signal
VSRKRPRP

SEQ ID NO: 183 - protein, 8 aa, Artificial Sequence
  nuclear localization signal
PPKKARED

SEQ ID NO: 184 - protein, 8 aa, Artificial Sequence
  nuclear localization signal
PQPKKKPL

SEQ ID NO: 185 - protein, 12 aa, Artificial Sequence
  nuclear localization signal
SALIKKKKKMAP

SEQ ID NO: 186 - protein, 5 aa, Artificial Sequence
  nuclear localization signal
DRLRR

SEQ ID NO: 187 - protein, 7 aa, Artificial Sequence
  nuclear localization signal
PKQKKRK

SEQ ID NO: 188 - protein, 9 aa, Artificial Sequence
  nuclear localization signal
RKLKKKIKK

SEQ ID NO: 189 - protein, 10 aa, Artificial Sequence
  nuclear localization signal
REKKKFLKRR

SEQ ID NO: 190 - protein, 20 aa, Artificial Sequence
  nuclear localization signal
KRKGDEVDGVDEVAKKKSKK

SEQ ID NO: 191 - protein, 17 aa, Artificial Sequence
  nuclear localization signal
RKCLQAGMNLEARKTKK

SEQ ID NO: 192 - protein, 8 aa, Artificial Sequence
  nuclear localization signal
PRPRKIPR

SEQ ID NO: 193 - protein, 9 aa, Artificial Sequence
  nuclear localization signal
PPRKKRTVV

SEQ ID NO: 194 - protein, 12 aa, Artificial Sequence
  nuclear localization signal
NLSKKKKRKREK

SEQ ID NO: 195 - protein, 10 aa, Artificial Sequence
  nuclear localization signal
RRPSRPFRKP

SEQ ID NO: 196 - protein, 8 aa, Artificial Sequence
  nuclear localization signal
KRPRSPSS

SEQ ID NO: 197 - protein, 19 aa, Artificial Sequence
  nuclear localization signal
KRGINDRNFWRGENERKTR

SEQ ID NO: 198 - protein, 11 aa, Artificial Sequence
  nuclear localization signal
PRPPKMARYDN

SEQ ID NO: 199 - protein, 8 aa, Artificial Sequence
  nuclear localization signal
KRSFSKAF

SEQ ID NO: 200 - protein, 9 aa, Artificial Sequence
  nuclear localization signal
KLKIKRPVK

SEQ ID NO: 201 - protein, 19 aa, Artificial Sequence
  nuclear localization signal
PKKKRKVPPPPAAKRVKLD

SEQ ID NO: 202 - protein, 17 aa, Artificial Sequence
  nuclear localization signal
PKTRRRPRRSQRKRPPT

SEQ ID NO: 203 - protein, 25 aa, Artificial Sequence
  nuclear localization signal
MSRRRKANPTKLSENAKKLAKEVEN

SEQ ID NO: 204 - protein, 16 aa, Artificial Sequence
  nuclear localization signal
KTRRRPRRSQRKRPPT

SEQ ID NO: 205 - protein, 13 aa, Artificial Sequence
  nuclear localization signal
RRKKRRPRRKKRR

SEQ ID NO: 206 - protein, 14 aa, Artificial Sequence
  nuclear localization signal
PKKKSRKPKKKSRK

SEQ ID NO: 207 - protein, 17 aa, Artificial Sequence
  nuclear localization signal
HKKKHPDASVNFSEFSK

SEQ ID NO: 208 - protein, 18 aa, Artificial Sequence
  nuclear localization signal
QRPGPYDRPQRPGPYDRP

SEQ ID NO: 209 - protein, 16 aa, Artificial Sequence
  nuclear localization signal
LSPSLSPLLSPSLSPL

SEQ ID NO: 210 - protein, 18 aa, Artificial Sequence
  nuclear localization signal
RGKGGKGLGKGGAKRHRK

SEQ ID NO: 211 - protein, 14 aa, Artificial Sequence
  nuclear localization signal
PKRGRGRPKRGRGR

SEQ ID NO: 212 - protein, 19 aa, Artificial Sequence
  nuclear localization signal
PKKKRKVPPPPAAKRVKLD

SEQ ID NO: 213 - protein, 17 aa, Artificial Sequence
  nuclear localization signal
PKKKRKVPPPPKKKRKV

SEQ ID NO: 214 - protein, 11 aa, Artificial Sequence
  peptide transduction domain
YGRKKRRQRRR

SEQ ID NO: 215 - protein, 8 aa, Artificial Sequence
  peptide transduction domain
RKKRRQRR

SEQ ID NO: 216 - protein, 11 aa, Artificial Sequence
  peptide transduction domain
YARAAARQARA

SEQ ID NO: 217 - protein, 11 aa, Artificial Sequence
  peptide transduction domain
THRLPRRRRRR

SEQ ID NO: 218 - protein, 11 aa, Artificial Sequence
  peptide transduction domain
GGRRARRRRRR

SEQ ID NO: 219 - protein, 50 aa, Artificial Sequence
  peptide transduction domain
  MISC_FEATURE (4)..(50): These individual amino acid residues may be present or absent
RRRRRRRRRRRRRRRRRRRRRRRRRRRRRRRRRRRRRRRRRRRRRRRRRR

SEQ ID NO: 220 - protein, 12 aa, Artificial Sequence
  peptide transduction domain
RRQRRTSKLMKR

SEQ ID NO: 221 - protein, 27 aa, Artificial Sequence
  peptide transduction domain
GWTLNSAGYLLGKINLKALAALAKKIL

SEQ ID NO: 222 - protein, 33 aa, Artificial Sequence
  peptide transduction domain
KALAWEAKLAKALAKALAKHLAKALAKALKCEA

SEQ ID NO: 223 - protein, 16 aa, Artificial Sequence
  peptide transduction domain
RQIKIWFQNRRMKWKK

SEQ ID NO: 224 - protein, 5 aa, Artificial Sequence
  linker
GSGGS

SEQ ID NO: 225 - protein, 6 aa, Artificial Sequence
  linker
GGSGGS

SEQ ID NO: 226 - protein, 4 aa, Artificial Sequence
  linker
GGGS

SEQ ID NO: 227 - protein, 4 aa, Artificial Sequence
  linker
GGSG

SEQ ID NO: 228 - protein, 5 aa, Artificial Sequence
  linker
GGSGG

SEQ ID NO: 229 - protein, 5 aa, Artificial Sequence
  linker
GSGSG

SEQ ID NO: 230 - protein, 5 aa, Artificial Sequence
  linker
GSGGG

SEQ ID NO: 231 - protein, 5 aa, Artificial Sequence
  linker
GGGSG

SEQ ID NO: 232 - protein, 5 aa, Artificial Sequence
  linker
GSSSG

SEQ ID NO: 233 - protein, 4 aa, Artificial Sequence
  linker
GPGP

SEQ ID NO: 234 - protein, 6 aa, Artificial Sequence
  linker
PPAPPA

SEQ ID NO: 235 - protein, 7 aa, Artificial Sequence
  linker
PPPGPPP

SEQ ID NO: 236 - DNA, 3120 bp, Artificial Sequence
  SV40 NLS-CasX-SV40 NLS-TEV cleavage site-TwinStrep tag
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcttccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcagccaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgccgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaaaaaactgaaagaggtctggaaaccggcggtagcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 237 - protein, 976 aa, Artificial Sequence; identical to SEQ ID NO: 117
  CasX Variant

SEQ ID NO: 238 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 239 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 240 - DNA, 3123 bp, Artificial Sequence
  CasX Variant
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 241 - DNA, 3123 bp, Artificial Sequence
  CasX Variant
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcataagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcaccagaagatcgcaaaaaaggcaagaagtttgctcgctatcagttgggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaccgctctacaaccgccgcacccgccaggatgagccggcactgtttgtcgcgctgacctttgaacggcgtgaagtcctcgatagcagcaacatcaaaccaatgaaccttatcggtgttgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgtcgtaagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 242 - DNA, 3123 bp, Artificial Sequence
  CasX Variant
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcagaagaagatcgcaaaaaaggcaagaagtttgctcgctatcagttgggcgatttattaaagcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtgttgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgtcgtaagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 243 - protein, 977 aa, Artificial Sequence; identical to SEQ ID NO: 135
  CasX Variant

SEQ ID NO: 244 - protein, 977 aa, Artificial Sequence; identical to SEQ ID NO: 138
  CasX Variant

SEQ ID NO: 245 - protein, 978 aa, Artificial Sequence; identical to SEQ ID NO: 145
  CasX Variant

SEQ ID NO: 246 - protein, 978 aa, Artificial Sequence; identical to SEQ ID NO: 156
  CasX Variant

SEQ ID NO: 247 - DNA, 2931 bp, Artificial Sequence
  CasX Variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 248 - DNA, 2931 bp, Artificial Sequence
  CasX Variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 249 - DNA, 2934 bp, Artificial Sequence
  CasX Variant
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgcccagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 250 - DNA, 2934 bp, Artificial Sequence
  CasX Variant
caagagatcaagagaatcaacaagatcagaaggagactggtcaaggacagcaacacaaagaaggccggcaagacacggggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 251 - protein, 987 aa, Artificial Sequence
  CasX Variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 252 - protein, 986 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 253 - protein, 996 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 254 - protein, 1006 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPHKKKHPDASVNFSEFSK

SEQ ID NO: 255 - protein, 1007 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPQRPGPYDRPQRPGPYDRP

SEQ ID NO: 256 - protein, 1005 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPLSPSLSPLLSPSLSPL

SEQ ID NO: 257 - protein, 1008 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPRGKGGKGLGKGGAKRHRK

SEQ ID NO: 258 - protein, 1013 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPSRRRKANPTKLSENAKKLAKEVEN

SEQ ID NO: 259 - protein, 998 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 260 - protein, 997 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRSFSKAF

SEQ ID NO: 261 - protein, 1008 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRGINDRNFWRGENERKTR

SEQ ID NO: 262 - protein, 1007 aa, Artificial Sequence
  CasX Variant
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 263 - protein, 1009 aa, Artificial Sequence
  CasX Variant
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 264 - DNA, 21 bp, Artificial Sequence
  nuclear localization signal
ccaaagaagaagcggaaggtc

SEQ ID NO: 265 - DNA, 51 bp, Artificial Sequence
  nuclear localization signal
cacaagaagaaacatccagacgcatcagtcaactttagcgagttcagtaaa

SEQ ID NO: 266 - DNA, 54 bp, Artificial Sequence
  nuclear localization signal
cagcgccctgggccttacgataggccgcaaagacccggaccgtatgatcgccct

SEQ ID NO: 267 - DNA, 48 bp, Artificial Sequence
  nuclear localization signal
ctcagcccgagtcttagtccactgctttccccgtccctgtctccactg

SEQ ID NO: 268 - DNA, 54 bp, Artificial Sequence
  nuclear localization signal
cggggcaagggtggcaaggggcttggcaaggggggggcaaagaggcacaggaag

SEQ ID NO: 269 - DNA, 72 bp, Artificial Sequence
  nuclear localization signal
agccgccgcagaaaagccaatcctacaaaactgtcagaaaatgcgaaaaaacttgctaaggaggtggaaaac

SEQ ID NO: 270 - DNA, 27 bp, Artificial Sequence
  nuclear localization signal
cctgccgcaaagcgagtgaaattggac

SEQ ID NO: 271 - DNA, 24 bp, Artificial Sequence
  nuclear localization signal
aagcggtccttcagtaaggccttt

SEQ ID NO: 272 - DNA, 57 bp, Artificial Sequence
  nuclear localization signal
aaacggggaataaacgaccggaacttctggcgcggggaaaacgagcgcaaaacccga

SEQ ID NO: 273 - protein, 997 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 274 - protein, 1005 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVTSPKKKRKV

SEQ ID NO: 275 - protein, 996 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 276 - protein, 996 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 277 - protein, 996 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 278 - protein, 997 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 279 - protein, 997 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 280 - protein, 997 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 281 - protein, 997 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 282 - protein, 997 aa, Artificial Sequence
  CasX variant
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 283 - DNA, 2991 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 284 - DNA, 2988 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 285 - DNA, 2988 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 286 - DNA, 2988 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 287 - DNA, 2988 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 288 - DNA, 2991 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 289 - DNA, 2991 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 290 - DNA, 2991 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 291 - DNA, 2991 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 292 - DNA, 2991 bp, Artificial Sequence
  CasX variant
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 293 - DNA, 22 bp, Artificial Sequence
  T7 promoter primer
gaaattaatacgactcactata

SEQ ID NO: 294 - DNA, 87 bp, Artificial Sequence
  sg2 backbone fwd
gaaattaatacgactcactataggtactggcgcttttatctcattactttgagagccatcaccagcgactatgtcgtatgggtaaag

SEQ ID NO: 295 - DNA, 78 bp, Artificial Sequence
  sg2 backbone rev
ctttgatgcttcttatttatcggatttctctccgataaataagcgctttacccatacgacatagtcgctggtgatggc

SEQ ID NO: 296 - DNA, 54 bp, Artificial Sequence
  sg2.7.37 spacer primer
cggagcgagacatctcggccctttgatgcttcttatttatcggatttctctccg

SEQ ID NO: 297 - DNA, 90 bp, Artificial Sequence
  sg32 backbone fwd
gaaattaatacgactcactataggtactggcgcttttatctcattactttgagagccatcaccagcgactatgtcgtatgggtaaagcgc

SEQ ID NO: 298 - DNA, 46 bp, Artificial Sequence
  sg32 backbone rev
ctttgatgcttccctccgaagagggcgctttacccatacgacatag

SEQ ID NO: 299 - DNA, 43 bp, Artificial Sequence
  sg32.7.37 spacer primer
cggagcgagacatctcggccctttgatgcttccctccgaagag

SEQ ID NO: 300 - DNA, 90 bp, Artificial Sequence
  sg64 backbone fwd
gaaattaatacgactcactataggtactggcgcctttatctcattactttgagagccatcaccagcgactatgtcgtatgggtaaagcgc

SEQ ID NO: 301 - DNA, 54 bp, Artificial Sequence
  sg64 backbone rev
ctttgatgcttcttacggaccgaagtccgtaagcgctttacccatacgacatag

SEQ ID NO: 302 - DNA, 45 bp, Artificial Sequence
  sg64.7.37 spacer primer
cggagcgagacatctcggccctttgatgcttcttacggaccgaag

SEQ ID NO: 303 - DNA, 87 bp, Artificial Sequence
  sg174 backbone fwd
gaaattaatacgactcactataactggcgcttttatctgattactttgagagccatcaccagcgactatgtcgtagtgggtaaagct

SEQ ID NO: 304 - DNA, 50 bp, Artificial Sequence
  sg174 backbone rev
ctttgatgctccctccgaagagggagctttacccactacgacatagtcgc

SEQ ID NO: 305 - DNA, 36 bp, Artificial Sequence
  sg174.7.37 spacer primer
cggagcgagacatctcggccctttgatgctccctcc

SEQ ID NO: 306 - RNA, 130 nt, Artificial Sequence
  gRNA sequence
gguacuggcgcuuuuaucucauuacuuugagagccaucaccagcgacuaugucguauggguaaagcgcuuauuuaucggagagaaauccgauaaauaagaagcaucaaagggccgagaugucucgcuccg

SEQ ID NO: 307 - RNA, 107 nt, Artificial Sequence
  gRNA sequence
gguacuggcgcuuuuaucucauuacuuugagagccaucaccagcgacuaugucguauggguaaagcgcccucuucggagggaagcaucaaagggccgagaugucucg

SEQ ID NO: 308 - RNA, 119 nt, Artificial Sequence
  gRNA sequence
guacuggcgccuuuaucucauuacuuugagagccaucaccagcgacuaugucguauggguaaagcgcuuacggacuucgguccguaagaagcaucaaagggccgagaugucucgcuccg

SEQ ID NO: 309 - RNA, 109 nt, Artificial Sequence
  gRNA sequence
acuggcgcuuuuaucugauuacuuugagagccaucaccagcgacuaugucguaguggguaaagcucccucuucggagggagcaucaaagggccgagaugucucgcuccg

SEQ ID NO: 310 - DNA, 60 bp, Artificial Sequence
  gRNA target oligo
tgaagctgacagcattcgggccgagatgtctcgctccgtggccttagctgtgctcgcgct

SEQ ID NO: 311 - DNA, 60 bp, Artificial Sequence; identical to SEQ ID NO: 310
  gRNA target oligo

SEQ ID NO: 312 - DNA, 89 bp, Artificial Sequence
  HDV antigenomic ribozyme
gggtcggcatggcatctccacctcctcgcggtccgacctgggcatccgaaggaggacgcacgtccactcggatggctaagggagagcca

SEQ ID NO: 313 - DNA, 86 bp, Artificial Sequence
  HDV genomic ribozyme
ggccggcatggtcccagcctcctcgctggcgccggctgggcaacattccgaggggaccgtcccctcggtaatggcgaatgggaccc

SEQ ID NO: 314 - DNA, 69 bp, Artificial Sequence
  HDV ribozyme
gatggccggcatggtcccagcctcctcgctggcgccggctgggcaacaccttcgggtggcgaatgggac

SEQ ID NO: 315 - DNA, 78 bp, Artificial Sequence
  HDV ribozyme
ttttggccggcatggtcccagcctcctcgctggcgccggctgggcaacatgcttcggcatggcgaatgggaccccggg

SEQ ID NO: 316 - DNA, 78 bp, Artificial Sequence
  Hatchet
cattcctcagaaaatgacaaacctgtggggcgtaagtagatcttcggatctatgatcgtgcagacgttaaaatcaggt

SEQ ID NO: 317 - DNA, 64 bp, Artificial Sequence
  env25 pistol ribozyme (with CUUCGG loop)
cgtggttagggccacgttaaatagttgcttaagccctaagcgttgatcttcggatcaggtgcaa

SEQ ID NO: 318 - DNA, 60 bp, Artificial Sequence
  HH15 Minimal Hammerhead ribozyme
gggagccccgctgatgaggtcggggagaccgaaagggacttcggtccctacggggctccc

SEQ ID NO: 319 - DNA, 52 bp, Artificial Sequence
  sTRSV WT viral Hammerhead ribozyme
cctgtcaccggatgtgctttccggtctgatgagtccgtgaggacgaaacagg

SEQ ID NO: 320 - DNA, 63 bp, Artificial Sequence
  Hammerhead ribozyme
cgactactgatgagtccgtgaggacgaaacgagtaagctcgtctagtcgcgtgtagcgaagca

SEQ ID NO: 321 - DNA, 49 bp, Artificial Sequence
  Hammerhead ribozyme, smaller scar
cgactactgatgagtccgtgaggacgaaacgagtaagctcgtctagtcg

SEQ ID NO: 322 - DNA, 63 bp, Artificial Sequence
  Hammerhead ribozyme, guide scaffold scar
ccagtactgatgagtccgtgaggacgaaacgagtaagctcgtctactggcgcttttatctcat

SEQ ID NO: 323 - DNA, 77 bp, Artificial Sequence
  Twisted Sister 1
acccgcaaggccgacggcatccgccgccgctggtgcaagtccagccgccccttcgggggcgggcgctcatgggtaac

SEQ ID NO: 324 - DNA, 76 bp, Artificial Sequence
  Env-9 Twister
ggcaataaagcggttacaagcccgcaaaaatagcagagtaatgtcgcgatagcgcggcattaatgcagctttattg

SEQ ID NO: 325 - DNA, 36 bp, Artificial Sequence
  RBMX recruiting motif
ccacccccaccaccacccccacccccaccaccaccc

SEQ ID NO: 326-327 - skipped (2 entries)

SEQ ID NO: 328 - DNA, 19 bp, Artificial Sequence
  spacer sequence
agcattcttgggtgggagc

SEQ ID NO: 329 - DNA, 19 bp, Artificial Sequence
  spacer sequence
gggtgggagcagccacggg

SEQ ID NO: 330 - DNA, 19 bp, Artificial Sequence
  spacer sequence
ggctgtggcccttgtggct

SEQ ID NO: 331 - DNA, 20 bp, Artificial Sequence
  spacer sequence
gtgccattcatggctgtggc

SEQ ID NO: 332 - DNA, 19 bp, Artificial Sequence
  spacer sequence
cgtgcccttctccaatgcg

SEQ ID NO: 333 - DNA, 19 bp, Artificial Sequence
  spacer sequence
caatgcgacgggtgtggta

SEQ ID NO: 334 - DNA, 19 bp, Artificial Sequence
  spacer sequence
gtacccacagtactacctg

SEQ ID NO: 335 - DNA, 19 bp, Artificial Sequence
  spacer sequence
catgctggccgcctacatg

SEQ ID NO: 336 - DNA, 19 bp, Artificial Sequence
  spacer sequence
ctgatcgtgctgggcttcc

SEQ ID NO: 337 - DNA, 19 bp, Artificial Sequence
  spacer sequence
catcaacttcctcacgctc

SEQ ID NO: 338 - DNA, 19 bp, Artificial Sequence
  spacer sequence
cacgctctacgtcaccgtc

SEQ ID NO: 339 - DNA, 19 bp, Artificial Sequence
  spacer sequence
gtgctggacggtgacgtag

SEQ ID NO: 340 - DNA, 19 bp, Artificial Sequence
  spacer sequence
ggtcctaggtggcttcacc

SEQ ID NO: 341 - DNA, 19 bp, Artificial Sequence
  spacer sequence
cagcaccctctacacctct

SEQ ID NO: 342 - DNA, 19 bp, Artificial Sequence
  spacer sequence
cttcgggcccacaggatgc

SEQ ID NO: 343 - DNA, 19 bp, Artificial Sequence
  spacer sequence
gcccacaggatgcaatttg

SEQ ID NO: 344 - DNA, 19 bp, Artificial Sequence
  spacer sequence
tgccaccctgggcggtatg

SEQ ID NO: 345 - DNA, 20 bp, Artificial Sequence
  spacer sequence
aaggggctgcgtaccacacc

SEQ ID NO: 346 - DNA, 21 bp, Artificial Sequence
  spacer sequence
aagtgggctgcgtaccacacc

SEQ ID NO: 347 - DNA, 89 bp, Artificial Sequence
  CasX variant scaffold
actggcgcttttatctgattactttgagagccatcaccagcgactatgtcgtagtgggtaaagctccctcttcggagggagcatcaaag

SEQ ID NO: 348 - DNA, 109 bp, Artificial Sequence
  CasX gRNA
actggcgcttttatctgattactttgagagccatcaccagcgactatgtcgtagtgggtaaagctccctcttcggagggagcatcaaagcagcattcttgggtgggagc

SEQ ID NO: 349 - DNA, 109 bp, Artificial Sequence
  CasX gRNA
actggcgcttttatctgattactttgagagccatcaccagcgactatgtcgtagtgggtaaagctccctcttcggagggagcatcaaagtgggtgggagcagccacggg

SEQ ID NO: 350 - DNA, 109 bp, Artificial Sequence
  CasX gRNA
actggcgcttttatctgattactttgagagccatcaccagcgactatgtcgtagtgggtaaagctccctcttcggagggagcatcaaagtggctgtggcccttgtggct

SEQ ID NO: 351 - DNA, 109 bp, Artificial Sequence
  CasX gRNA
actggcgcttttatctgattactttgagagccatcaccagcgactatgtcgtagtgggtaaagctccctcttcggagggagcatcaaaggtgccattcatggctgtggc

SEQ ID NO: 352 - DNA, 109 bp, Artificial Sequence
  CasX gRNA
actggcgcttttatctgattactttgagagccatcaccagcgactatgtcgtagtgggtaaagctccctcttcggagggagcatcaaagacgtgcccttctccaatgcg

SEQ ID NO: 353 - DNA, 109 bp, Artificial Sequence
  CasX gRNA
actggcgcttttatctgattactttgagagccatcaccagcgactatgtcgtagtgggtaaagctccctcttcggagggagcatcaaagccaatgcgacgggtgtggta

SEQ ID NO: 354 - DNA, 109 bp, Artificial Sequence
  CasX gRNA
actggcgcttttatctgattactttgagagccatcaccagcgactatgtcgtagtgggtaaagctccctcttcggagggagcatcaaagagtacccacagtactacctg

SEQ ID NO: 355 - DNA, 109 bp, Artificial Sequence
  CasX gRNA
actggcgcttttatctgattactttgagagccatcaccagcgactatgtcgtagtgggtaaagctccctcttcggagggagcatcaaagccatgctggccgcctacatg

SEQ ID NO: 356 - DNA, 109 bp, Artificial Sequence
  CasX gRNA
actggcgcttttatctgattactttgagagccatcaccagcgactatgtcgtagtgggtaaagctccctcttcggagggagcatcaaaggctgatcgtgctgggcttcc

SEQ ID NO: 357 - DNA, 109 bp, Artificial Sequence
  CasX gRNA
actggcgcttttatctgattactttgagagccatcaccagcgactatgtcgtagtgggtaaagctccctcttcggagggagcatcaaagccatcaacttcctcacgctc

SEQ ID NO: 358 - DNA, 109 bp, Artificial Sequence
  CasX gRNA
actggcgcttttatctgattactttgagagccatcaccagcgactatgtcgtagtgggtaaagctccctcttcggagggagcatcaaagtcacgctctacgtcaccgtc

SEQ ID NO: 359 - DNA, 109 bp, Artificial Sequence
  CasX gRNA
actggcgcttttatctgattactttgagagccatcaccagcgactatgtcgtagtgggtaaagctccctcttcggagggagcatcaaagtgtgctggacggtgacgtag

SEQ ID NO: 360 - DNA, 109 bp, Artificial Sequence
  CasX gRNA
actggcgcttttatctgattactttgagagccatcaccagcgactatgtcgtagtgggtaaagctccctcttcggagggagcatcaaagtggtcctaggtggcttcacc

SEQ ID NO: 361 - DNA, 109 bp, Artificial Sequence
  CasX gRNA
actggcgcttttatctgattactttgagagccatcaccagcgactatgtcgtagtgggtaaagctccctcttcggagggagcatcaaagccagcaccctctacacctct

SEQ ID NO: 362 - DNA, 109 bp, Artificial Sequence
  CasX gRNA
actggcgcttttatctgattactttgagagccatcaccagcgactatgtcgtagtgggtaaagctccctcttcggagggagcatcaaagtcttcgggcccacaggatgc

SEQ ID NO: 363 - DNA, 109 bp, Artificial Sequence
  CasX gRNA
actggcgcttttatctgattactttgagagccatcaccagcgactatgtcgtagtgggtaaagctccctcttcggagggagcatcaaagggcccacaggatgcaatttg

SEQ ID NO: 364 - DNA, 109 bp, Artificial Sequence
  CasX gRNA
actggcgcttttatctgattactttgagagccatcaccagcgactatgtcgtagtgggtaaagctccctcttcggagggagcatcaaagttgccaccctgggcggtatg

SEQ ID NO: 365 - DNA, 109 bp, Artificial Sequence
  CasX gRNA
actggcgcttttatctgattactttgagagccatcaccagcgactatgtcgtagtgggtaaagctccctcttcggagggagcatcaaagaaggggctgcgtaccacacc

SEQ ID NO: 366 - DNA, 110 bp, Artificial Sequence
  CasX gRNA
actggcgcttttatctgattactttgagagccatcaccagcgactatgtcgtagtgggtaaagctccctcttcggagggagcatcaaagaagtgggctgcgtaccacacc

SEQ ID NO: 367 - DNA, 20 bp, Artificial Sequence
  spacer sequence
aaggggctgcgtaccacacc

SEQ ID NO: 368 - DNA, 20 bp, Artificial Sequence
  spacer sequence
aagtggctgcgtaccacacc

SEQ ID NO: 369 - DNA, 20 bp, Artificial Sequence
  spacer sequence
aagtggctgccctccacaga

SEQ ID NO: 370 - DNA, 20 bp, Artificial Sequence
  spacer sequence
aagtggctgcattctacacc

SEQ ID NO: 371 - DNA, 20 bp, Artificial Sequence
  spacer sequence
aagtggctatgaacaacagc

SEQ ID NO: 372 - DNA, 20 bp, Artificial Sequence
  spacer sequence
aagtggctgccagccacccc

SEQ ID NO: 373 - DNA, 20 bp, Artificial Sequence
  spacer sequence
aagtggctgctgacagcact

SEQ ID NO: 374 - DNA, 20 bp, Artificial Sequence
  spacer sequence
aagtggctgcctccctcagt

SEQ ID NO: 375 - DNA, 20 bp, Artificial Sequence
  spacer sequence
aagtggctgtgaaccatggc

SEQ ID NO: 376 - DNA, 20 bp, Artificial Sequence
  spacer sequence
aagtggctgcttatctaagc

SEQ ID NO: 377 - DNA, 20 bp, Artificial Sequence
  spacer sequence
aaggggctccgcaccacgcc

SEQ ID NO: 378 - DNA, 62 bp, Artificial Sequence
  mouse Rho primer
  misc_feature (34)..(40): n is any nucleotide
acactctttccctacacgacgctcttccgatctnnnnnnngcagccttggtctctgtctacg

SEQ ID NO: 379 - DNA, 57 bp, Artificial Sequence
  mouse Rho primer
gtgactggagttcagacgtgtgctcttccgatctgccccagtctctctgctcatacc

SEQ ID NO: 380 - DNA, 20 bp, Artificial Sequence
  spacer sequence
aagtggctccgcaccacgcc

SEQ ID NO: 381 - RNA, 31 nt, Artificial Sequence
  tracrRNA stem loop
  misc_feature (4)..(28): n is any ribonucleotide
  misc_feature (8)..(28): These individual nucleotides may be absent
uuunnnnnnnnnnnnnnnnnnnnnnnnnuuu

SEQ ID NO: 382 - RNA, 20 nt, Artificial Sequence
  spacer targeting mutant Rho
aaguggcugcguaccacacc

SEQ ID NO: 383 - RNA, 20 nt, Artificial Sequence
  spacer targeting mutant Rho
uaggcaggucuuaggccagg

SEQ ID NO: 384 - RNA, 20 nt, Artificial Sequence
  spacer targeting mutant Rho
uaggccagggccaccuggcu

SEQ ID NO: 385 - RNA, 20 nt, Artificial Sequence
  spacer targeting mutant Rho
uaggccgaggccaccuggcu

SEQ ID NO: 386 - RNA, 20 nt, Artificial Sequence
  spacer targeting mutant Rho
gccuaagaccugccuaggac

SEQ ID NO: 387 - RNA, 20 nt, Artificial Sequence
  spacer targeting mutant Rho
acuuccucaggcucuacguc

SEQ ID NO: 388 - RNA, 20 nt, Artificial Sequence
  spacer targeting mutant Rho
ggcucuacgucaccguccag

SEQ ID NO: 389 - RNA, 20 nt, Artificial Sequence
  spacer targeting mutant Rho
ccaucaacuuccucaggcuc

SEQ ID NO: 390 - RNA, 20 nt, Artificial Sequence
  spacer targeting mutant Rho
ucaggcucuacgucaccguc

SEQ ID NO: 391 - RNA, 20 nt, Artificial Sequence
  spacer targeting mutant Rho
ccaaugcgauggguguggua

SEQ ID NO: 392 - RNA, 20 nt, Artificial Sequence
  spacer targeting mutant Rho
aaugcgaugggugugguacg

SEQ ID NO: 393 - RNA, 20 nt, Artificial Sequence
  spacer targeting mutant Rho
gcagaagcauguaggcggcc

SEQ ID NO: 394 - RNA, 20 nt, Artificial Sequence
  spacer targeting mutant Rho
uggaccuagguggcuucacc

SEQ ID NO: 395 - RNA, 20 nt, Artificial Sequence
  spacer targeting mutant Rho
ucauggaccuagguggcuuc

SEQ ID NO: 396 - RNA, 20 nt, Artificial Sequence
  spacer targeting mutant Rho
augaagaggucagccacggc

SEQ ID NO: 397 - RNA, 20 nt, Artificial Sequence
  spacer targeting mutant Rho
ucaugguccuagauggcuuc

SEQ ID NO: 398 - RNA, 20 nt, Artificial Sequence
  spacer targeting mutant Rho
uagauggcuucaccagcacc

SEQ ID NO: 399 - RNA, 20 nt, Artificial Sequence
  spacer targeting mutant Rho
ugguccuagauggcuucacc

SEQ ID NO: 400 - RNA, 20 nt, Artificial Sequence
  spacer targeting mutant Rho
aggaccaugaagaggucagc

SEQ ID NO: 401 - RNA, 20 nt, Artificial Sequence
  spacer targeting mutant Rho
ucuucuggcccacaggaugc

SEQ ID NO: 402 - RNA, 20 nt, Artificial Sequence
  spacer targeting mutant Rho
ugugggccagaagacgaagu

SEQ ID NO: 403 - RNA, 20 nt, Artificial Sequence
  spacer targeting mutant Rho
ucuggcccacaggaugcaau

SEQ ID NO: 404 - RNA, 20 nt, Artificial Sequence
  spacer targeting mutant Rho
uguggaaucaacuacuacac

SEQ ID NO: 405 - RNA, 20 nt, Artificial Sequence
  spacer targeting mutant Rho
uggccaucgagcuguacgug

SEQ ID NO: 406 - RNA, 20 nt, Artificial Sequence
  spacer targeting mutant Rho
agcuguacgugguggugugu

SEQ ID NO: 407 - RNA, 20 nt, Artificial Sequence
  spacer targeting mutant Rho
gggaugcaccugaggacagg

SEQ ID NO: 408 - RNA, 20 nt, Artificial Sequence
  spacer targeting mutant Rho
ucaggugcauccccgagggc

SEQ ID NO: 409 - RNA, 20 nt, Artificial Sequence
  spacer targeting mutant Rho
ggugcauccccgagggccug

SEQ ID NO: 410 - RNA, 20 nt, Artificial Sequence
  spacer targeting mutant Rho
uguggaaucggcuacuacac

SEQ ID NO: 411 - RNA, 20 nt, Artificial Sequence
  spacer targeting mutant Rho
gcuacuacacgcucaagccg

SEQ ID NO: 412 - RNA, 20 nt, Artificial Sequence
  spacer targeting mutant Rho
ccuucaccauccccaugauu

SEQ ID NO: 413 - RNA, 20 nt, Artificial Sequence
  spacer targeting mutant Rho
acauguucgugguccccuuc

SEQ ID NO: 414 - RNA, 20 nt, Artificial Sequence
  spacer targeting mutant Rho
ugguccccuucaccaucccc

SEQ ID NO: 415 - RNA, 20 nt, Artificial Sequence
  spacer targeting mutant Rho
uggggauggugaaggggacc

SEQ ID NO: 416 - RNA, 20 nt, Artificial Sequence
  spacer targeting mutant Rho
uggccaucgagugguacgug

SEQ ID NO: 417 - RNA, 20 nt, Artificial Sequence
  spacer targeting mutant Rho
agugguacgugguggugugu

SEQ ID NO: 418 - RNA, 20 nt, Artificial Sequence
  spacer targeting mutant Rho
aagacggagacgagcuaggu

SEQ ID NO: 419 - RNA, 20 nt, Artificial Sequence
  spacer targeting mutant Rho
uaggccggggccaccuagcu

SEQ ID NO: 420 - RNA, 20 nt, Artificial Sequence
  spacer targeting mutant Rho
cagcguucuuugccgagagc

SEQ ID NO: 421 - RNA, 20 nt, Artificial Sequence
  spacer targeting mutant Rho
gcaaagaacgcugggauggu

SEQ ID NO: 422 - RNA, 20 nt, Artificial Sequence
  spacer targeting mutant Rho
cggcaaagaacgcugggaug

SEQ ID NO: 423 - RNA, 20 nt, Artificial Sequence
  spacer targeting mutant Rho
uugccgagagcgccgccauc

SEQ ID NO: 424 - RNA, 20 nt, Artificial Sequence
  spacer targeting mutant Rho
uaggcccgggccaccuggcu

SEQ ID NO: 425 - RNA, 20 nt, Artificial Sequence
  spacer targeting mutant Rho
uaggcaggucuuaggcccgg

SEQ ID NO: 426 - RNA, 20 nt, Artificial Sequence
  spacer targeting mutant Rho
ccgagagccugcagugcucg

SEQ ID NO: 427 - RNA, 20 nt, Artificial Sequence
  spacer targeting mutant Rho
acacgagcacugcaggcucu

SEQ ID NO: 428 - RNA, 20 nt, Artificial Sequence
  spacer targeting mutant Rho
ucagguacauccccgagagc

SEQ ID NO: 429 - RNA, 20 nt, Artificial Sequence
  spacer targeting mutant Rho
cggggauguaccugaggaca

SEQ ID NO: 430 - RNA, 20 nt, Artificial Sequence
  spacer targeting mutant Rho
gguacauccccgagagccug

SEQ ID NO: 431 - RNA, 20 nt, Artificial Sequence
  spacer targeting mutant Rho
gcugggugcucuacgccagc

SEQ ID NO: 432 - RNA, 20 nt, Artificial Sequence
  spacer targeting mutant Rho
ugaucugcugggugcucuac

SEQ ID NO: 433 - RNA, 20 nt, Artificial Sequence
  spacer targeting mutant Rho
acgccagcguggcauucuac

SEQ ID NO: 434 - RNA, 20 nt, Artificial Sequence
  spacer targeting mutant Rho
aaauuguauccugugggccc

SEQ ID NO: 435 - RNA, 20 nt, Artificial Sequence
  spacer targeting mutant Rho
ucgggcccacaggauacaau

SEQ ID NO: 436 - RNA, 20 nt, Artificial Sequence
  spacer targeting mutant Rho
ggcccacaggauacaauuug

SEQ ID NO: 437 - RNA, 20 nt, Artificial Sequence
  spacer targeting mutant Rho
ugcugggcuuccgcaucaac

SEQ ID NO: 438 - RNA, 20 nt, Artificial Sequence
  spacer targeting mutant Rho
gcaucaacuuccucacgcuc

SEQ ID NO: 439 - RNA, 20 nt, Artificial Sequence
  spacer targeting mutant Rho
ucaggcccacaggaugcaau

SEQ ID NO: 440 - RNA, 20 nt, Artificial Sequence
  spacer targeting mutant Rho
ucuucaggcccacaggaugc

SEQ ID NO: 441 - RNA, 20 nt, Artificial Sequence
  spacer targeting mutant Rho
ugugggccugaagacgaagu

SEQ ID NO: 442 - RNA, 20 nt, Artificial Sequence
  spacer targeting mutant Rho
uguggaaucuacuacuacac

SEQ ID NO: 443 - RNA, 20 nt, Artificial Sequence
  spacer targeting mutant Rho
acgugcccuucuccagugcg

SEQ ID NO: 444 - RNA, 20 nt, Artificial Sequence
  spacer targeting mutant Rho
cacuggagaagggcacguag

SEQ ID NO: 445 - RNA, 20 nt, Artificial Sequence
  spacer targeting mutant Rho
ccagugcgacggguguggua

SEQ ID NO: 446 - RNA, 20 nt, Artificial Sequence
  spacer targeting mutant Rho
agugcgacgggugugguacg

SEQ ID NO: 447 - RNA, 20 nt, Artificial Sequence
  spacer targeting mutant Rho
acagguucgugguccacuuc

SEQ ID NO: 448 - RNA, 20 nt, Artificial Sequence
  spacer targeting mutant Rho
ucuacagguucgugguccac

SEQ ID NO: 449 - RNA, 20 nt, Artificial Sequence
  spacer targeting mutant Rho
uuugucaucuacagguucgu

SEQ ID NO: 450 - RNA, 20 nt, Artificial Sequence
  spacer targeting mutant Rho
ugaccaucccagaguucuuu

SEQ ID NO: 451 - RNA, 20 nt, Artificial Sequence
  spacer targeting mutant Rho
gggauggucaugaagauggg

SEQ ID NO: 452 - RNA, 20 nt, Artificial Sequence
  spacer targeting mutant Rho
uggcaaagaacucugggaug

SEQ ID NO: 453 - RNA, 20 nt, Artificial Sequence
  spacer targeting mutant Rho
cagaguucuuugccaagagc

SEQ ID NO: 454 - RNA, 20 nt, Artificial Sequence
  spacer targeting mutant Rho
ucaugaccaucccagaguuc

SEQ ID NO: 455 - RNA, 20 nt, Artificial Sequence
  spacer targeting mutant Rho
ccuaggaccaugaagagguc

SEQ ID NO: 456 - RNA, 20 nt, Artificial Sequence
  spacer targeting mutant Rho
uaggugacuucaccagcacc

SEQ ID NO: 457 - RNA, 20 nt, Artificial Sequence
  spacer targeting mutant Rho
ucaugguccuaggugacuuc

SEQ ID NO: 458 - RNA, 20 nt, Artificial Sequence
  spacer targeting mutant Rho
ugguccuaggugacuucacc

SEQ ID NO: 459 - RNA, 20 nt, Artificial Sequence
  spacer targeting mutant Rho
gcuucgggaagaaccaugcc

SEQ ID NO: 460 - RNA, 20 nt, Artificial Sequence
  spacer targeting mutant Rho
cgaagcggaaguugcucaug

SEQ ID NO: 461 - RNA, 20 nt, Artificial Sequence
  spacer targeting mutant Rho
ucccgaagcggaaguugcuc

SEQ ID NO: 462 - RNA, 20 nt, Artificial Sequence
  spacer targeting mutant Rho
ggaagaaccaugccaucaug

SEQ ID NO: 463 - RNA, 20 nt, Artificial Sequence
  spacer targeting mutant Rho
ugcugcgcuuccccaucaac

SEQ ID NO: 464 - RNA, 20 nt, Artificial Sequence
  spacer targeting mutant Rho
gcugaucgugcugcgcuucc

SEQ ID NO: 465 - RNA, 20 nt, Artificial Sequence
  spacer targeting mutant Rho
uccaaauugcauccuguggg

SEQ ID NO: 466 - RNA, 20 nt, Artificial Sequence
  spacer targeting mutant Rho
augacccaggugaaggcaac

SEQ ID NO: 467 - RNA, 20 nt, Artificial Sequence
  spacer targeting mutant Rho
uggagcuggccugcgccgca

SEQ ID NO: 468 - RNA, 20 nt, Artificial Sequence
  spacer targeting mutant Rho
ccugggucauggagcuggcc

SEQ ID NO: 469 - RNA, 20 nt, Artificial Sequence
  spacer targeting mutant Rho
cucgccggcugguccaggua

SEQ ID NO: 470 - RNA, 20 nt, Artificial Sequence
  spacer targeting mutant Rho
ugaucugggugcccuacgcc

SEQ ID NO: 471 - RNA, 20 nt, Artificial Sequence
  spacer targeting mutant Rho
cuuuccugaucugggugccc

SEQ ID NO: 472 - RNA, 20 nt, Artificial Sequence
  spacer targeting mutant Rho
ucgcuuuccugaucugggug

SEQ ID NO: 473 - RNA, 20 nt, Artificial Sequence
  spacer targeting mutant Rho
gggugcccuacgccagcgug

SEQ ID NO: 474 - RNA, 20 nt, Artificial Sequence
  spacer targeting mutant Rho
uaggccggggccagcuggcu

SEQ ID NO: 475 - RNA, 20 nt, Artificial Sequence
  spacer targeting mutant Rho
uaggccugggccaccuggcu

SEQ ID NO: 476 - RNA, 20 nt, Artificial Sequence
  spacer targeting mutant Rho
uaggcaggucuuaggccugg

SEQ ID NO: 477 - RNA, 20 nt, Artificial Sequence
  spacer targeting mutant Rho
ccagcauccucuacaccucu

SEQ ID NO: 478 - RNA, 20 nt, Artificial Sequence
  spacer targeting mutant Rho
ucuacaccucucugcaugga

SEQ ID NO: 479 - RNA, 20 nt, Artificial Sequence
  spacer targeting mutant Rho
aaggcgcugcguaccacacc

SEQ ID NO: 480 - RNA, 20 nt, Artificial Sequence
  spacer targeting mutant Rho
ggcucgucuccgucuuggac

SEQ ID NO: 481 - RNA, 20 nt, Artificial Sequence
  spacer targeting mutant Rho
uaggccggggccaucuggcu

SEQ ID NO: 482 - RNA, 20 nt, Artificial Sequence
  spacer targeting mutant Rho
ccuaggucauggcgcuggcc

SEQ ID NO: 483 - RNA, 20 nt, Artificial Sequence
  spacer targeting mutant Rho
acuuccucacgcucuaaguc

SEQ ID NO: 484 - RNA, 20 nt, Artificial Sequence
  spacer targeting mutant Rho
cgcucuaagucaccguccag

SEQ ID NO: 485 - RNA, 20 nt, Artificial Sequence
  spacer targeting mutant Rho
aagucaccguccagcacaag

SEQ ID NO: 486 - RNA, 20 nt, Artificial Sequence
  spacer targeting mutant Rho
ugugcuggacggugacuuag

SEQ ID NO: 487 - RNA, 20 nt, Artificial Sequence
  spacer targeting mutant Rho
ucacgcucuaagucaccguc

SEQ ID NO: 488 - RNA, 20 nt, Artificial Sequence
  spacer targeting mutant Rho
ccagcugguccagguaaugg

SEQ ID NO: 489 - RNA, 20 nt, Artificial Sequence
  spacer targeting mutant Rho
auucuacacgagcacugcag

SEQ ID NO: 490 - RNA, 20 nt, Artificial Sequence
  spacer targeting mutant Rho
uguagaaucgacuacuacac

SEQ ID NO: 491 - RNA, 20 nt, Artificial Sequence
  spacer targeting mutant Rho
ucacccaguucuugccgcag

SEQ ID NO: 492 - RNA, 20 nt, Artificial Sequence
  spacer targeting mutant Rho
gcugcggcaagaacugggug

SEQ ID NO: 493 - RNA, 20 nt, Artificial Sequence
  spacer targeting mutant Rho
cccaguucuugccgcagcag

SEQ ID NO: 494 - RNA, 20 nt, Artificial Sequence
  spacer targeting mutant Rho
ucgucacccaguucuugccg

SEQ ID NO: 495 - RNA, 20 nt, Artificial Sequence
  spacer targeting mutant Rho
gguacauccccaagggccug

SEQ ID NO: 496 - RNA, 20 nt, Artificial Sequence
  spacer targeting mutant Rho
ucagguacauccccaagggc

SEQ ID NO: 497 - RNA, 20 nt, Artificial Sequence
  spacer targeting mutant Rho
ccaagggccugcagugcucg

SEQ ID NO: 498 - RNA, 20 nt, Artificial Sequence
  spacer targeting mutant Rho
agcuuuacgugguggugugu

SEQ ID NO: 499 - RNA, 20 nt, Artificial Sequence
  spacer targeting mutant Rho
uggccaucgagcuuuacgug

SEQ ID NO: 500 - RNA, 20 nt, Artificial Sequence
  spacer targeting mutant Rho
uugccacccuggcgguauga

SEQ ID NO: 501 - RNA, 20 nt, Artificial Sequence
  spacer targeting mutant Rho
uaccgccaggguggcaaaga

SEQ ID NO: 502 - RNA, 20 nt, Artificial Sequence
  spacer targeting mutant Rho
uggucccagguggcuucacc

SEQ ID NO: 503 - RNA, 20 nt, Artificial Sequence
  spacer targeting mutant Rho
ucauggucccagguggcuuc

SEQ ID NO: 504 - RNA, 20 nt, Artificial Sequence
  spacer targeting mutant Rho
cagguggcuucaccagcacc

SEQ ID NO: 505 - RNA, 20 nt, Artificial Sequence
  spacer targeting mutant Rho
ccugggucauggugcuggcc

SEQ ID NO: 506 - RNA, 20 nt, Artificial Sequence
  spacer targeting mutant Rho
uggugcuggccugcgccgca

SEQ ID NO: 507 - RNA, 20 nt, Artificial Sequence
  spacer targeting mutant Rho
ggaacgcaugcucaccacca

SEQ ID NO: 508 - RNA, 20 nt, Artificial Sequence
  spacer targeting mutant Rho
aguuccggaacgcaugcuca

SEQ ID NO: 509 - RNA, 20 nt, Artificial Sequence
  spacer targeting mutant Rho
gccagguaguaccgugggua

SEQ ID NO: 510 - RNA, 20 nt, Artificial Sequence
  spacer targeting mutant Rho
aguacccacgguacuaccug

SEQ ID NO: 511 - RNA, 20 nt, Artificial Sequence
  spacer targeting mutant Rho
cggccaucgagcgguacgug

SEQ ID NO: 512 - RNA, 20 nt, Artificial Sequence
  spacer targeting mutant Rho
auggccgggaccaccaagga

SEQ ID NO: 513 - RNA, 20 nt, Artificial Sequence
  spacer targeting mutant Rho
uugguggucccggccaucga

SEQ ID NO: 514 - RNA, 20 nt, Artificial Sequence
  spacer targeting mutant Rho
uugccaagagggccgccauc

SEQ ID NO: 515 - RNA, 20 nt, Artificial Sequence
  spacer targeting mutant Rho
acacgagcacugccaggccc

SEQ ID NO: 516 - RNA, 20 nt, Artificial Sequence
  spacer targeting mutant Rho
ccgagggccuggcagugcuc

SEQ ID NO: 517 - RNA, 20 nt, Artificial Sequence
  spacer targeting mutant Rho
aaugcgacggaugugguacg

SEQ ID NO: 518 - RNA, 20 nt, Artificial Sequence
  spacer targeting mutant Rho
ccaaugcgacggauguggua

SEQ ID NO: 519 - RNA, 20 nt, Artificial Sequence
  spacer targeting mutant Rho
gucgcauuggagaagggcac

SEQ ID NO: 520 - RNA, 20 nt, Artificial Sequence
  spacer targeting mutant Rho
acaccucucugcauguauac

SEQ ID NO: 521 - RNA, 20 nt, Artificial Sequence
  spacer targeting mutant Rho
cugcauguauacuucgucuu

SEQ ID NO: 522 - RNA, 20 nt, Artificial Sequence
  spacer targeting mutant Rho
gcauguauacuucgucuucg

SEQ ID NO: 523 - RNA, 20 nt, Artificial Sequence
  spacer targeting mutant Rho
gugauguaccugaggacagg

SEQ ID NO: 524 - RNA, 20 nt, Artificial Sequence
  spacer targeting mutant Rho
gguacaucaccgagggccug

SEQ ID NO: 525 - RNA, 20 nt, Artificial Sequence
  spacer targeting mutant Rho
ucagguacaucaccgagggc

SEQ ID NO: 526 - RNA, 20 nt, Artificial Sequence
  spacer targeting mutant Rho
uggccaucgagcgguaagug

SEQ ID NO: 527 - RNA, 20 nt, Artificial Sequence
  spacer targeting mutant Rho
agcgguaagugguggugugu

SEQ ID NO: 528 - RNA, 20 nt, Artificial Sequence
  spacer targeting mutant Rho
ucgggcccacaggaggcaau

SEQ ID NO: 529 - RNA, 20 nt, Artificial Sequence
  spacer targeting mutant Rho
aaauugccuccugugggccc

SEQ ID NO: 530 - RNA, 20 nt, Artificial Sequence
  spacer targeting mutant Rho
ucuucgggcccacaggaggc

SEQ ID NO: 531 - RNA, 20 nt, Artificial Sequence
  spacer targeting mutant Rho
ggcccacaggaggcaauuug

SEQ ID NO: 532 - RNA, 20 nt, Artificial Sequence
  spacer targeting mutant Rho
uaggccggggccaacuggcu

SEQ ID NO: 533 - RNA, 20 nt, Artificial Sequence
  spacer targeting mutant Rho
agcacaagaagcggcgcacg

SEQ ID NO: 534 - RNA, 20 nt, Artificial Sequence
  spacer targeting mutant Rho
ugguccuacguggcuucacc

SEQ ID NO: 535 - RNA, 20 nt, Artificial Sequence
  spacer targeting mutant Rho
ucaugguccuacguggcuuc

SEQ ID NO: 536 - RNA, 20 nt, Artificial Sequence
  spacer targeting mutant Rho
uacguggcuucaccagcacc

SEQ ID NO: 537 - RNA, 20 nt, Artificial Sequence
  spacer targeting mutant Rho
ggcguagggcacccagcaga

SEQ ID NO: 538 - RNA, 20 nt, Artificial Sequence
  spacer targeting mutant Rho
acaaccgugucaucuauauc

SEQ ID NO: 539 - RNA, 20 nt, Artificial Sequence
  spacer targeting mutant Rho
ucaugauauagaugacacgg

SEQ ID NO: 540 - RNA, 20 nt, Artificial Sequence
  spacer targeting mutant Rho
ugauauagaugacacgguug

SEQ ID NO: 541 - RNA, 20 nt, Artificial Sequence
  spacer targeting mutant Rho
auaucaugaugaacaaguag

SEQ ID NO: 542 - RNA, 20 nt, Artificial Sequence
  spacer targeting mutant Rho
ugaugaacaaguaggugccu

SEQ ID NO: 543 - RNA, 20 nt, Artificial Sequence
  spacer targeting mutant Rho
aaggcgacgggugugguacg

SEQ ID NO: 544 - RNA, 20 nt, Artificial Sequence
  spacer targeting mutant Rho
ccaaggcgacggguguggua

SEQ ID NO: 545 - RNA, 20 nt, Artificial Sequence
  spacer targeting mutant Rho
ccuuggagaagggcacguag

SEQ ID NO: 546 - RNA, 20 nt, Artificial Sequence
  spacer targeting mutant Rho
acgugcccuucuccaaggcg

SEQ ID NO: 547 - RNA, 20 nt, Artificial Sequence
  spacer targeting mutant Rho
ugcccacaggaugcaauuug

SEQ ID NO: 548 - RNA, 20 nt, Artificial Sequence
  spacer targeting mutant Rho
ucuucgugcccacaggaugc

SEQ ID NO: 549 - RNA, 20 nt, Artificial Sequence
  spacer targeting mutant Rho
ucgugcccacaggaugcaau

SEQ ID NO: 550 - RNA, 20 nt, Artificial Sequence
  spacer targeting mutant Rho
ugugggcacgaagacgaagu

SEQ ID NO: 551 - RNA, 20 nt, Artificial Sequence
  spacer targeting mutant Rho
acaccagcacugcaggcccu

SEQ ID NO: 552 - RNA, 20 nt, Artificial Sequence
  spacer targeting mutant Rho
auuccacaccagcacugcag

SEQ ID NO: 553 - RNA, 20 nt, Artificial Sequence
  spacer targeting mutant Rho
agccucuugccuuccuguuc

SEQ ID NO: 554 - RNA, 20 nt, Artificial Sequence
  spacer targeting mutant Rho
ggaacaggaaggcaagaggc

SEQ ID NO: 555 - RNA, 20 nt, Artificial Sequence
  spacer targeting mutant Rho
uguuccggaacugcaugcuc

SEQ ID NO: 556 - RNA, 20 nt, Artificial Sequence
  spacer targeting mutant Rho
ugccuuccuguuccggaacu

SEQ ID NO: 557 - RNA, 20 nt, Artificial Sequence
  spacer targeting mutant Rho
uaggccggggccgccuggcu

SEQ ID NO: 558 - RNA, 20 nt, Artificial Sequence
  spacer targeting mutant Rho
cccaguguucuugccgcagc

SEQ ID NO: 559 - RNA, 20 nt, Artificial Sequence
  spacer targeting mutant Rho
gcugcggcaagaacacuggg

SEQ ID NO: 560 - RNA, 20 nt, Artificial Sequence
  spacer targeting mutant Rho
ucgucacccaguguucuugc

SEQ ID NO: 561 - RNA, 20 nt, Artificial Sequence
  spacer targeting mutant Rho
ucacccaguguucuugccgc

SEQ ID NO: 562 - RNA, 20 nt, Artificial Sequence
  spacer targeting mutant Rho
ugugaaaucgacuacuacac

SEQ ID NO: 563 - RNA, 20 nt, Artificial Sequence
  spacer targeting mutant Rho
auuucacacgagcacugcag

SEQ ID NO: 564 - RNA, 20 nt, Artificial Sequence
  spacer targeting mutant Rho
cacgagcacugcaggcccuc

SEQ ID NO: 565 - RNA, 20 nt, Artificial Sequence
  spacer targeting mutant Rho
uggcgcuggucugcgccgca

SEQ ID NO: 566 - RNA, 20 nt, Artificial Sequence
  spacer targeting mutant Rho
gcgccgcacccccacucgcc

SEQ ID NO: 567 - RNA, 20 nt, Artificial Sequence
  spacer targeting mutant Rho
ggcuugagcguguaguaguc

SEQ ID NO: 568 - RNA, 20 nt, Artificial Sequence
  spacer targeting mutant Rho
cugcagugcucguguggaau

SEQ ID NO: 569 - RNA, 20 nt, Artificial Sequence
  spacer targeting mutant Rho
uuguugaccuccggcuugag

SEQ ID NO: 570 - RNA, 20 nt, Artificial Sequence
  spacer targeting mutant Rho
acacgagcacugcagugaag

SEQ ID NO: 571 - RNA, 20 nt, Artificial Sequence
  spacer targeting mutant Rho
acuucacugcagugcucgug

SEQ ID NO: 572 - RNA, 20 nt, Artificial Sequence
  spacer targeting mutant Rho
acuacuacacgcucaagccg

SEQ ID NO: 573 - RNA, 20 nt, Artificial Sequence
  spacer targeting mutant Rho
ugguccacuucacugcagug

SEQ ID NO: 574 - RNA, 20 nt, Artificial Sequence
  spacer targeting mutant Rho
agccggaggucaacaacgag

SEQ ID NO: 575 - RNA, 20 nt, Artificial Sequence
  spacer targeting mutant Rho
ucuacauguucgugguccac

SEQ ID NO: 576 - RNA, 20 nt, Artificial Sequence
  spacer targeting mutant Rho
acaacgagucuuuugucauc

SEQ ID NO: 577 - RNA, 20 nt, Artificial Sequence
  spacer targeting mutant Rho
acauguucgugguccacuuc

SEQ ID NO: 578 - RNA, 20 nt, Artificial Sequence
  spacer targeting mutant Rho
uguggaaucgacuacuacac

SEQ ID NO: 579 - RNA, 20 nt, Artificial Sequence
  spacer targeting mutant Rho
uuugucaucuacauguucgu

SEQ ID NO: 580 - RNA, 20 nt, Artificial Sequence
  spacer targeting mutant Rho
uauggaaucgacuacuacac

SEQ ID NO: 581 - RNA, 20 nt, Artificial Sequence
  spacer targeting mutant Rho
auuccauacgagcacugcag

SEQ ID NO: 582 - RNA, 20 nt, Artificial Sequence
  spacer targeting mutant Rho
auacgagcacugcaggcccu

SEQ ID NO: 583 - RNA, 20 nt, Artificial Sequence
  targeting sequence with ATCN PAM
ucagaccucauucgaguuug

SEQ ID NO: 584 - RNA, 20 nt, Artificial Sequence
  targeting sequence with ATCN PAM
guguucguuuccuagcacca

SEQ ID NO: 585 - RNA, 20 nt, Artificial Sequence
  targeting sequence with ATCN PAM
ucagggugaugggacaugag

SEQ ID NO: 586 - RNA, 20 nt, Artificial Sequence
  targeting sequence with ATCN PAM
gggugaugggacaugaggcu

SEQ ID NO: 587 - RNA, 20 nt, Artificial Sequence
  targeting sequence with ATCN PAM
cccugaugauuuucaagugc

SEQ ID NO: 588 - RNA, 20 nt, Artificial Sequence
  targeting sequence with ATCN PAM
gccagcgcaguccaaaaaga

SEQ ID NO: 589 - RNA, 20 nt, Artificial Sequence
  targeting sequence with ATCN PAM
ugcucuuuaaaaaucacaua

SEQ ID NO: 590 - RNA, 20 nt, Artificial Sequence
  targeting sequence with ATCN PAM
cauagcaaaacuagaggcaa

SEQ ID NO: 591 - RNA, 20 nt, Artificial Sequence
  targeting sequence with ATCN PAM
caggaacugaacugcucaau

SEQ ID NO: 592 - RNA, 20 nt, Artificial Sequence
  targeting sequence with ATCN PAM
uagcacugcacuccagccug

SEQ ID NO: 593 - RNA, 20 nt, Artificial Sequence
  targeting sequence with ATCN PAM
cggcucacugcaagcuccgc

SEQ ID NO: 594 - RNA, 20 nt, Artificial Sequence
  targeting sequence with ATCN PAM
agugagugcggggugcuggg

SEQ ID NO: 595 - RNA, 20 nt, Artificial Sequence
  targeting sequence with ATCN PAM
uggaggcaaaguccaucuag

SEQ ID NO: 596 - RNA, 20 nt, Artificial Sequence
  targeting sequence with ATCN PAM
gguaucugccuaugagagag

SEQ ID NO: 597 - RNA, 20 nt, Artificial Sequence
  targeting sequence with ATCN PAM
gccuaugagagaguuguguc

SEQ ID NO: 598 - RNA, 20 nt, Artificial Sequence
  targeting sequence with ATCN PAM
ggugagacacaacucucuca

SEQ ID NO: 599 - RNA, 20 nt, Artificial Sequence
  targeting sequence with ATCN PAM
uuuguguaucauucccaaga

SEQ ID NO: 600 - RNA, 20 nt, Artificial Sequence
  targeting sequence with ATCN PAM
uucccaagaggugaaacaua

SEQ ID NO: 601 - RNA, 20 nt, Artificial Sequence
  targeting sequence with ATCN PAM
aaggcucugaaguuugcugu

SEQ ID NO: 602 - RNA, 20 nt, Artificial Sequence
  targeting sequence with ATCN PAM
uuccugccuuugccacagca

SEQ ID NO: 603 - RNA, 20 nt, Artificial Sequence
  targeting sequence with ATCN PAM
ggugcuuugagaaagaccau

SEQ ID NO: 604 - RNA, 20 nt, Artificial Sequence
  targeting sequence with ATCN PAM
uuaaauacuaugauggcaaa

SEQ ID NO: 605 - RNA, 20 nt, Artificial Sequence
  targeting sequence with ATCN PAM
uaguauuuaaagauggucuu

SEQ ID NO: 606 - RNA, 20 nt, Artificial Sequence
  targeting sequence with ATCN PAM
cuguaugccguuaaaauaca

SEQ ID NO: 607 - RNA, 20 nt, Artificial Sequence
  targeting sequence with ATCN PAM
gauuuuacacauuuauuucu

SEQ ID NO: 608 - RNA, 20 nt, Artificial Sequence
  targeting sequence with ATCN PAM
gauuuguucuuuuuguauuu

SEQ ID NO: 609 - RNA, 20 nt, Artificial Sequence
  targeting sequence with ATCN PAM
gaaauaaauguguaaaaucu

SEQ ID NO: 610 - RNA, 20 nt, Artificial Sequence
  targeting sequence with ATCN PAM
ucacugcugcgugcaccaca

SEQ ID NO: 611 - RNA, 20 nt, Artificial Sequence
  targeting sequence with ATCN PAM
gcaagaaggguauuccagag

SEQ ID NO: 612 - RNA, 20 nt, Artificial Sequence
  targeting sequence with ATCN PAM
cuccuacuccauugagguca

SEQ ID NO: 613 - RNA, 20 nt, Artificial Sequence
  targeting sequence with ATCN PAM
aaugugaccucaauggagua

SEQ ID NO: 614 - RNA, 20 nt, Artificial Sequence
  targeting sequence with ATCN PAM
ugugucaucuaaugugaccu

SEQ ID NO: 615 - RNA, 20 nt, Artificial Sequence
  targeting sequence with ATCN PAM
ugcuucucuguccucugggc

SEQ ID NO: 616 - RNA, 20 nt, Artificial Sequence
  targeting sequence with ATCN PAM
augaggcguugcugacaauu

SEQ ID NO: 617 - RNA, 20 nt, Artificial Sequence
  targeting sequence with ATCN PAM
agugagaaggucuccuuucc

SEQ ID NO: 618 - RNA, 20 nt, Artificial Sequence
  targeting sequence with ATCN PAM
cgguuagaauuccagguagg

SEQ ID NO: 619 - RNA, 20 nt, Artificial Sequence
  targeting sequence with ATCN PAM
accucacaauguuuccauca

SEQ ID NO: 620 - RNA, 20 nt, Artificial Sequence
  targeting sequence with ATCN PAM
auucaauuaauuagagugca

SEQ ID NO: 621 - RNA, 20 nt, Artificial Sequence
  targeting sequence with ATCN PAM
cugaagcugcgcucuucugu

SEQ ID NO: 622 - RNA, 20 nt, Artificial Sequence
  targeting sequence with ATCN PAM
uuauaucucugaagcugcgc

SEQ ID NO: 623 - RNA, 20 nt, Artificial Sequence
  targeting sequence with ATCN PAM
ugucuucuucaucuuuauau

SEQ ID NO: 624 - RNA, 20 nt, Artificial Sequence
  targeting sequence with ATCN PAM
gagcagacaccuacucugca

SEQ ID NO: 625 - RNA, 20 nt, Artificial Sequence
  targeting sequence with ATCN PAM
aaucauccauuuaugggagc

SEQ ID NO: 626 - RNA, 20 nt, Artificial Sequence
  targeting sequence with ATCN PAM
uccauuuaugggagcuuccu

SEQ ID NO: 627 - RNA, 20 nt, Artificial Sequence
  targeting sequence with ATCN PAM
auuuaugggagcuuccuggg

SEQ ID NO: 628 - RNA, 20 nt, Artificial Sequence
  targeting sequence with ATCN PAM
ccaggccucacagagggccu

SEQ ID NO: 629 - RNA, 20 nt, Artificial Sequence
  targeting sequence with ATCN PAM
aggucgaggguucccagcag

SEQ ID NO: 630 - RNA, 20 nt, Artificial Sequence
  targeting sequence with ATCN PAM
ugucuggacaggguuugcug

SEQ ID NO: 631 - RNA, 20 nt, Artificial Sequence
  targeting sequence with ATCN PAM
gagcagcagggacagagggg

SEQ ID NO: 632 - RNA, 20 nt, Artificial Sequence
  targeting sequence with ATCN PAM
ccucugucccugcugcucug

SEQ ID NO: 633 - RNA, 20 nt, Artificial Sequence
  targeting sequence with ATCN PAM
ccucugacccuggaucagag

SEQ ID NO: 634 - RNA, 20 nt, Artificial Sequence
  targeting sequence with ATCN PAM
agggucagaggagaugagcg

SEQ ID NO: 635 - RNA, 20 nt, Artificial Sequence
  targeting sequence with ATCN PAM
gagcccgagaaagcaccugg

SEQ ID NO: 636 - RNA, 20 nt, Artificial Sequence
  targeting sequence with ATCN PAM
aggugcuuucucgggcucug

SEQ ID NO: 637 - RNA, 20 nt, Artificial Sequence
  targeting sequence with ATCN PAM
ucacccugucuagccuguug

SEQ ID NO: 638 - RNA, 20 nt, Artificial Sequence
  targeting sequence with ATCN PAM
agcucaggcauggaaggguu

SEQ ID NO: 639 - RNA, 20 nt, Artificial Sequence
  targeting sequence with ATCN PAM
cagcccagcgaugugcuuau

SEQ ID NO: 640 - RNA, 20 nt, Artificial Sequence
  targeting sequence with ATCN PAM
uaaaucagucuuucccuaug

SEQ ID NO: 641 - RNA, 20 nt, Artificial Sequence
  targeting sequence with ATCN PAM
gucuuucccuaugucuccuc

SEQ ID NO: 642 - RNA, 20 nt, Artificial Sequence
  targeting sequence with ATCN PAM
uuccuggccauguggccuug

SEQ ID NO: 643 - RNA, 20 nt, Artificial Sequence
  targeting sequence with ATCN PAM
gcagcagggggaaugggagg

SEQ ID NO: 644 - RNA, 20 nt, Artificial Sequence
  targeting sequence with ATCN PAM
caggcguaggagggugaguu

SEQ ID NO: 645 - RNA, 20 nt, Artificial Sequence
  targeting sequence with ATCN PAM
cauuggaucgucccaagaaa

SEQ ID NO: 646 - RNA, 20 nt, Artificial Sequence
  targeting sequence with ATCN PAM
aaugagaucacaggcguagg

SEQ ID NO: 647 - RNA, 20 nt, Artificial Sequence
  targeting sequence with ATCN PAM
ucccaagaaauuaucauuuc

SEQ ID NO: 648 - RNA, 20 nt, Artificial Sequence
  targeting sequence with ATCN PAM
uuucuaacuuagaaaugagg

SEQ ID NO: 649 - RNA, 20 nt, Artificial Sequence
  targeting sequence with ATCN PAM
ugccucauuucuaagugugu

SEQ ID NO: 650 - RNA, 20 nt, Artificial Sequence
  targeting sequence with ATCN PAM
cagcauugcuugaggccaag

SEQ ID NO: 651 - RNA, 20 nt, Artificial Sequence
  targeting sequence with ATCN PAM
cacaugcaccaaacacacau

SEQ ID NO: 652 - RNA, 20 nt, Artificial Sequence
  targeting sequence with ATCN PAM
guguuuguguggugugcgug

SEQ ID NO: 653 - RNA, 20 nt, Artificial Sequence
  targeting sequence with ATCN PAM
cgugggggcugcuucuccac

SEQ ID NO: 654 - RNA, 20 nt, Artificial Sequence
  targeting sequence with ATCN PAM
cagcugcuugcagagguccu

SEQ ID NO: 655 - RNA, 20 nt, Artificial Sequence
  targeting sequence with ATCN PAM
gagucaaccgaagcugccca

SEQ ID NO: 656 - RNA, 20 nt, Artificial Sequence
  targeting sequence with ATCN PAM
ccagugacuccgccugccac

SEQ ID NO: 657 - RNA, 20 nt, Artificial Sequence
  targeting sequence with ATCN PAM
uccccgcagcccagcucuga

SEQ ID NO: 658 - RNA, 20 nt, Artificial Sequence
  targeting sequence with ATCN PAM
cggcucacugcaaccuccgc

SEQ ID NO: 659 - RNA, 20 nt, Artificial Sequence
  targeting sequence with ATCN PAM
cuugaacccaggaggcggag

SEQ ID NO: 660 - RNA, 20 nt, Artificial Sequence
  targeting sequence with ATCN PAM
uuucaccucggccuccugag

SEQ ID NO: 661 - RNA, 20 nt, Artificial Sequence
  targeting sequence with ATCN PAM
cuguguuuuggacaaugaaa

SEQ ID NO: 662 - RNA, 20 nt, Artificial Sequence
  targeting sequence with ATCN PAM
ggagcagccacugccaucaa

SEQ ID NO: 663 - RNA, 20 nt, Artificial Sequence
  targeting sequence with ATCN PAM
augguauaucagaaucaugu

SEQ ID NO: 664 - RNA, 20 nt, Artificial Sequence
  targeting sequence with ATCN PAM
gaaucauguugaaauacggu

SEQ ID NO: 665 - RNA, 20 nt, Artificial Sequence
  targeting sequence with ATCN PAM
uguugaaauacgguguucua

SEQ ID NO: 666 - RNA, 20 nt, Artificial Sequence
  targeting sequence with ATCN PAM
uguguuucauuccuuuguua

SEQ ID NO: 667 - RNA, 20 nt, Artificial Sequence
  targeting sequence with ATCN PAM
aaguaccaaaaucagggauu

SEQ ID NO: 668 - RNA, 20 nt, Artificial Sequence
  targeting sequence with ATCN PAM
gggauuuauaaaagagagaa

SEQ ID NO: 669 - RNA, 20 nt, Artificial Sequence
  targeting sequence with ATCN PAM
cugauuuugguacuucgauc

SEQ ID NO: 670 - RNA, 20 nt, Artificial Sequence
  targeting sequence with ATCN PAM
guuaccccuuauauaguuga

SEQ ID NO: 671 - RNA, 20 nt, Artificial Sequence
  targeting sequence with ATCN PAM
uucaacuauauaagggguaa

SEQ ID NO: 672 - RNA, 20 nt, Artificial Sequence
  targeting sequence with ATCN PAM
gcauagggugccauucaccu

SEQ ID NO: 673 - RNA, 20 nt, Artificial Sequence
  targeting sequence with ATCN PAM
cuucaucugcauagggugcc

SEQ ID NO: 674 - RNA, 20 nt, Artificial Sequence
  targeting sequence with ATCN PAM
aaagggaaacaccugggucu

SEQ ID NO: 675 - RNA, 20 nt, Artificial Sequence
  targeting sequence with ATCN PAM
agcuuugggaagucagcaca

SEQ ID NO: 676 - RNA, 20 nt, Artificial Sequence
  targeting sequence with ATCN PAM
gaggccaauuugugcugacu

SEQ ID NO: 677 - RNA, 20 nt, Artificial Sequence
  targeting sequence with ATCN PAM
aggaaaaacaccaaggucug

SEQ ID NO: 678 - RNA, 20 nt, Artificial Sequence
  targeting sequence with ATCN PAM
ugccucauugcuacagaguc

SEQ ID NO: 679 - RNA, 20 nt, Artificial Sequence
  targeting sequence with ATCN PAM
ugggcauaaggggucagacu

SEQ ID NO: 680 - RNA, 20 nt, Artificial Sequence
  targeting sequence with ATCN PAM
uuuaguuuuaguauugaagg

SEQ ID NO: 681 - RNA, 20 nt, Artificial Sequence
  targeting sequence with ATCN PAM
uugaaauuuccagucccauc

SEQ ID NO: 682 - RNA, 20 nt, Artificial Sequence
  targeting sequence with ATCN PAM
acauuugggaaccauuagca

SEQ ID NO: 683 - RNA, 20 nt, Artificial Sequence
  targeting sequence with ATCN PAM
cuccuggcuuccugggcagg

SEQ ID NO: 684 - RNA, 20 nt, Artificial Sequence
  targeting sequence with ATCN PAM
ucaacaaggaaaggccuugc

SEQ ID NO: 685 - RNA, 20 nt, Artificial Sequence
  targeting sequence with ATCN PAM
gccuuagguucccucccucc

SEQ ID NO: 686 - RNA, 20 nt, Artificial Sequence
  targeting sequence with ATCN PAM
aaaggaaaaccucaccucuu

SEQ ID NO: 687 - RNA, 20 nt, Artificial Sequence
  targeting sequence with ATCN PAM
uuuuguuacuugggugugaa

SEQ ID NO: 688 - RNA, 20 nt, Artificial Sequence
  targeting sequence with ATCN PAM
gaggcuacucccuuugcacu

SEQ ID NO: 689 - RNA, 20 nt, Artificial Sequence
  targeting sequence with ATCN PAM
gcuauguagugcaaagggag

SEQ ID NO: 690 - RNA, 20 nt, Artificial Sequence
  targeting sequence with ATCN PAM
gagguacuuuuuuauuuuuu

SEQ ID NO: 691 - RNA, 20 nt, Artificial Sequence
  targeting sequence with ATCN PAM
caaugguuguggaccauucc

SEQ ID NO: 692 - RNA, 20 nt, Artificial Sequence
  targeting sequence with ATCN PAM
ucuaggguuugaguaccuuc

SEQ ID NO: 693 - RNA, 20 nt, Artificial Sequence
  targeting sequence with ATCN PAM
gugcuuuuguugcuucauuc

SEQ ID NO: 694 - RNA, 20 nt, Artificial Sequence
  targeting sequence with ATCN PAM
ucccacgcaucuggaggcag

SEQ ID NO: 695 - RNA, 20 nt, Artificial Sequence
  targeting sequence with ATCN PAM
ggaggcaggcucuguaugca

SEQ ID NO: 696 - RNA, 20 nt, Artificial Sequence
  targeting sequence with ATCN PAM
gguucuuuccauggcccuga

SEQ ID NO: 697 - RNA, 20 nt, Artificial Sequence
  targeting sequence with ATCN PAM
agggaaaaaaagacuguuuu

SEQ ID NO: 698 - RNA, 20 nt, Artificial Sequence
  targeting sequence with ATCN PAM
ugcagucugcucccauguac

SEQ ID NO: 699 - RNA, 20 nt, Artificial Sequence
  targeting sequence with ATCN PAM
agguacugguacaugggagc

SEQ ID NO: 700 - RNA, 20 nt, Artificial Sequence
  targeting sequence with ATCN PAM
gguaggcuuccuugaacagu

SEQ ID NO: 701 - RNA, 20 nt, Artificial Sequence
  targeting sequence with ATCN PAM
gugucugugacacccaagca

SEQ ID NO: 702 - RNA, 20 nt, Artificial Sequence
  targeting sequence with ATCN PAM
aaaccuagcgcuuccauggc

SEQ ID NO: 703 - RNA, 20 nt, Artificial Sequence
  targeting sequence with ATCN PAM
agccagcaggagcuggaguu

SEQ ID NO: 704 - RNA, 20 nt, Artificial Sequence
  targeting sequence with ATCN PAM
gccuucuuaagggaccccac

SEQ ID NO: 705 - RNA, 20 nt, Artificial Sequence
  targeting sequence with ATCN PAM
uagccacuuccucacugugg

SEQ ID NO: 706 - RNA, 20 nt, Artificial Sequence
  targeting sequence with ATCN PAM
uagaaagggugucaccuacc

SEQ ID NO: 707 - RNA, 20 nt, Artificial Sequence
  targeting sequence with ATCN PAM
cccuacgucuauagagaagc

SEQ ID NO: 708 - RNA, 20 nt, Artificial Sequence
  targeting sequence with ATCN PAM
ucacaaagcugugaggauca

SEQ ID NO: 709 - RNA, 20 nt, Artificial Sequence
  targeting sequence with ATCN PAM
ucacagcuuugugaggaugg

SEQ ID NO: 710 - RNA, 20 nt, Artificial Sequence
  targeting sequence with ATCN PAM
aaugggaggaugccuguaaa

SEQ ID NO: 711 - RNA, 20 nt, Artificial Sequence
  targeting sequence with ATCN PAM
ucccauuugauccucacagc

SEQ ID NO: 712 - RNA, 20 nt, Artificial Sequence
  targeting sequence with ATCN PAM
gacaugcugcuccuggguca

SEQ ID NO: 713 - RNA, 20 nt, Artificial Sequence
  targeting sequence with ATCN PAM
caggcacuccguaaauggcg

SEQ ID NO: 714 - RNA, 20 nt, Artificial Sequence
  targeting sequence with ATCN PAM
guguagucacuggccaugau

SEQ ID NO: 715 - RNA, 20 nt, Artificial Sequence
  targeting sequence with ATCN PAM
uggccagugacuacaccgau

SEQ ID NO: 716 - RNA, 20 nt, Artificial Sequence
  targeting sequence with ATCN PAM
gccaacuaaggugggagaga

SEQ ID NO: 717 - RNA, 20 nt, Artificial Sequence
  targeting sequence with ATCN PAM
cucccaccuuaguuggcaga

SEQ ID NO: 718 - RNA, 20 nt, Artificial Sequence
  targeting sequence with ATCN PAM
gagaccuugaccaucucucc

SEQ ID NO: 719 - RNA, 20 nt, Artificial Sequence
  targeting sequence with ATCN PAM
cgccaugaagguacguggga

SEQ ID NO: 720 - RNA, 20 nt, Artificial Sequence
  targeting sequence with ATCN PAM
aguccaugaaucccgccaug

SEQ ID NO: 721 - RNA, 20 nt, Artificial Sequence
  targeting sequence with ATCN PAM
cucuagcuuucauagacuag

SEQ ID NO: 722 - RNA, 20 nt, Artificial Sequence
  targeting sequence with ATCN PAM
gaccccucucugcacauaag

SEQ ID NO: 723 - RNA, 20 nt, Artificial Sequence
  targeting sequence with ATCN PAM
agaaccucagauggaggaag

SEQ ID NO: 724 - RNA, 20 nt, Artificial Sequence
  targeting sequence with ATCN PAM
gagguucuagauggaaacac

SEQ ID NO: 725 - RNA, 20 nt, Artificial Sequence
  targeting sequence with ATCN PAM
ccccacagucaauuaaggag

SEQ ID NO: 726 - RNA, 20 nt, Artificial Sequence
  targeting sequence with ATCN PAM
cgucccucuuugccacuccu

SEQ ID NO: 727 - RNA, 20 nt, Artificial Sequence
  targeting sequence with ATCN PAM
aacccaaggcgggcaucacg

SEQ ID NO: 728 - RNA, 20 nt, Artificial Sequence
  targeting sequence with ATCN PAM
agacuuguaggcaugaagag

SEQ ID NO: 729 - RNA, 20 nt, Artificial Sequence
  targeting sequence with ATCN PAM
caguuaagccuugugacugc

SEQ ID NO: 730 - RNA, 20 nt, Artificial Sequence
  targeting sequence with ATCN PAM
cugcuuuaaauuccccuuua

SEQ ID NO: 731 - RNA, 20 nt, Artificial Sequence
  targeting sequence with ATCN PAM
gcacaaccaucccugcuuua

SEQ ID NO: 732 - RNA, 20 nt, Artificial Sequence
  targeting sequence with ATCN PAM
uuguguaacaauguucaagu

SEQ ID NO: 733 - RNA, 20 nt, Artificial Sequence
  targeting sequence with ATCN PAM
agauuauauuuuuagauguc

SEQ ID NO: 734 - RNA, 20 nt, Artificial Sequence
  targeting sequence with ATCN PAM
ugaucauuguguaacaaugu

SEQ ID NO: 735 - RNA, 20 nt, Artificial Sequence
  targeting sequence with ATCN PAM
aaaaauauaaucuugaucau

SEQ ID NO: 736 - RNA, 20 nt, Artificial Sequence
  targeting sequence with ATCN PAM
ccacuuuccuacacugggga

SEQ ID NO: 737 - RNA, 20 nt, Artificial Sequence
  targeting sequence with ATCN PAM
uacagcuuccuccaucucca

SEQ ID NO: 738 - RNA, 20 nt, Artificial Sequence
  targeting sequence with ATCN PAM
ccauggagggagcuucccuc

SEQ ID NO: 739 - RNA, 20 nt, Artificial Sequence
  targeting sequence with ATCN PAM
uccucccugcuggcauuucu

SEQ ID NO: 740 - RNA, 20 nt, Artificial Sequence
  targeting sequence with ATCN PAM
ccagaauagguguuguuuug

SEQ ID NO: 741 - RNA, 20 nt, Artificial Sequence
  targeting sequence with ATCN PAM
agagggaagguucuuaauuu

SEQ ID NO: 742 - RNA, 20 nt, Artificial Sequence
  targeting sequence with ATCN PAM
uaauaacacugcacacugcc

SEQ ID NO: 743 - RNA, 20 nt, Artificial Sequence
  targeting sequence with ATCN PAM
auucaaauauuuguugagca

SEQ ID NO: 744 - RNA, 20 nt, Artificial Sequence
  targeting sequence with ATCN PAM
ccaaaacacucccugagaau

SEQ ID NO: 745 - RNA, 20 nt, Artificial Sequence
  targeting sequence with ATCN PAM
uguggcuuuaauacacccuu

SEQ ID NO: 746 - RNA, 20 nt, Artificial Sequence
  targeting sequence with ATCN PAM
augaacaguguuauuuuuua

SEQ ID NO: 747 - RNA, 20 nt, Artificial Sequence
  targeting sequence with ATCN PAM
auuaaguacaacaugggaca

SEQ ID NO: 748 - RNA, 20 nt, Artificial Sequence
  targeting sequence with ATCN PAM
caguucuuugggaggccgag

SEQ ID NO: 749 - RNA, 20 nt, Artificial Sequence
  targeting sequence with ATCN PAM
gccugucucggccucccaaa

SEQ ID NO: 750 - RNA, 20 nt, Artificial Sequence
  targeting sequence with ATCN PAM
guugaggccaggaguuuaag

SEQ ID NO: 751 - RNA, 20 nt, Artificial Sequence
  targeting sequence with ATCN PAM
cggcucacuguagccucugu

SEQ ID NO: 752 - RNA, 20 nt, Artificial Sequence
  targeting sequence with ATCN PAM
ugccacugcauuccagccuu

SEQ ID NO: 753 - RNA, 20 nt, Artificial Sequence
  targeting sequence with ATCN PAM
guacaauaugauguuuugaa

SEQ ID NO: 754 - RNA, 20 nt, Artificial Sequence
  targeting sequence with ATCN PAM
uauuguacugauuuuuuugu

SEQ ID NO: 755 - RNA, 20 nt, Artificial Sequence
  targeting sequence with ATCN PAM
agcuuuuucaaaacaucaua

SEQ ID NO: 756 - RNA, 20 nt, Artificial Sequence
  targeting sequence with ATCN PAM
uccagcuuuuucaaaacauc

SEQ ID NO: 757 - RNA, 20 nt, Artificial Sequence
  targeting sequence with ATCN PAM
aaauccuguauccccccccu

SEQ ID NO: 758 - RNA, 20 nt, Artificial Sequence
  targeting sequence with ATCN PAM
uguauccccccccuuucuuu

SEQ ID NO: 759 - RNA, 20 nt, Artificial Sequence
  targeting sequence with ATCN PAM
ccccccuuucuuucccucug

SEQ ID NO: 760 - RNA, 20 nt, Artificial Sequence
  targeting sequence with ATCN PAM
cuggggaccacccugugcaa

SEQ ID NO: 761 - RNA, 20 nt, Artificial Sequence
  targeting sequence with ATCN PAM
ccacuagauggcagagaaga

SEQ ID NO: 762 - RNA, 20 nt, Artificial Sequence
  targeting sequence with ATCN PAM
aguggggauggcauaccauc

SEQ ID NO: 763 - RNA, 20 nt, Artificial Sequence
  targeting sequence with ATCN PAM
cggcagcuguucagaguggu

SEQ ID NO: 764 - RNA, 20 nt, Artificial Sequence
  targeting sequence with ATCN PAM
ugcagcaucacggcagcugu

SEQ ID NO: 765 - RNA, 20 nt, Artificial Sequence
  targeting sequence with ATCN PAM
gguugaaggaacuuggaaac

SEQ ID NO: 766 - RNA, 20 nt, Artificial Sequence
  targeting sequence with ATCN PAM
guuuccaaguuccuucaacc

SEQ ID NO: 767 - RNA, 20 nt, Artificial Sequence
  targeting sequence with ATCN PAM
uagacuccagcacagccgac

SEQ ID NO: 768 - RNA, 20 nt, Artificial Sequence
  targeting sequence with ATCN PAM
uuguggaaagggggcugcua

SEQ ID NO: 769 - RNA, 20 nt, Artificial Sequence
  targeting sequence with ATCN PAM
ggguuuccuuaaaacaccuu

SEQ ID NO: 770 - RNA, 20 nt, Artificial Sequence
  targeting sequence with ATCN PAM
agaggguaguguauaacacc

SEQ ID NO: 771 - RNA, 20 nt, Artificial Sequence
  targeting sequence with ATCN PAM
caugggcuaaggaacagagg

SEQ ID NO: 772 - RNA, 20 nt, Artificial Sequence
  targeting sequence with ATCN PAM
gagucagaaccuagcaaaca

SEQ ID NO: 773 - RNA, 20 nt, Artificial Sequence
  targeting sequence with ATCN PAM
guguucuccaggcaucuggu

SEQ ID NO: 774 - RNA, 20 nt, Artificial Sequence
  targeting sequence with ATCN PAM
gguucauagucggagagcuc

SEQ ID NO: 775 - RNA, 20 nt, Artificial Sequence
  targeting sequence with ATCN PAM
guuuaauuggucagccuccc

SEQ ID NO: 776 - RNA, 20 nt, Artificial Sequence
  targeting sequence with ATCN PAM
cacaggaccaggcuuccugu

SEQ ID NO: 777 - RNA, 20 nt, Artificial Sequence
  targeting sequence with ATCN PAM
uuucaucccacaggaccagg

SEQ ID NO: 778 - RNA, 20 nt, Artificial Sequence
  targeting sequence with ATCN PAM
ccugaggucuuuucaggagg

SEQ ID NO: 779 - RNA, 20 nt, Artificial Sequence
  targeting sequence with ATCN PAM
ucccuccugaaaagaccuca

SEQ ID NO: 780 - RNA, 20 nt, Artificial Sequence
  targeting sequence with ATCN PAM
ugaccacuugcagccucugc

SEQ ID NO: 781 - RNA, 20 nt, Artificial Sequence
  targeting sequence with ATCN PAM
ccccauucaaaaugggcuga

SEQ ID NO: 782 - RNA, 20 nt, Artificial Sequence
  targeting sequence with ATCN PAM
gaaagcagcaaaacuagcuu

SEQ ID NO: 783 - RNA, 20 nt, Artificial Sequence
  targeting sequence with ATCN PAM
uaaaauugcagcccuugccu

SEQ ID NO: 784 - RNA, 20 nt, Artificial Sequence
  targeting sequence with ATCN PAM
cgccaagucuguggaaggca

SEQ ID NO: 785 - RNA, 20 nt, Artificial Sequence
  targeting sequence with ATCN PAM
guguuuaugcccucucagcu

SEQ ID NO: 786 - RNA, 20 nt, Artificial Sequence
  targeting sequence with ATCN PAM
uggcgacauggguagaaugc

SEQ ID NO: 787 - RNA, 20 nt, Artificial Sequence
  targeting sequence with ATCN PAM
guccaugcaucucucucucu

SEQ ID NO: 788 - RNA, 20 nt, Artificial Sequence
  targeting sequence with ATCN PAM
cucucucucuugcugugaug

SEQ ID NO: 789 - RNA, 20 nt, Artificial Sequence
  targeting sequence with ATCN PAM
cagcaagagagagagagaug

SEQ ID NO: 790 - RNA, 20 nt, Artificial Sequence
  targeting sequence with ATCN PAM
cgguuuuguuuuaccugauc

SEQ ID NO: 791 - RNA, 20 nt, Artificial Sequence
  targeting sequence with ATCN PAM
gguaaaacaaaaccgcgaug

SEQ ID NO: 792 - RNA, 20 nt, Artificial Sequence
  targeting sequence with ATCN PAM
caaaaugacugaugcaaccg

SEQ ID NO: 793 - RNA, 20 nt, Artificial Sequence
  targeting sequence with ATCN PAM
gucauuuugggaucagguaa

SEQ ID NO: 794 - RNA, 20 nt, Artificial Sequence
  targeting sequence with ATCN PAM
cgguugcaucagucauuuug

SEQ ID NO: 795 - RNA, 20 nt, Artificial Sequence
  targeting sequence with ATCN PAM
ugcaaagaacagcaaagaca

SEQ ID NO: 796 - RNA, 20 nt, Artificial Sequence
  targeting sequence with ATCN PAM
aauuuuggggauaaagccgc

SEQ ID NO: 797 - RNA, 20 nt, Artificial Sequence
  targeting sequence with ATCN PAM
ccaaaauuggaucaugcaaa

SEQ ID NO: 798 - RNA, 20 nt, Artificial Sequence
  targeting sequence with ATCN PAM
ugcgugcaggagguuauacc

SEQ ID NO: 799 - RNA, 20 nt, Artificial Sequence
  targeting sequence with ATCN PAM
ucgugcgugcaggagguuau

SEQ ID NO: 800 - RNA, 20 nt, Artificial Sequence
  targeting sequence with ATCN PAM
gcugccuucuuggcuucaaa

SEQ ID NO: 801 - RNA, 20 nt, Artificial Sequence
  targeting sequence with ATCN PAM
gaguacaagaccucaucagc

SEQ ID NO: 802 - RNA, 20 nt, Artificial Sequence
  targeting sequence with ATCN PAM
gcagcauugagguaaaaguu

SEQ ID NO: 803 - RNA, 20 nt, Artificial Sequence
  targeting sequence with ATCN PAM
uuuccagcagcgugaaaaug

SEQ ID NO: 804 - RNA, 20 nt, Artificial Sequence
  targeting sequence with ATCN PAM
ugaggcuuccuuagccaugu

SEQ ID NO: 805 - RNA, 20 nt, Artificial Sequence
  targeting sequence with ATCN PAM
uggcagaaggcaaggaagag

SEQ ID NO: 806 - RNA, 20 nt, Artificial Sequence
  targeting sequence with ATCN PAM
auauaagcugugacuugcuc

SEQ ID NO: 807 - RNA, 20 nt, Artificial Sequence
  targeting sequence with ATCN PAM
gaucucgugagacuuacuau

SEQ ID NO: 808 - RNA, 20 nt, Artificial Sequence
  targeting sequence with ATCN PAM
gaugguuuuaaaaagaggag

SEQ ID NO: 809 - RNA, 20 nt, Artificial Sequence
  targeting sequence with ATCN PAM
cgugagacuuacuaucauga

SEQ ID NO: 810 - RNA, 20 nt, Artificial Sequence
  targeting sequence with ATCN PAM
ugagaacagcaugggaaaga

SEQ ID NO: 811 - RNA, 20 nt, Artificial Sequence
  targeting sequence with ATCN PAM
uggggcaggucuuucccaug

SEQ ID NO: 812 - RNA, 20 nt, Artificial Sequence
  targeting sequence with ATCN PAM
ugaauucccauguguugugg

SEQ ID NO: 813 - RNA, 20 nt, Artificial Sequence
  targeting sequence with ATCN PAM
caucuugaauucccaugugu

SEQ ID NO: 814 - RNA, 20 nt, Artificial Sequence
  targeting sequence with ATCN PAM
ggguggggacacagccaaac

SEQ ID NO: 815 - RNA, 20 nt, Artificial Sequence
  targeting sequence with ATCN PAM
gcaggcaaaagcccugagga

SEQ ID NO: 816 - RNA, 20 nt, Artificial Sequence
  targeting sequence with ATCN PAM
gggccacagccuugcuccag

SEQ ID NO: 817 - RNA, 20 nt, Artificial Sequence
  targeting sequence with ATCN PAM
gccucagucaguuaccacgu

SEQ ID NO: 818 - RNA, 20 nt, Artificial Sequence
  targeting sequence with ATCN PAM
ggaacccaucugccucaguc

SEQ ID NO: 819 - RNA, 20 nt, Artificial Sequence
  targeting sequence with ATCN PAM
cuccaggguuggguuucuug

SEQ ID NO: 820 - RNA, 20 nt, Artificial Sequence
  targeting sequence with ATCN PAM
cuuuucacagacaagaaacc

SEQ ID NO: 821 - RNA, 20 nt, Artificial Sequence
  targeting sequence with ATCN PAM
ucacagcagccugugacgua

SEQ ID NO: 822 - RNA, 20 nt, Artificial Sequence
  targeting sequence with ATCN PAM
uccugguggcggauagcugg

SEQ ID NO: 823 - RNA, 20 nt, Artificial Sequence
  targeting sequence with ATCN PAM
gccaccaggaggaugcaaac

SEQ ID NO: 824 - RNA, 20 nt, Artificial Sequence
  targeting sequence with ATCN PAM
ucucagacuccaguaaucug

SEQ ID NO: 825 - RNA, 20 nt, Artificial Sequence
  targeting sequence with ATCN PAM
gauagcgcuggaggaguuuc

SEQ ID NO: 826 - RNA, 20 nt, Artificial Sequence
  targeting sequence with ATCN PAM
gauuacuggagucugagagg

SEQ ID NO: 827 - RNA, 20 nt, Artificial Sequence
  targeting sequence with ATCN PAM
aacccaauaggccugcagug

SEQ ID NO: 828 - RNA, 20 nt, Artificial Sequence
  targeting sequence with ATCN PAM
caggaccacacaccuugauu

SEQ ID NO: 829 - RNA, 20 nt, Artificial Sequence
  targeting sequence with ATCN PAM
aggugugugguccugggaug

SEQ ID NO: 830 - RNA, 20 nt, Artificial Sequence
  targeting sequence with ATCN PAM
gucugacuggugccggauga

SEQ ID NO: 831 - RNA, 20 nt, Artificial Sequence
  targeting sequence with ATCN PAM
ggcaccagucagaccgauau

SEQ ID NO: 832 - RNA, 20 nt, Artificial Sequence
  targeting sequence with ATCN PAM
ucaaaaagagaaccaagaaa

SEQ ID NO: 833 - RNA, 20 nt, Artificial Sequence
  targeting sequence with ATCN PAM
ugggcuucacaagggaucug

SEQ ID NO: 834 - RNA, 20 nt, Artificial Sequence
  targeting sequence with ATCN PAM
cuugugaagcccaagaucgu

SEQ ID NO: 835 - RNA, 20 nt, Artificial Sequence
  targeting sequence with ATCN PAM
gagggcagccaugaugccuu

SEQ ID NO: 836 - RNA, 20 nt, Artificial Sequence
  targeting sequence with ATCN PAM
uggcugcccucagaucccuu

SEQ ID NO: 837 - RNA, 20 nt, Artificial Sequence
  targeting sequence with ATCN PAM
uggaaggaggcuuucccgcc

SEQ ID NO: 838 - RNA, 20 nt, Artificial Sequence
  targeting sequence with ATCN PAM
ccagcuacggagcaagcugg

SEQ ID NO: 839 - RNA, 20 nt, Artificial Sequence
  targeting sequence with ATCN PAM
ggagacugccuaguauucug

SEQ ID NO: 840 - RNA, 20 nt, Artificial Sequence
  targeting sequence with ATCN PAM
caucuggagacugccuagua

SEQ ID NO: 841 - RNA, 20 nt, Artificial Sequence
  targeting sequence with ATCN PAM
caggaggucaagggucaccu

SEQ ID NO: 842 - RNA, 20 nt, Artificial Sequence
  targeting sequence with ATCN PAM
aaacugaccccaagacacuc

SEQ ID NO: 843 - RNA, 20 nt, Artificial Sequence
  targeting sequence with ATCN PAM
cacccugccagugucugaac

SEQ ID NO: 844 - RNA, 20 nt, Artificial Sequence
  targeting sequence with ATCN PAM
ggggguucagacacuggcag

SEQ ID NO: 845 - RNA, 20 nt, Artificial Sequence
  targeting sequence with ATCN PAM
acuugaacuggagucucagu

SEQ ID NO: 846 - RNA, 20 nt, Artificial Sequence
  targeting sequence with ATCN PAM
uaucccucuaaggaugccuc

SEQ ID NO: 847 - RNA, 20 nt, Artificial Sequence
  targeting sequence with ATCN PAM
cucuaaggaugccucaaacc

SEQ ID NO: 848 - RNA, 20 nt, Artificial Sequence
  targeting sequence with ATCN PAM
uuagagggauaugaugguuu

SEQ ID NO: 849 - RNA, 20 nt, Artificial Sequence
  targeting sequence with ATCN PAM
ccagguuugaggcauccuua

SEQ ID NO: 850 - RNA, 20 nt, Artificial Sequence
  targeting sequence with ATCN PAM
uccauuaucaacucacaacu

SEQ ID NO: 851 - RNA, 20 nt, Artificial Sequence
  targeting sequence with ATCN PAM
acucacaacuuccucagugu

SEQ ID NO: 852 - RNA, 20 nt, Artificial Sequence
  targeting sequence with ATCN PAM
guuggcacagaguggguacu

SEQ ID NO: 853 - RNA, 20 nt, Artificial Sequence
  targeting sequence with ATCN PAM
ugggccagaaggcaaaguug

SEQ ID NO: 854 - RNA, 20 nt, Artificial Sequence
  targeting sequence with ATCN PAM
uugaaggcaagggggaaguu

SEQ ID NO: 855 - RNA, 20 nt, Artificial Sequence
  targeting sequence with ATCN PAM
uuauauucccagagcuccug

SEQ ID NO: 856 - RNA, 20 nt, Artificial Sequence
  targeting sequence with ATCN PAM
ucaggagcucugggaauaua

SEQ ID NO: 857 - RNA, 20 nt, Artificial Sequence
  targeting sequence with ATCN PAM
aaaucucuguuaacaacuga

SEQ ID NO: 858 - RNA, 20 nt, Artificial Sequence
  targeting sequence with ATCN PAM
cuguuaacaacugagugagc

SEQ ID NO: 859 - RNA, 20 nt, Artificial Sequence
  targeting sequence with ATCN PAM
uuuuuuuuuuuuuuuuuuuu

SEQ ID NO: 860 - RNA, 20 nt, Artificial Sequence
  targeting sequence with ATCN PAM
guaagcacgguauaaaccga

SEQ ID NO: 861 - RNA, 20 nt, Artificial Sequence
  targeting sequence with ATCN PAM
cuuuuaaugcuaacgcuggu

SEQ ID NO: 862 - RNA, 20 nt, Artificial Sequence
  targeting sequence with ATCN PAM
caagacugacaaaacagacu

SEQ ID NO: 863 - RNA, 20 nt, Artificial Sequence
  targeting sequence with ATCN PAM
caugacagauugcaggcccu

SEQ ID NO: 864 - RNA, 20 nt, Artificial Sequence
  targeting sequence with ATCN PAM
gucaugugaugcuauacuag

SEQ ID NO: 865 - RNA, 20 nt, Artificial Sequence
  targeting sequence with ATCN PAM
acguccuguagugaaucccc

SEQ ID NO: 866 - RNA, 20 nt, Artificial Sequence
  targeting sequence with ATCN PAM
cccucccuuuccaggucuuc

SEQ ID NO: 867 - RNA, 20 nt, Artificial Sequence
  targeting sequence with ATCN PAM
uaaauguuucuuaccaggcc

SEQ ID NO: 868 - RNA, 20 nt, Artificial Sequence
  targeting sequence with ATCN PAM
acucucuuugaagcccgcua

SEQ ID NO: 869 - RNA, 20 nt, Artificial Sequence
  targeting sequence with ATCN PAM
gaacccaggcauuccuuuuu

SEQ ID NO: 870 - RNA, 20 nt, Artificial Sequence
  targeting sequence with ATCN PAM
acaaaaaggaaugccugggu

SEQ ID NO: 871 - RNA, 20 nt, Artificial Sequence
  targeting sequence with ATCN PAM
accaacagcccggaccaggc

SEQ ID NO: 872 - RNA, 20 nt, Artificial Sequence
  targeting sequence with ATCN PAM
ggcccuaugguccccuggua

SEQ ID NO: 873 - RNA, 20 nt, Artificial Sequence
  targeting sequence with ATCN PAM
gcguuccugcaggcuucauc

SEQ ID NO: 874 - RNA, 20 nt, Artificial Sequence
  targeting sequence with ATCN PAM
guggccaucugcguuccugc

SEQ ID NO: 875 - RNA, 20 nt, Artificial Sequence
  targeting sequence with ATCN PAM
cagaacuuuggaaggccgag

SEQ ID NO: 876 - RNA, 20 nt, Artificial Sequence
  targeting sequence with ATCN PAM
guccgccucggccuuccaaa

SEQ ID NO: 877 - RNA, 20 nt, Artificial Sequence
  targeting sequence with ATCN PAM
cuugaggucaggcguuccag

SEQ ID NO: 878 - RNA, 20 nt, Artificial Sequence
  targeting sequence with ATCN PAM
cuugaaccccggaagcggag

SEQ ID NO: 879 - RNA, 20 nt, Artificial Sequence
  targeting sequence with ATCN PAM
cagcuuacugcagccuccgc

SEQ ID NO: 880 - RNA, 20 nt, Artificial Sequence
  targeting sequence with ATCN PAM
caccacugcacuccagccug

SEQ ID NO: 881 - RNA, 20 nt, Artificial Sequence
  targeting sequence with ATCN PAM
cuucucucuuccuuggugcu

SEQ ID NO: 882 - RNA, 20 nt, Artificial Sequence
  targeting sequence with ATCN PAM
gccccggcgcucucucaucc

SEQ ID NO: 883 - RNA, 20 nt, Artificial Sequence
  targeting sequence with ATCN PAM
aagaauguaaaggaaaauuu

SEQ ID NO: 884 - RNA, 20 nt, Artificial Sequence
  targeting sequence with ATCN PAM
uaccugcccuuggcacuagu

SEQ ID NO: 885 - RNA, 20 nt, Artificial Sequence
  targeting sequence with ATCN PAM
acuuccgccagaaguugaag

SEQ ID NO: 886 - RNA, 20 nt, Artificial Sequence
  targeting sequence with ATCN PAM
agcguuugggcuauuuccgc

SEQ ID NO: 887 - RNA, 20 nt, Artificial Sequence
  targeting sequence with ATCN PAM
cuccugaccgcuaggaagcg

SEQ ID NO: 888 - RNA, 20 nt, Artificial Sequence
  targeting sequence with ATCN PAM
agaccgacuucccaaaauuc

SEQ ID NO: 889 - RNA, 20 nt, Artificial Sequence
  targeting sequence with ATCN PAM
cuauuuacuauguaaauuca

SEQ ID NO: 890 - RNA, 20 nt, Artificial Sequence
  targeting sequence with ATCN PAM
uacguuagcgguuccggucu

SEQ ID NO: 891 - RNA, 20 nt, Artificial Sequence
  targeting sequence with ATCN PAM
ccaaaauucuccuuccacau

SEQ ID NO: 892 - RNA, 20 nt, Artificial Sequence
  targeting sequence with ATCN PAM
cuuaagaccagccuggccaa

SEQ ID NO: 893 - RNA, 20 nt, Artificial Sequence
  targeting sequence with ATCN PAM
cucgccucagccuccugagu

SEQ ID NO: 894 - RNA, 20 nt, Artificial Sequence
  targeting sequence with ATCN PAM
ccgcuacucaggaggcugag

SEQ ID NO: 895 - RNA, 20 nt, Artificial Sequence
  targeting sequence with ATCN PAM
agaacaagcuuaaaaauuag

SEQ ID NO: 896 - RNA, 20 nt, Artificial Sequence
  targeting sequence with ATCN PAM
ugccacuccacugcacucca

SEQ ID NO: 897 - RNA, 20 nt, Artificial Sequence
  targeting sequence with ATCN PAM
cggcucacugcaacuucugc

SEQ ID NO: 898 - RNA, 20 nt, Artificial Sequence
  targeting sequence with ATCN PAM
cuugucccuugaaccuggga

SEQ ID NO: 899 - RNA, 20 nt, Artificial Sequence
  targeting sequence with ATCN PAM
cagcuacuacggagccugag

SEQ ID NO: 900 - RNA, 20 nt, Artificial Sequence
  targeting sequence with ATCN PAM
ccugaggucaggaguuugag

SEQ ID NO: 901 - RNA, 20 nt, Artificial Sequence
  targeting sequence with ATCN PAM
gcccaccuuggccucccaaa

SEQ ID NO: 902 - RNA, 20 nt, Artificial Sequence
  targeting sequence with ATCN PAM
cagcauuuugggaggccaag

SEQ ID NO: 903 - RNA, 20 nt, Artificial Sequence
  targeting sequence with ATCN PAM
aacuccacaaggaaggaagg

SEQ ID NO: 904 - RNA, 20 nt, Artificial Sequence
  targeting sequence with ATCN PAM
ucuaacuccacaaggaagga

SEQ ID NO: 905 - RNA, 20 nt, Artificial Sequence
  targeting sequence with ATCN PAM
aggccaauggggcuuuaggg

SEQ ID NO: 906 - RNA, 20 nt, Artificial Sequence
  targeting sequence with ATCN PAM
ucauauguaaaggggccuag

SEQ ID NO: 907 - RNA, 20 nt, Artificial Sequence
  targeting sequence with ATCN PAM
gacaggccuucgguuaaaug

SEQ ID NO: 908 - RNA, 20 nt, Artificial Sequence
  targeting sequence with ATCN PAM
cuacagggcccugcuguguc

SEQ ID NO: 909 - RNA, 20 nt, Artificial Sequence
  targeting sequence with ATCN PAM
ggccagcugggcucuccucc

SEQ ID NO: 910 - RNA, 20 nt, Artificial Sequence
  targeting sequence with ATCN PAM
cugcagaggcaggggcgcgg

SEQ ID NO: 911 - RNA, 20 nt, Artificial Sequence
  targeting sequence with ATCN PAM
gugggugacugcagaggaac

SEQ ID NO: 912 - RNA, 20 nt, Artificial Sequence
  targeting sequence with ATCN PAM
ggguagcucaggcuuuggag

SEQ ID NO: 913 - RNA, 20 nt, Artificial Sequence
  targeting sequence with ATCN PAM
uccuaugagcugcaagccca

SEQ ID NO: 914 - RNA, 20 nt, Artificial Sequence
  targeting sequence with ATCN PAM
gcaaagaccagcccaugagc

SEQ ID NO: 915 - RNA, 20 nt, Artificial Sequence
  targeting sequence with ATCN PAM
ggcccaccagcuguuuuuau

SEQ ID NO: 916 - RNA, 20 nt, Artificial Sequence
  targeting sequence with ATCN PAM
agguuugagugcaguggugu

SEQ ID NO: 917 - RNA, 20 nt, Artificial Sequence
  targeting sequence with ATCN PAM
ccccccaaaaauauauauac

SEQ ID NO: 918 - RNA, 20 nt, Artificial Sequence
  targeting sequence with ATCN PAM
ucccacuucagcuuccugag

SEQ ID NO: 919 - RNA, 20 nt, Artificial Sequence
  targeting sequence with ATCN PAM
uagcuuacugcagccucaaa

SEQ ID NO: 920 - RNA, 20 nt, Artificial Sequence
  targeting sequence with ATCN PAM
caccugugaauagccacuuc

SEQ ID NO: 921 - RNA, 20 nt, Artificial Sequence
  targeting sequence with ATCN PAM
aacauaaggagacucaugca

SEQ ID NO: 922 - RNA, 20 nt, Artificial Sequence
  targeting sequence with ATCN PAM
acacauauccaacauaagga

SEQ ID NO: 923 - RNA, 20 nt, Artificial Sequence
  targeting sequence with ATCN PAM
aucuacacauauccaacaua

SEQ ID NO: 924 - RNA, 20 nt, Artificial Sequence
  targeting sequence with ATCN PAM
auccaucuacacauauccaa

SEQ ID NO: 925 - RNA, 20 nt, Artificial Sequence
  targeting sequence with ATCN PAM
auccauccaucuacacauau

SEQ ID NO: 926 - RNA, 20 nt, Artificial Sequence
  targeting sequence with ATCN PAM
aucuauccauccaucuacac

SEQ ID NO: 927 - RNA, 20 nt, Artificial Sequence
  targeting sequence with ATCN PAM
aucuaucuauccauccaucu

SEQ ID NO: 928 - RNA, 20 nt, Artificial Sequence
  targeting sequence with ATCN PAM
aucuaucuaucuauccaucc

SEQ ID NO: 929 - RNA, 20 nt, Artificial Sequence
  targeting sequence with ATCN PAM
aucuaucuaucuaucuaucc

SEQ ID NO: 930 - RNA, 20 nt, Artificial Sequence
  targeting sequence with ATCN PAM
aucuaucuaucuaucuaucu

SEQ ID NO: 931 - RNA, 20 nt, Artificial Sequence
  targeting sequence with ATCN PAM
aucuaucuaucuaucuaucu

SEQ ID NO: 932 - RNA, 20 nt, Artificial Sequence
  targeting sequence with ATCN PAM
aucuaucuaucuaucuaucu

SEQ ID NO: 933 - RNA, 20 nt, Artificial Sequence
  targeting sequence with ATCN PAM
aucuaucuaucuaucuaucu

SEQ ID NO: 934 - RNA, 20 nt, Artificial Sequence
  targeting sequence with ATCN PAM
aucuaucuaucuaucuaucu

SEQ ID NO: 935 - RNA, 20 nt, Artificial Sequence
  targeting sequence with ATCN PAM
aucuaucuaucuaucuaucu

SEQ ID NO: 936 - RNA, 20 nt, Artificial Sequence
  targeting sequence with ATCN PAM
ggucggucggucagucuguc

SEQ ID NO: 937 - RNA, 20 nt, Artificial Sequence
  targeting sequence with ATCN PAM
ccucauucccuuggcuuccc

SEQ ID NO: 938 - RNA, 20 nt, Artificial Sequence
  targeting sequence with ATCN PAM
ggccucagcugccuucccac

SEQ ID NO: 939 - RNA, 20 nt, Artificial Sequence
  targeting sequence with ATCN PAM
uaccccagggccuuugccuu

SEQ ID NO: 940 - RNA, 20 nt, Artificial Sequence
  targeting sequence with ATCN PAM
gccuagauugugcuuccccc

SEQ ID NO: 941 - RNA, 20 nt, Artificial Sequence
  targeting sequence with ATCN PAM
aggcagauagaacugugaag

SEQ ID NO: 942 - RNA, 20 nt, Artificial Sequence
  targeting sequence with ATCN PAM
cucagaugucagcuccaaug

SEQ ID NO: 943 - RNA, 20 nt, Artificial Sequence
  targeting sequence with ATCN PAM
gagugauugacaggaacuag

SEQ ID NO: 944 - RNA, 20 nt, Artificial Sequence
  targeting sequence with ATCN PAM
aaagcuggggcuuuggcugg

SEQ ID NO: 945 - RNA, 20 nt, Artificial Sequence
  targeting sequence with ATCN PAM
uuguugagcaacuacuaugu

SEQ ID NO: 946 - RNA, 20 nt, Artificial Sequence
  targeting sequence with ATCN PAM
cauugucccugcccugguuc

SEQ ID NO: 947 - RNA, 20 nt, Artificial Sequence
  targeting sequence with ATCN PAM
ucucaagcugaaauaauauc

SEQ ID NO: 948 - RNA, 20 nt, Artificial Sequence
  targeting sequence with ATCN PAM
ugaccuuaccaccuucuauu

SEQ ID NO: 949 - RNA, 20 nt, Artificial Sequence
  targeting sequence with ATCN PAM
ugaccucugcggacauaaag

SEQ ID NO: 950 - RNA, 20 nt, Artificial Sequence
  targeting sequence with ATCN PAM
uuuauguccgcagaggucag

SEQ ID NO: 951 - RNA, 20 nt, Artificial Sequence
  targeting sequence with ATCN PAM
caguuuauccuuuauguccg

SEQ ID NO: 952 - RNA, 20 nt, Artificial Sequence
  targeting sequence with ATCN PAM
uucugcaagaaugaagaaga

SEQ ID NO: 953 - RNA, 20 nt, Artificial Sequence
  targeting sequence with ATCN PAM
gggacaaacaccgccacuuu

SEQ ID NO: 954 - RNA, 20 nt, Artificial Sequence
  targeting sequence with ATCN PAM
cuucucuucuaacuauaagc

SEQ ID NO: 955 - RNA, 20 nt, Artificial Sequence
  targeting sequence with ATCN PAM
uagugcaccugaagggaaag

SEQ ID NO: 956 - RNA, 20 nt, Artificial Sequence
  targeting sequence with ATCN PAM
cccaagucugcuuuuagcuu

SEQ ID NO: 957 - RNA, 20 nt, Artificial Sequence
  targeting sequence with ATCN PAM
uucugcagcugcaggcauau

SEQ ID NO: 958 - RNA, 20 nt, Artificial Sequence
  targeting sequence with ATCN PAM
gggaggcagaguugcguguc

SEQ ID NO: 959 - RNA, 20 nt, Artificial Sequence
  targeting sequence with ATCN PAM
gaggcuuggacugcuucucu

SEQ ID NO: 960 - RNA, 20 nt, Artificial Sequence
  targeting sequence with ATCN PAM
uuaaaaacucuuagucugua

SEQ ID NO: 961 - RNA, 20 nt, Artificial Sequence
  targeting sequence with ATCN PAM
uacccacuauugcucaccag

SEQ ID NO: 962 - RNA, 20 nt, Artificial Sequence
  targeting sequence with ATCN PAM
cugaguucuuuuucccuggu

SEQ ID NO: 963 - RNA, 20 nt, Artificial Sequence
  targeting sequence with ATCN PAM
cugcugcgaauaugcaucac

SEQ ID NO: 964 - RNA, 20 nt, Artificial Sequence
  targeting sequence with ATCN PAM
cagcacacuguggucauuga

SEQ ID NO: 965 - RNA, 20 nt, Artificial Sequence
  targeting sequence with ATCN PAM
guguagcuggcugugaguca

SEQ ID NO: 966 - RNA, 20 nt, Artificial Sequence
  targeting sequence with ATCN PAM
uuaucuguguagcuggcugu

SEQ ID NO: 967 - RNA, 20 nt, Artificial Sequence
  targeting sequence with ATCN PAM
gagggaaagcagcccaacuu

SEQ ID NO: 968 - RNA, 20 nt, Artificial Sequence
  targeting sequence with ATCN PAM
ccuuuauguccagcacauuu

SEQ ID NO: 969 - RNA, 20 nt, Artificial Sequence
  targeting sequence with ATCN PAM
ccucccaagcagggucucug

SEQ ID NO: 970 - RNA, 20 nt, Artificial Sequence
  targeting sequence with ATCN PAM
ccuggaggacugaggaaugg

SEQ ID NO: 971 - RNA, 20 nt, Artificial Sequence
  targeting sequence with ATCN PAM
auuccucaguccuccaggag

SEQ ID NO: 972 - RNA, 20 nt, Artificial Sequence
  targeting sequence with ATCN PAM
ucacuggaguggcucauuug

SEQ ID NO: 973 - RNA, 20 nt, Artificial Sequence
  targeting sequence with ATCN PAM
ggggugaggccguuggaguu

SEQ ID NO: 974 - RNA, 20 nt, Artificial Sequence
  targeting sequence with ATCN PAM
uuaccauuguuaggaaaccc

SEQ ID NO: 975 - RNA, 20 nt, Artificial Sequence
  targeting sequence with ATCN PAM
caugcauguuuggggcuucc

SEQ ID NO: 976 - RNA, 20 nt, Artificial Sequence
  targeting sequence with ATCN PAM
accagguuggcaggaacuua

SEQ ID NO: 977 - RNA, 20 nt, Artificial Sequence
  targeting sequence with ATCN PAM
ugcucuguucccaucuacca

SEQ ID NO: 978 - RNA, 20 nt, Artificial Sequence
  targeting sequence with ATCN PAM
uaguaccauucuuguaguaa

SEQ ID NO: 979 - RNA, 20 nt, Artificial Sequence
  targeting sequence with ATCN PAM
guccagacaaggcacagagg

SEQ ID NO: 980 - RNA, 20 nt, Artificial Sequence
  targeting sequence with ATCN PAM
gccaagcaauacauuugugg

SEQ ID NO: 981 - RNA, 20 nt, Artificial Sequence
  targeting sequence with ATCN PAM
gggguauuauggcaggguug

SEQ ID NO: 982 - RNA, 20 nt, Artificial Sequence
  targeting sequence with ATCN PAM
auaagcuauggauuaauagu

SEQ ID NO: 983 - RNA, 20 nt, Artificial Sequence
  targeting sequence with ATCN PAM
auagcuuauugauaaaauuc

SEQ ID NO: 984 - RNA, 20 nt, Artificial Sequence
  targeting sequence with ATCN PAM
uccucuaagaacaagggcug

SEQ ID NO: 985 - RNA, 20 nt, Artificial Sequence
  targeting sequence with ATCN PAM
acuccuuaguuaaucucugg

SEQ ID NO: 986 - RNA, 20 nt, Artificial Sequence
  targeting sequence with ATCN PAM
cugggccugaaaauuuccag

SEQ ID NO: 987 - RNA, 20 nt, Artificial Sequence
  targeting sequence with ATCN PAM
ugugccuccaccuccccguc

SEQ ID NO: 988 - RNA, 20 nt, Artificial Sequence
  targeting sequence with ATCN PAM
uggccaauaccuacaagcag

SEQ ID NO: 989 - RNA, 20 nt, Artificial Sequence
  targeting sequence with ATCN PAM
auggugaugguguugugcuu

SEQ ID NO: 990 - RNA, 20 nt, Artificial Sequence
  targeting sequence with ATCN PAM
ccauggauauccuggccaau

SEQ ID NO: 991 - RNA, 20 nt, Artificial Sequence
  targeting sequence with ATCN PAM
accucagcucucuugggaag

SEQ ID NO: 992 - RNA, 20 nt, Artificial Sequence
  targeting sequence with ATCN PAM
cuauauccuccaccucuugg

SEQ ID NO: 993 - RNA, 20 nt, Artificial Sequence
  targeting sequence with ATCN PAM
uccaccucuugguucuucag

SEQ ID NO: 994 - RNA, 20 nt, Artificial Sequence
  targeting sequence with ATCN PAM
guuuucucacacauguuuua

SEQ ID NO: 995 - RNA, 20 nt, Artificial Sequence
  targeting sequence with ATCN PAM
cagucaacucccuaaaguug

SEQ ID NO: 996 - RNA, 20 nt, Artificial Sequence
  targeting sequence with ATCN PAM
caacuuaaaagaaacccaaa

SEQ ID NO: 997 - RNA, 20 nt, Artificial Sequence
  targeting sequence with ATCN PAM
ugcucugucacccaggcugg

SEQ ID NO: 998 - RNA, 20 nt, Artificial Sequence
  targeting sequence with ATCN PAM
caccacuacacuccagccug

SEQ ID NO: 999 - RNA, 20 nt, Artificial Sequence
  targeting sequence with ATCN PAM
uagcucacugcagccucuaa

SEQ ID NO: 1000 - RNA, 20 nt, Artificial Sequence
  targeting sequence with ATCN PAM
cuugagcccgggaguuagag

SEQ ID NO: 1001 - RNA, 20 nt, Artificial Sequence
  targeting sequence with ATCN PAM
ucccaucugacccucccaug

SEQ ID NO: 1002 - RNA, 20 nt, Artificial Sequence
  targeting sequence with ATCN PAM
gacccucccauguagcuggg

SEQ ID NO: 1003 - RNA, 20 nt, Artificial Sequence
  targeting sequence with ATCN PAM
caguguggugguacacaccu

SEQ ID NO: 1004 - RNA, 20 nt, Artificial Sequence
  targeting sequence with ATCN PAM
cuacaaaaaauuaaaaaacu

SEQ ID NO: 1005 - RNA, 20 nt, Artificial Sequence
  targeting sequence with ATCN PAM
gccuggguaacacagugaga

SEQ ID NO: 1006 - RNA, 20 nt, Artificial Sequence
  targeting sequence with ATCN PAM
caagcucuuggccucaagca

SEQ ID NO: 1007 - RNA, 20 nt, Artificial Sequence
  targeting sequence with ATCN PAM
cccaacacuuuggaaggcca

SEQ ID NO: 1008 - RNA, 20 nt, Artificial Sequence
  targeting sequence with ATCN PAM
ugcauucaaaauguauaaaa

SEQ ID NO: 1009 - RNA, 20 nt, Artificial Sequence
  targeting sequence with ATCN PAM
agacuaggguuagcaaguua

SEQ ID NO: 1010 - RNA, 20 nt, Artificial Sequence
  targeting sequence with ATCN PAM
gacuuuuuauagaaaaagcu

SEQ ID NO: 1011 - RNA, 20 nt, Artificial Sequence
  targeting sequence with ATCN PAM
cagcacuuugggaggcugag

SEQ ID NO: 1012 - RNA, 20 nt, Artificial Sequence
  targeting sequence with ATCN PAM
accugccucagccucccaaa

SEQ ID NO: 1013 - RNA, 20 nt, Artificial Sequence
  targeting sequence with ATCN PAM
caaggucaagagaucaagac

SEQ ID NO: 1014 - RNA, 20 nt, Artificial Sequence
  targeting sequence with ATCN PAM
cuugaccuugugauccaccu

SEQ ID NO: 1015 - RNA, 20 nt, Artificial Sequence
  targeting sequence with ATCN PAM
agaccauccuggccaacaug

SEQ ID NO: 1016 - RNA, 20 nt, Artificial Sequence
  targeting sequence with ATCN PAM
uggccaacauggugaaaccc

SEQ ID NO: 1017 - RNA, 20 nt, Artificial Sequence
  targeting sequence with ATCN PAM
uggcucacugcaaccuccgc

SEQ ID NO: 1018 - RNA, 20 nt, Artificial Sequence
  targeting sequence with ATCN PAM
caccaccgcacuccagccug

SEQ ID NO: 1019 - RNA, 20 nt, Artificial Sequence
  targeting sequence with ATCN PAM
gagguuuuuuguuuuuaguu

SEQ ID NO: 1020 - RNA, 20 nt, Artificial Sequence
  targeting sequence with ATCN PAM
uugaauugucuauggcugcu

SEQ ID NO: 1021 - RNA, 20 nt, Artificial Sequence
  targeting sequence with ATCN PAM
gccuagcagaggucugcaaa

SEQ ID NO: 1022 - RNA, 20 nt, Artificial Sequence
  targeting sequence with ATCN PAM
uggaaaguuguaucggccua

SEQ ID NO: 1023 - RNA, 20 nt, Artificial Sequence
  targeting sequence with ATCN PAM
ucauggaaaguuguaucggc

SEQ ID NO: 1024 - RNA, 20 nt, Artificial Sequence
  targeting sequence with ATCN PAM
gugcaguccaguagaggagc

SEQ ID NO: 1025 - RNA, 20 nt, Artificial Sequence
  targeting sequence with ATCN PAM
caccagccacauauuuugag

SEQ ID NO: 1026 - RNA, 20 nt, Artificial Sequence
  targeting sequence with ATCN PAM
agucuuucaaucacaccagc

SEQ ID NO: 1027 - RNA, 20 nt, Artificial Sequence
  targeting sequence with ATCN PAM
auuauaaauuuaaaaaucca

SEQ ID NO: 1028 - RNA, 20 nt, Artificial Sequence
  targeting sequence with ATCN PAM
ccaggagcucguuagaaaua

SEQ ID NO: 1029 - RNA, 20 nt, Artificial Sequence
  targeting sequence with ATCN PAM
uuugaugacccacagaugug

SEQ ID NO: 1030 - RNA, 20 nt, Artificial Sequence
  targeting sequence with ATCN PAM
aaagaugcuguauuucuaac

SEQ ID NO: 1031 - RNA, 20 nt, Artificial Sequence
  targeting sequence with ATCN PAM
gugggucaucaaaagaugcu

SEQ ID NO: 1032 - RNA, 20 nt, Artificial Sequence
  targeting sequence with ATCN PAM
gagaaagcugguagaguguc

SEQ ID NO: 1033 - RNA, 20 nt, Artificial Sequence
  targeting sequence with ATCN PAM
uaguuuuggggucugcugug

SEQ ID NO: 1034 - RNA, 20 nt, Artificial Sequence
  targeting sequence with ATCN PAM
cugucuugcacagcagaccc

SEQ ID NO: 1035 - RNA, 20 nt, Artificial Sequence
  targeting sequence with ATCN PAM
gccccgcaccagucugaccu

SEQ ID NO: 1036 - RNA, 20 nt, Artificial Sequence
  targeting sequence with ATCN PAM
ucaauaucugccccgcacca

SEQ ID NO: 1037 - RNA, 20 nt, Artificial Sequence
  targeting sequence with ATCN PAM
gauuuggccacaaguuaauc

SEQ ID NO: 1038 - RNA, 20 nt, Artificial Sequence
  targeting sequence with ATCN PAM
gauccucaauaucugccccg

SEQ ID NO: 1039 - RNA, 20 nt, Artificial Sequence
  targeting sequence with ATCN PAM
auauuuucuagccuuaauaa

SEQ ID NO: 1040 - RNA, 20 nt, Artificial Sequence
  targeting sequence with ATCN PAM
ugcccacuuaggcccaucca

SEQ ID NO: 1041 - RNA, 20 nt, Artificial Sequence
  targeting sequence with ATCN PAM
agagaaagcagguggcacuu

SEQ ID NO: 1042 - RNA, 20 nt, Artificial Sequence
  targeting sequence with ATCN PAM
cggcuguaaaggcaguaagu

SEQ ID NO: 1043 - RNA, 20 nt, Artificial Sequence
  targeting sequence with ATCN PAM
ccagggaggaguucaucgcg

SEQ ID NO: 1044 - RNA, 20 nt, Artificial Sequence
  targeting sequence with ATCN PAM
ccaggaucuugaucuugcgg

SEQ ID NO: 1045 - RNA, 20 nt, Artificial Sequence
  targeting sequence with ATCN PAM
uggagauauuucacaaggug

SEQ ID NO: 1046 - RNA, 20 nt, Artificial Sequence
  targeting sequence with ATCN PAM
ugaucuugcggcuaugcagg

SEQ ID NO: 1047 - RNA, 20 nt, Artificial Sequence
  targeting sequence with ATCN PAM
agauccuggagauauuucac

SEQ ID NO: 1048 - RNA, 20 nt, Artificial Sequence
  targeting sequence with ATCN PAM
ugcggcuaugcagguaggag

SEQ ID NO: 1049 - RNA, 20 nt, Artificial Sequence
  targeting sequence with ATCN PAM
ggcgggacagccgggagagc

SEQ ID NO: 1050 - RNA, 20 nt, Artificial Sequence
  targeting sequence with ATCN PAM
gccuggccugucuccuuuga

SEQ ID NO: 1051 - RNA, 20 nt, Artificial Sequence
  targeting sequence with ATCN PAM
ugcuauuuagagcugcucgu

SEQ ID NO: 1052 - RNA, 20 nt, Artificial Sequence
  targeting sequence with ATCN PAM
gaaaaacacaaggcuugggc

SEQ ID NO: 1053 - RNA, 20 nt, Artificial Sequence
  targeting sequence with ATCN PAM
acaucucuccugucaaacca

SEQ ID NO: 1054 - RNA, 20 nt, Artificial Sequence
  targeting sequence with ATCN PAM
cuccugucaaaccagucagu

SEQ ID NO: 1055 - RNA, 20 nt, Artificial Sequence
  targeting sequence with ATCN PAM
cacuggucuggucucucagu

SEQ ID NO: 1056 - RNA, 20 nt, Artificial Sequence
  targeting sequence with ATCN PAM
guuguucaggaaacugccuu

SEQ ID NO: 1057 - RNA, 20 nt, Artificial Sequence
  targeting sequence with ATCN PAM
auuuaauuuucaaauuauac

SEQ ID NO: 1058 - RNA, 20 nt, Artificial Sequence
  targeting sequence with ATCN PAM
aauggauacugggguggaau

SEQ ID NO: 1059 - RNA, 20 nt, Artificial Sequence
  targeting sequence with ATCN PAM
auuugauaaccuaaugugaa

SEQ ID NO: 1060 - RNA, 20 nt, Artificial Sequence
  targeting sequence with ATCN PAM
acaauuccuaagagcuagug

SEQ ID NO: 1061 - RNA, 20 nt, Artificial Sequence
  targeting sequence with ATCN PAM
gccuugcuaaagcuaggggc

SEQ ID NO: 1062 - RNA, 20 nt, Artificial Sequence
  targeting sequence with ATCN PAM
auaauacaaagcaaauuucu

SEQ ID NO: 1063 - RNA, 20 nt, Artificial Sequence
  targeting sequence with ATCN PAM
ucugauuauauuucaucauu

SEQ ID NO: 1064 - RNA, 20 nt, Artificial Sequence
  targeting sequence with ATCN PAM
gaagaugaaaaauaguucua

SEQ ID NO: 1065 - RNA, 20 nt, Artificial Sequence
  targeting sequence with ATCN PAM
uuggaaaagccguauuuuuu

SEQ ID NO: 1066 - RNA, 20 nt, Artificial Sequence
  targeting sequence with ATCN PAM
aaaaaaaauacggcuuuucc

SEQ ID NO: 1067 - RNA, 20 nt, Artificial Sequence
  targeting sequence with ATCN PAM
caaaacauguucaaacacau

SEQ ID NO: 1068 - RNA, 20 nt, Artificial Sequence
  targeting sequence with ATCN PAM
uugcuacugaauguguuuga

SEQ ID NO: 1069 - RNA, 20 nt, Artificial Sequence
  targeting sequence with ATCN PAM
accauuggcacacacauuaa

SEQ ID NO: 1070 - RNA, 20 nt, Artificial Sequence
  targeting sequence with ATCN PAM
guuaugcauagcuuugcacu

SEQ ID NO: 1071 - RNA, 20 nt, Artificial Sequence
  targeting sequence with ATCN PAM
uaaacucugcagcuuucaag

SEQ ID NO: 1072 - RNA, 20 nt, Artificial Sequence
  targeting sequence with ATCN PAM
ugaaaaauuaagucuaucuu

SEQ ID NO: 1073 - RNA, 20 nt, Artificial Sequence
  targeting sequence with ATCN PAM
ugacuggcuuugggaaaauc

SEQ ID NO: 1074 - RNA, 20 nt, Artificial Sequence
  targeting sequence with ATCN PAM
uauguuucuuccaggugcac

SEQ ID NO: 1075 - RNA, 20 nt, Artificial Sequence
  targeting sequence with ATCN PAM
cuaagccugacgugguuuuc

SEQ ID NO: 1076 - RNA, 20 nt, Artificial Sequence
  targeting sequence with ATCN PAM
ccagugguuugucaccucug

SEQ ID NO: 1077 - RNA, 20 nt, Artificial Sequence
  targeting sequence with ATCN PAM
auaauucagcacauuugguc

SEQ ID NO: 1078 - RNA, 20 nt, Artificial Sequence
  targeting sequence with ATCN PAM
caugaagcucaauuggauac

SEQ ID NO: 1079 - RNA, 20 nt, Artificial Sequence
  targeting sequence with ATCN PAM
aauugagcuucaugggauug

SEQ ID NO: 1080 - RNA, 20 nt, Artificial Sequence
  targeting sequence with ATCN PAM
gaagaauacaacaucccaca

SEQ ID NO: 1081 - RNA, 20 nt, Artificial Sequence
  targeting sequence with ATCN PAM
cacauuaucaggucagcuuc

SEQ ID NO: 1082 - RNA, 20 nt, Artificial Sequence
  targeting sequence with ATCN PAM
ggucagcuucuaaagacacc

SEQ ID NO: 1083 - RNA, 20 nt, Artificial Sequence
  targeting sequence with ATCN PAM
ucgggcaaaaaccauuguca

SEQ ID NO: 1084 - RNA, 20 nt, Artificial Sequence
  targeting sequence with ATCN PAM
uagagaccaagagguuuaag

SEQ ID NO: 1085 - RNA, 20 nt, Artificial Sequence
  targeting sequence with ATCN PAM
cuccagucugcgguucuugc

SEQ ID NO: 1086 - RNA, 20 nt, Artificial Sequence
  targeting sequence with ATCN PAM
uucagcugagguagcaagaa

SEQ ID NO: 1087 - RNA, 20 nt, Artificial Sequence
  targeting sequence with ATCN PAM
uucaguuacuuuuacuuccc

SEQ ID NO: 1088 - RNA, 20 nt, Artificial Sequence
  targeting sequence with ATCN PAM
gcccaccuggagucuuguaa

SEQ ID NO: 1089 - RNA, 20 nt, Artificial Sequence
  targeting sequence with ATCN PAM
ugcaaggccaguuuucagca

SEQ ID NO: 1090 - RNA, 20 nt, Artificial Sequence
  targeting sequence with ATCN PAM
uuuaaaagcuaaucaugcaa

SEQ ID NO: 1091 - RNA, 20 nt, Artificial Sequence
  targeting sequence with ATCN PAM
gaucagcagauaaugagagu

SEQ ID NO: 1092 - RNA, 20 nt, Artificial Sequence
  targeting sequence with ATCN PAM
gaucauuuaaaagcuaauca

SEQ ID NO: 1093 - RNA, 20 nt, Artificial Sequence
  targeting sequence with ATCN PAM
gcagauaaugagaguagaag

SEQ ID NO: 1094 - RNA, 20 nt, Artificial Sequence
  targeting sequence with ATCN PAM
gcugaucugaucauuuaaaa

SEQ ID NO: 1095 - RNA, 20 nt, Artificial Sequence
  targeting sequence with ATCN PAM
guuaacguuucuccacccuc

SEQ ID NO: 1096 - RNA, 20 nt, Artificial Sequence
  targeting sequence with ATCN PAM
gugaaaaucaguuaacguuu

SEQ ID NO: 1097 - RNA, 20 nt, Artificial Sequence
  targeting sequence with ATCN PAM
ucagugaaaaucaguuaacg

SEQ ID NO: 1098 - RNA, 20 nt, Artificial Sequence
  targeting sequence with ATCN PAM
aaaagaauuuggaaguauaa

SEQ ID NO: 1099 - RNA, 20 nt, Artificial Sequence
  targeting sequence with ATCN PAM
accucuuuauucuaaaaggu

SEQ ID NO: 1100 - RNA, 20 nt, Artificial Sequence
  targeting sequence with ATCN PAM
uugucuuaguagagacagug

SEQ ID NO: 1101 - RNA, 20 nt, Artificial Sequence
  targeting sequence with ATCN PAM
ucuuugucuuaguagagaca

SEQ ID NO: 1102 - RNA, 20 nt, Artificial Sequence
  targeting sequence with ATCN PAM
ccaaaccugagguccgauug

SEQ ID NO: 1103 - RNA, 20 nt, Artificial Sequence
  targeting sequence with ATCN PAM
gaccucagguuuggggauua

SEQ ID NO: 1104 - RNA, 20 nt, Artificial Sequence
  targeting sequence with ATCN PAM
cuacuauauuucucaaucgg

SEQ ID NO: 1105 - RNA, 20 nt, Artificial Sequence
  targeting sequence with ATCN PAM
auggaagcuucucaucgcua

SEQ ID NO: 1106 - RNA, 20 nt, Artificial Sequence
  targeting sequence with ATCN PAM
ugaaaaaguguuucuugaac

SEQ ID NO: 1107 - RNA, 20 nt, Artificial Sequence
  targeting sequence with ATCN PAM
cguucaagaaacacuuuuuc

SEQ ID NO: 1108 - RNA, 20 nt, Artificial Sequence
  targeting sequence with ATCN PAM
gaauugaaaacccaaaaugg

SEQ ID NO: 1109 - RNA, 20 nt, Artificial Sequence
  targeting sequence with ATCN PAM
gaacagcaaauucuaauucc

SEQ ID NO: 1110 - RNA, 20 nt, Artificial Sequence
  targeting sequence with ATCN PAM
cuuucccaaucagaacagca

SEQ ID NO: 1111 - RNA, 20 nt, Artificial Sequence
  targeting sequence with ATCN PAM
guguucgugggaugguaucu

SEQ ID NO: 1112 - RNA, 20 nt, Artificial Sequence
  targeting sequence with ATCN PAM
cacgaacacagauagaaaga

SEQ ID NO: 1113 - RNA, 20 nt, Artificial Sequence
  targeting sequence with ATCN PAM
ucugaaaaggaaaaguaaac

SEQ ID NO: 1114 - RNA, 20 nt, Artificial Sequence
  targeting sequence with ATCN PAM
aacuaaugacccaugaacuu

SEQ ID NO: 1115 - RNA, 20 nt, Artificial Sequence
  targeting sequence with ATCN PAM
ccacuuuacagauaaggaca

SEQ ID NO: 1116 - RNA, 20 nt, Artificial Sequence
  targeting sequence with ATCN PAM
guaaaguggagauaaaaaua

SEQ ID NO: 1117 - RNA, 20 nt, Artificial Sequence
  targeting sequence with ATCN PAM
ugagcaaguuacuuagcuuc

SEQ ID NO: 1118 - RNA, 20 nt, Artificial Sequence
  targeting sequence with ATCN PAM
cacagauacuaaguguccca

SEQ ID NO: 1119 - RNA, 20 nt, Artificial Sequence
  targeting sequence with ATCN PAM
gugugaucuugagcaaguua

SEQ ID NO: 1120 - RNA, 20 nt, Artificial Sequence
  targeting sequence with ATCN PAM
uaauuuaaaauauuccauac

SEQ ID NO: 1121 - RNA, 20 nt, Artificial Sequence
  targeting sequence with ATCN PAM
uuuuggcuuauuucauucuu

SEQ ID NO: 1122 - RNA, 20 nt, Artificial Sequence
  targeting sequence with ATCN PAM
cauguaauacuccuuaacca

SEQ ID NO: 1123 - RNA, 20 nt, Artificial Sequence
  targeting sequence with ATCN PAM
guuaauaauaccuugcauuu

SEQ ID NO: 1124 - RNA, 20 nt, Artificial Sequence
  targeting sequence with ATCN PAM
uuuucacuucucauuuuaca

SEQ ID NO: 1125 - RNA, 20 nt, Artificial Sequence
  targeting sequence with ATCN PAM
aaaauauuguaaaaugagaa

SEQ ID NO: 1126 - RNA, 20 nt, Artificial Sequence
  targeting sequence with ATCN PAM
ugacuaguccuguuuuucac

SEQ ID NO: 1127 - RNA, 20 nt, Artificial Sequence
  targeting sequence with ATCN PAM
guaaaauagagguaaccauc

SEQ ID NO: 1128 - RNA, 20 nt, Artificial Sequence
  targeting sequence with ATCN PAM
ucccaaaaugauacugggau

SEQ ID NO: 1129 - RNA, 20 nt, Artificial Sequence
  targeting sequence with ATCN PAM
caaaaugauacugggauuga

SEQ ID NO: 1130 - RNA, 20 nt, Artificial Sequence
  targeting sequence with ATCN PAM
uuuugggaugauugcuucau

SEQ ID NO: 1131 - RNA, 20 nt, Artificial Sequence
  targeting sequence with ATCN PAM
caguaucauuuugggaugau

SEQ ID NO: 1132 - RNA, 20 nt, Artificial Sequence
  targeting sequence with ATCN PAM
cauguugagaacuagacucu

SEQ ID NO: 1133 - RNA, 20 nt, Artificial Sequence
  targeting sequence with ATCN PAM
acauaaaccucaaagcuuuc

SEQ ID NO: 1134 - RNA, 20 nt, Artificial Sequence
  targeting sequence with ATCN PAM
cuuauucacugagguauuau

SEQ ID NO: 1135 - RNA, 20 nt, Artificial Sequence
  targeting sequence with ATCN PAM
auuauuuguaauaugcucuu

SEQ ID NO: 1136 - RNA, 20 nt, Artificial Sequence
  targeting sequence with ATCN PAM
cauaguucaucuauuauuug

SEQ ID NO: 1137 - RNA, 20 nt, Artificial Sequence
  targeting sequence with ATCN PAM
ucuauuuuaauguaaugcuu

SEQ ID NO: 1138 - RNA, 20 nt, Artificial Sequence
  targeting sequence with ATCN PAM
agugcuuucaagcacuauua

SEQ ID NO: 1139 - RNA, 20 nt, Artificial Sequence
  targeting sequence with ATCN PAM
gaacaaaaguagaaguugug

SEQ ID NO: 1140 - RNA, 20 nt, Artificial Sequence
  targeting sequence with ATCN PAM
gaagaaaucggaacaaaagu

SEQ ID NO: 1141 - RNA, 20 nt, Artificial Sequence
  targeting sequence with ATCN PAM
ucauacuucucguuguguuc

SEQ ID NO: 1142 - RNA, 20 nt, Artificial Sequence
  targeting sequence with ATCN PAM
uaaacaaauuuuguucagcc

SEQ ID NO: 1143 - RNA, 20 nt, Artificial Sequence
  targeting sequence with ATCN PAM
aauuuuuguucugaacaaaa

SEQ ID NO: 1144 - RNA, 20 nt, Artificial Sequence
  targeting sequence with ATCN PAM
ugaacucaaugaucuuucuu

SEQ ID NO: 1145 - RNA, 20 nt, Artificial Sequence
  targeting sequence with ATCN PAM
uugaguucaggaucaaauuu

SEQ ID NO: 1146 - RNA, 20 nt, Artificial Sequence
  targeting sequence with ATCN PAM
uucuuuuuuuuuuacaaggc

SEQ ID NO: 1147 - RNA, 20 nt, Artificial Sequence
  targeting sequence with ATCN PAM
uuuuuuaguuuucuuaauug

SEQ ID NO: 1148 - RNA, 20 nt, Artificial Sequence
  targeting sequence with ATCN PAM
caauuaagaaaacuaaaaaa

SEQ ID NO: 1149 - RNA, 20 nt, Artificial Sequence
  targeting sequence with ATCN PAM
ucaacacccucaucuucuuu

SEQ ID NO: 1150 - RNA, 20 nt, Artificial Sequence
  targeting sequence with ATCN PAM
acacccucaucuucuuucaa

SEQ ID NO: 1151 - RNA, 20 nt, Artificial Sequence
  targeting sequence with ATCN PAM
ucuuucaaaagcaaaugagu

SEQ ID NO: 1152 - RNA, 20 nt, Artificial Sequence
  targeting sequence with ATCN PAM
uuuuugcacuugcuucgggu

SEQ ID NO: 1153 - RNA, 20 nt, Artificial Sequence
  targeting sequence with ATCN PAM
acaaaaccaaaguaacaauu

SEQ ID NO: 1154 - RNA, 20 nt, Artificial Sequence
  targeting sequence with ATCN PAM
caucuacaaaaccaaaguaa

SEQ ID NO: 1155 - RNA, 20 nt, Artificial Sequence
  targeting sequence with ATCN PAM
ugacuugauaccccuuuuag

SEQ ID NO: 1156 - RNA, 20 nt, Artificial Sequence
  targeting sequence with ATCN PAM
agucaagauauaaagacugc

SEQ ID NO: 1157 - RNA, 20 nt, Artificial Sequence
  targeting sequence with ATCN PAM
aaaucuucuggcuuaagaga

SEQ ID NO: 1158 - RNA, 20 nt, Artificial Sequence
  targeting sequence with ATCN PAM
ucuggcuuaagagaagucuc

SEQ ID NO: 1159 - RNA, 20 nt, Artificial Sequence
  targeting sequence with ATCN PAM
ucacaaaaauggagagacuu

SEQ ID NO: 1160 - RNA, 20 nt, Artificial Sequence
  targeting sequence with ATCN PAM
aaaaguucacuugcuaauua

SEQ ID NO: 1161 - RNA, 20 nt, Artificial Sequence
  targeting sequence with ATCN PAM
gaacuucaguccuugugggc

SEQ ID NO: 1162 - RNA, 20 nt, Artificial Sequence
  targeting sequence with ATCN PAM
uuuucuagcccacaaggacu

SEQ ID NO: 1163 - RNA, 20 nt, Artificial Sequence
  targeting sequence with ATCN PAM
gaaaugugguccaguucuuu

SEQ ID NO: 1164 - RNA, 20 nt, Artificial Sequence
  targeting sequence with ATCN PAM
gucauuuaaaaaugaaaaag

SEQ ID NO: 1165 - RNA, 20 nt, Artificial Sequence
  targeting sequence with ATCN PAM
cucuuuuucauuuuuaaaug

SEQ ID NO: 1166 - RNA, 20 nt, Artificial Sequence
  targeting sequence with ATCN PAM
uuuggcuguacuaucuuuac

SEQ ID NO: 1167 - RNA, 20 nt, Artificial Sequence
  targeting sequence with ATCN PAM
uuaccaucuuauaugcuuac

SEQ ID NO: 1168 - RNA, 20 nt, Artificial Sequence
  targeting sequence with ATCN PAM
uauaugcuuaccugauaaag

SEQ ID NO: 1169 - RNA, 20 nt, Artificial Sequence
  targeting sequence with ATCN PAM
gguaagcauauaagauggua

SEQ ID NO: 1170 - RNA, 20 nt, Artificial Sequence
  targeting sequence with ATCN PAM
aaucuuccugcugucuuccc

SEQ ID NO: 1171 - RNA, 20 nt, Artificial Sequence
  targeting sequence with ATCN PAM
uccugcugucuucccaaaua

SEQ ID NO: 1172 - RNA, 20 nt, Artificial Sequence
  targeting sequence with ATCN PAM
acaugggacagacuuacggc

SEQ ID NO: 1173 - RNA, 20 nt, Artificial Sequence
  targeting sequence with ATCN PAM
cuucugcucaguuuggugcu

SEQ ID NO: 1174 - RNA, 20 nt, Artificial Sequence
  targeting sequence with ATCN PAM
cuugcuacaagaacccaucg

SEQ ID NO: 1175 - RNA, 20 nt, Artificial Sequence
  targeting sequence with ATCN PAM
ucauuuguuccucaucuucu

SEQ ID NO: 1176 - RNA, 20 nt, Artificial Sequence
  targeting sequence with ATCN PAM
uuuguuccucaucuucuccc

SEQ ID NO: 1177 - RNA, 20 nt, Artificial Sequence
  targeting sequence with ATCN PAM
ucucccacucuuuccaauuc

SEQ ID NO: 1178 - RNA, 20 nt, Artificial Sequence
  targeting sequence with ATCN PAM
ucuuugcuggaaaaacaaag

SEQ ID NO: 1179 - RNA, 20 nt, Artificial Sequence
  targeting sequence with ATCN PAM
cuuagacuuuguuuuuccag

SEQ ID NO: 1180 - RNA, 20 nt, Artificial Sequence
  targeting sequence with ATCN PAM
cccucauuuuaauauggaua

SEQ ID NO: 1181 - RNA, 20 nt, Artificial Sequence
  targeting sequence with ATCN PAM
cugcacaacaaaaaagucaa

SEQ ID NO: 1182 - RNA, 20 nt, Artificial Sequence
  targeting sequence with ATCN PAM
gaaaaguuucuagcuugacu

SEQ ID NO: 1183 - RNA, 20 nt, Artificial Sequence
  targeting sequence with ATCN PAM
cugaguagggcuauuauaaa

SEQ ID NO: 1184 - RNA, 20 nt, Artificial Sequence
  targeting sequence with ATCN PAM
uuauaauagcccuacucagu

SEQ ID NO: 1185 - RNA, 20 nt, Artificial Sequence
  targeting sequence with ATCN PAM
gugaguuacacugucuucuc

SEQ ID NO: 1186 - RNA, 20 nt, Artificial Sequence
  targeting sequence with ATCN PAM
cuuucaucagauguaauccu

SEQ ID NO: 1187 - RNA, 20 nt, Artificial Sequence
  targeting sequence with ATCN PAM
gauguaauccuccagaaggu

SEQ ID NO: 1188 - RNA, 20 nt, Artificial Sequence
  targeting sequence with ATCN PAM
gaugaaagugauacacacuc

SEQ ID NO: 1189 - RNA, 20 nt, Artificial Sequence
  targeting sequence with ATCN PAM
uccagaagguaaauaauuug

SEQ ID NO: 1190 - RNA, 20 nt, Artificial Sequence
  targeting sequence with ATCN PAM
aauuauuuaccuucuggagg

SEQ ID NO: 1191 - RNA, 20 nt, Artificial Sequence
  targeting sequence with ATCN PAM
ucuucauucuugauccucau

SEQ ID NO: 1192 - RNA, 20 nt, Artificial Sequence
  targeting sequence with ATCN PAM
agaaugaagaagauucaaaa

SEQ ID NO: 1193 - RNA, 20 nt, Artificial Sequence
  targeting sequence with ATCN PAM
ucaugguaaccuuguaggua

SEQ ID NO: 1194 - RNA, 20 nt, Artificial Sequence
  targeting sequence with ATCN PAM
auaaauugagaguaaaccuu

SEQ ID NO: 1195 - RNA, 20 nt, Artificial Sequence
  targeting sequence with ATCN PAM
uggucuaauacuucuccccc

SEQ ID NO: 1196 - RNA, 20 nt, Artificial Sequence
  targeting sequence with ATCN PAM
ucccacuuccuccucccaaa

SEQ ID NO: 1197 - RNA, 20 nt, Artificial Sequence
  targeting sequence with ATCN PAM
ccugaucccaagaguuugag

SEQ ID NO: 1198 - RNA, 20 nt, Artificial Sequence
  targeting sequence with ATCN PAM
ggugaucuucccacuuccuc

SEQ ID NO: 1199 - RNA, 20 nt, Artificial Sequence
  targeting sequence with ATCN PAM
caagaguuugagaccagccu

SEQ ID NO: 1200 - RNA, 20 nt, Artificial Sequence
  targeting sequence with ATCN PAM
cacugugcucuccaggcugg

SEQ ID NO: 1201 - RNA, 20 nt, Artificial Sequence
  targeting sequence with ATCN PAM
ucgucuuugcaaaaaaugaa

SEQ ID NO: 1202 - RNA, 20 nt, Artificial Sequence
  targeting sequence with ATCN PAM
uagcucccugaagccuugac

SEQ ID NO: 1203 - RNA, 20 nt, Artificial Sequence
  targeting sequence with ATCN PAM
caaaaaaaaacccacuaaac

SEQ ID NO: 1204 - RNA, 20 nt, Artificial Sequence
  targeting sequence with ATCN PAM
uagaagacacauuggaacuu

SEQ ID NO: 1205 - RNA, 20 nt, Artificial Sequence
  targeting sequence with ATCN PAM
uaaucacuaaaccacagauu

SEQ ID NO: 1206 - RNA, 20 nt, Artificial Sequence
  targeting sequence with ATCN PAM
cuaaaccacagauuguaaaa

SEQ ID NO: 1207 - RNA, 20 nt, Artificial Sequence
  targeting sequence with ATCN PAM
gugguuuagugauuaggaua

SEQ ID NO: 1208 - RNA, 20 nt, Artificial Sequence
  targeting sequence with ATCN PAM
accuuuuacaaucugugguu

SEQ ID NO: 1209 - RNA, 20 nt, Artificial Sequence
  targeting sequence with ATCN PAM
cucuagacccauccaccuuu

SEQ ID NO: 1210 - RNA, 20 nt, Artificial Sequence
  targeting sequence with ATCN PAM
uuuaacccaaguucuuuucu

SEQ ID NO: 1211 - RNA, 20 nt, Artificial Sequence
  targeting sequence with ATCN PAM
agguuuucugauguaauuug

SEQ ID NO: 1212 - RNA, 20 nt, Artificial Sequence
  targeting sequence with ATCN PAM
gaaaaccuugauucuaauuc

SEQ ID NO: 1213 - RNA, 20 nt, Artificial Sequence
  targeting sequence with ATCN PAM
agcuccucaaaauuauuuua

SEQ ID NO: 1214 - RNA, 20 nt, Artificial Sequence
  targeting sequence with ATCN PAM
auccagcuccucaaaauuau

SEQ ID NO: 1215 - RNA, 20 nt, Artificial Sequence
  targeting sequence with ATCN PAM
uaugaaaugauauuguuuac

SEQ ID NO: 1216 - RNA, 20 nt, Artificial Sequence
  targeting sequence with ATCN PAM
uuucauaagauccauccagc

SEQ ID NO: 1217 - RNA, 20 nt, Artificial Sequence
  targeting sequence with ATCN PAM
cuaaaauuguaaacaauauc

SEQ ID NO: 1218 - RNA, 20 nt, Artificial Sequence
  targeting sequence with ATCN PAM
gcacaaacucuuaagagacu

SEQ ID NO: 1219 - RNA, 20 nt, Artificial Sequence
  targeting sequence with ATCN PAM
caaagucucgguaaaagacu

SEQ ID NO: 1220 - RNA, 20 nt, Artificial Sequence
  targeting sequence with ATCN PAM
ccuucuuuuuacagagucuu

SEQ ID NO: 1221 - RNA, 20 nt, Artificial Sequence
  targeting sequence with ATCN PAM
uaaccuccuaucacacacgu

SEQ ID NO: 1222 - RNA, 20 nt, Artificial Sequence
  targeting sequence with ATCN PAM
cacacguagucuaaugacuu

SEQ ID NO: 1223 - RNA, 20 nt, Artificial Sequence
  targeting sequence with ATCN PAM
uaggaagucauuagacuacg

SEQ ID NO: 1224 - RNA, 20 nt, Artificial Sequence
  targeting sequence with ATCN PAM
uccaaccccaaggggaccuc

SEQ ID NO: 1225 - RNA, 20 nt, Artificial Sequence
  targeting sequence with ATCN PAM
uagaugaggaagucgagcgc

SEQ ID NO: 1226 - RNA, 20 nt, Artificial Sequence
  targeting sequence with ATCN PAM
aagaugacuagggagacugg

SEQ ID NO: 1227 - RNA, 20 nt, Artificial Sequence
  targeting sequence with ATCN PAM
gcccuggggugcgcucgacu

SEQ ID NO: 1228 - RNA, 20 nt, Artificial Sequence
  targeting sequence with ATCN PAM
cacaggaagagcaccugggc

SEQ ID NO: 1229 - RNA, 20 nt, Artificial Sequence
  targeting sequence with ATCN PAM
ggagaguggacagugugugg

SEQ ID NO: 1230 - RNA, 20 nt, Artificial Sequence
  targeting sequence with ATCN PAM
agcaggguccggcugcagca

SEQ ID NO: 1231 - RNA, 20 nt, Artificial Sequence
  targeting sequence with ATCN PAM
uacuccgccccacacccugg

SEQ ID NO: 1232 - RNA, 20 nt, Artificial Sequence
  targeting sequence with ATCN PAM
aauccauucucgaggaagac

SEQ ID NO: 1233 - RNA, 20 nt, Artificial Sequence
  targeting sequence with ATCN PAM
auucucgaggaagacgcacc

SEQ ID NO: 1234 - RNA, 20 nt, Artificial Sequence
  targeting sequence with ATCN PAM
cucgcgcucugguugcgcug

SEQ ID NO: 1235 - RNA, 20 nt, Artificial Sequence
  targeting sequence with ATCN PAM
cggcuucccuuacggcucgg

SEQ ID NO: 1236 - RNA, 20 nt, Artificial Sequence
  targeting sequence with ATCN PAM
cuccacgucaacacggcccu

SEQ ID NO: 1237 - RNA, 20 nt, Artificial Sequence
  targeting sequence with ATCN PAM
aaggcagcgacagggccaga

SEQ ID NO: 1238 - RNA, 20 nt, Artificial Sequence
  targeting sequence with ATCN PAM
cacacccacgagacagcacg

SEQ ID NO: 1239 - RNA, 20 nt, Artificial Sequence
  targeting sequence with ATCN PAM
acauaguacccauacucuug

SEQ ID NO: 1240 - RNA, 20 nt, Artificial Sequence
  targeting sequence with ATCN PAM
uaauuaaaauaaaugagaca

SEQ ID NO: 1241 - RNA, 20 nt, Artificial Sequence
  targeting sequence with ATCN PAM
uaacauuuagagcaagugac

SEQ ID NO: 1242 - RNA, 20 nt, Artificial Sequence
  targeting sequence with ATCN PAM
gcgucgcuugcucuaagugu

SEQ ID NO: 1243 - RNA, 20 nt, Artificial Sequence
  targeting sequence with ATCN PAM
cagguuuaaaggcucccuag

SEQ ID NO: 1244 - RNA, 20 nt, Artificial Sequence
  targeting sequence with ATCN PAM
cguuucucuaaaacuggaga

SEQ ID NO: 1245 - RNA, 20 nt, Artificial Sequence
  targeting sequence with ATCN PAM
ccaguuuuagagaaacgaga

SEQ ID NO: 1246 - RNA, 20 nt, Artificial Sequence
  targeting sequence with ATCN PAM
uaccugcccaucuccaguuu

SEQ ID NO: 1247 - RNA, 20 nt, Artificial Sequence
  targeting sequence with ATCN PAM
gaaaggugcucaaaaugagc

SEQ ID NO: 1248 - RNA, 20 nt, Artificial Sequence
  targeting sequence with ATCN PAM
aaaggugacaaagucauucc

SEQ ID NO: 1249 - RNA, 20 nt, Artificial Sequence
  targeting sequence with ATCN PAM
ccuaaaucuauaacauagca

SEQ ID NO: 1250 - RNA, 20 nt, Artificial Sequence
  targeting sequence with ATCN PAM
auaacauagcagucuguuuu

SEQ ID NO: 1251 - RNA, 20 nt, Artificial Sequence
  targeting sequence with ATCN PAM
cauaaguaagaauaugacaa

SEQ ID NO: 1252 - RNA, 20 nt, Artificial Sequence
  targeting sequence with ATCN PAM
uucagcauuguugugaagcc

SEQ ID NO: 1253 - RNA, 20 nt, Artificial Sequence
  targeting sequence with ATCN PAM
cagaagggacagaaccaaag

SEQ ID NO: 1254 - RNA, 20 nt, Artificial Sequence
  targeting sequence with ATCN PAM
uucucuguguaaagcaugcc

SEQ ID NO: 1255 - RNA, 20 nt, Artificial Sequence
  targeting sequence with ATCN PAM
cacacggaaauccugaacau

SEQ ID NO: 1256 - RNA, 20 nt, Artificial Sequence
  targeting sequence with ATCN PAM
ugaacauccuucaaggcuca

SEQ ID NO: 1257 - RNA, 20 nt, Artificial Sequence
  targeting sequence with ATCN PAM
uucaaggcucacguuggaga

SEQ ID NO: 1258 - RNA, 20 nt, Artificial Sequence
  targeting sequence with ATCN PAM
uuuaucucguugugucuuca

SEQ ID NO: 1259 - RNA, 20 nt, Artificial Sequence
  targeting sequence with ATCN PAM
cguugugucuucaccacucu

SEQ ID NO: 1260 - RNA, 20 nt, Artificial Sequence
  targeting sequence with ATCN PAM
acccucucugggcuucaguu

SEQ ID NO: 1261 - RNA, 20 nt, Artificial Sequence
  targeting sequence with ATCN PAM
cccauuuauguuaccugccu

SEQ ID NO: 1262 - RNA, 20 nt, Artificial Sequence
  targeting sequence with ATCN PAM
ucaacacuaggaauuguaug

SEQ ID NO: 1263 - RNA, 20 nt, Artificial Sequence
  targeting sequence with ATCN PAM
gugaaucuuucauuuguacu

SEQ ID NO: 1264 - RNA, 20 nt, Artificial Sequence
  targeting sequence with ATCN PAM
uucauuuguacuuuuaauag

SEQ ID NO: 1265 - RNA, 20 nt, Artificial Sequence
  targeting sequence with ATCN PAM
cuauuaaaaguacaaaugaa

SEQ ID NO: 1266 - RNA, 20 nt, Artificial Sequence
  targeting sequence with ATCN PAM
uuuuacuuuuaacuuuauua

SEQ ID NO: 1267 - RNA, 20 nt, Artificial Sequence
  targeting sequence with ATCN PAM
gcuugugcuauagguacguu

SEQ ID NO: 1268 - RNA, 20 nt, Artificial Sequence
  targeting sequence with ATCN PAM
ucagcuugugcuauagguac

SEQ ID NO: 1269 - RNA, 20 nt, Artificial Sequence
  targeting sequence with ATCN PAM
ggguuuuuaugugaaauggc

SEQ ID NO: 1270 - RNA, 20 nt, Artificial Sequence
  targeting sequence with ATCN PAM
acucugaaaaaaaaacaaaa

SEQ ID NO: 1271 - RNA, 20 nt, Artificial Sequence
  targeting sequence with ATCN PAM
ggcugcauucggccagcaaa

SEQ ID NO: 1272 - RNA, 20 nt, Artificial Sequence
  targeting sequence with ATCN PAM
guuuaauucagaagucuaau

SEQ ID NO: 1273 - RNA, 20 nt, Artificial Sequence
  targeting sequence with ATCN PAM
auaguaacaacaaccacuga

SEQ ID NO: 1274 - RNA, 20 nt, Artificial Sequence
  targeting sequence with ATCN PAM
aguauuuuauuacuauccau

SEQ ID NO: 1275 - RNA, 20 nt, Artificial Sequence
  targeting sequence with ATCN PAM
acccacaguauuucguuuua

SEQ ID NO: 1276 - RNA, 20 nt, Artificial Sequence
  targeting sequence with ATCN PAM
uucauucacguaugaauaca

SEQ ID NO: 1277 - RNA, 20 nt, Artificial Sequence
  targeting sequence with ATCN PAM
uuauucaucauucauucacg

SEQ ID NO: 1278 - RNA, 20 nt, Artificial Sequence
  targeting sequence with ATCN PAM
guaaugggccaaaaaccaga

SEQ ID NO: 1279 - RNA, 20 nt, Artificial Sequence
  targeting sequence with ATCN PAM
uaauagguugucucaaaucu

SEQ ID NO: 1280 - RNA, 20 nt, Artificial Sequence
  targeting sequence with ATCN PAM
cuuauccuaauagguugucu

SEQ ID NO: 1281 - RNA, 20 nt, Artificial Sequence
  targeting sequence with ATCN PAM
auccugauggcugcuagaua

SEQ ID NO: 1282 - RNA, 20 nt, Artificial Sequence
  targeting sequence with ATCN PAM
ugauggcugcuagauauacc

SEQ ID NO: 1283 - RNA, 20 nt, Artificial Sequence
  targeting sequence with ATCN PAM
ggauugauggucuauagaac

SEQ ID NO: 1284 - RNA, 20 nt, Artificial Sequence
  targeting sequence with ATCN PAM
agcagccaucaggauugaug

SEQ ID NO: 1285 - RNA, 20 nt, Artificial Sequence
  targeting sequence with ATCN PAM
gcugguauaucuagcagcca

SEQ ID NO: 1286 - RNA, 20 nt, Artificial Sequence
  targeting sequence with ATCN PAM
uagaugucaaagauuagucc

SEQ ID NO: 1287 - RNA, 20 nt, Artificial Sequence
  targeting sequence with ATCN PAM
aggauuuuuuuaguucuacu

SEQ ID NO: 1288 - RNA, 20 nt, Artificial Sequence
  targeting sequence with ATCN PAM
uugacaucuaggauuuuuuu

SEQ ID NO: 1289 - RNA, 20 nt, Artificial Sequence
  targeting sequence with ATCN PAM
aaaucagccauugucucccg

SEQ ID NO: 1290 - RNA, 20 nt, Artificial Sequence
  targeting sequence with ATCN PAM
gccauugucucccggucugc

SEQ ID NO: 1291 - RNA, 20 nt, Artificial Sequence
  targeting sequence with ATCN PAM
cagcagcaggucuuaaaaaa

SEQ ID NO: 1292 - RNA, 20 nt, Artificial Sequence
  targeting sequence with ATCN PAM
uguuacucuacuucucauaa

SEQ ID NO: 1293 - RNA, 20 nt, Artificial Sequence
  targeting sequence with ATCN PAM
cucuagguuuaugagaagua

SEQ ID NO: 1294 - RNA, 20 nt, Artificial Sequence
  targeting sequence with ATCN PAM
ggcuugcaacauuuaaauuu

SEQ ID NO: 1295 - RNA, 20 nt, Artificial Sequence
  targeting sequence with ATCN PAM
ucggguagaaaaauagaguu

SEQ ID NO: 1296 - RNA, 20 nt, Artificial Sequence
  targeting sequence with ATCN PAM
uucccaaaugcucccuuauu

SEQ ID NO: 1297 - RNA, 20 nt, Artificial Sequence
  targeting sequence with ATCN PAM
caaccaggaugucuuauuag

SEQ ID NO: 1298 - RNA, 20 nt, Artificial Sequence
  targeting sequence with ATCN PAM
ugguugagaugaaccuggag

SEQ ID NO: 1299 - RNA, 20 nt, Artificial Sequence
  targeting sequence with ATCN PAM
cauuuaaagaugaagaaauu

SEQ ID NO: 1300 - RNA, 20 nt, Artificial Sequence
  targeting sequence with ATCN PAM
uuaaaugagaugaaaauucc

SEQ ID NO: 1301 - RNA, 20 nt, Artificial Sequence
  targeting sequence with ATCN PAM
caauuucuucaucuuuaaau

SEQ ID NO: 1302 - RNA, 20 nt, Artificial Sequence
  targeting sequence with ATCN PAM
ugcaaauuguccucugacaa

SEQ ID NO: 1303 - RNA, 20 nt, Artificial Sequence
  targeting sequence with ATCN PAM
cugcaauggaaucugacagu

SEQ ID NO: 1304 - RNA, 20 nt, Artificial Sequence
  targeting sequence with ATCN PAM
ccagaaacucagaauuggaa

SEQ ID NO: 1305 - RNA, 20 nt, Artificial Sequence
  targeting sequence with ATCN PAM
aaacucuuaauguacuuaga

SEQ ID NO: 1306 - RNA, 20 nt, Artificial Sequence
  targeting sequence with ATCN PAM
gacauauaugauauauuuua

SEQ ID NO: 1307 - RNA, 20 nt, Artificial Sequence
  targeting sequence with ATCN PAM
uauaugucugauuugcccca

SEQ ID NO: 1308 - RNA, 20 nt, Artificial Sequence
  targeting sequence with ATCN PAM
ugaaauuugccuuccuaaaa

SEQ ID NO: 1309 - RNA, 20 nt, Artificial Sequence
  targeting sequence with ATCN PAM
aagaggaagaauguucaggc

SEQ ID NO: 1310 - RNA, 20 nt, Artificial Sequence
  targeting sequence with ATCN PAM
uuucugaaugucucauuuga

SEQ ID NO: 1311 - RNA, 20 nt, Artificial Sequence
  targeting sequence with ATCN PAM
caaaaucauuucugaauguc

SEQ ID NO: 1312 - RNA, 20 nt, Artificial Sequence
  targeting sequence with ATCN PAM
cuuugaugagcucauaugug

SEQ ID NO: 1313 - RNA, 20 nt, Artificial Sequence
  targeting sequence with ATCN PAM
aagugauuccugugugaccu

SEQ ID NO: 1314 - RNA, 20 nt, Artificial Sequence
  targeting sequence with ATCN PAM
uugguauguggcuuccuuuc

SEQ ID NO: 1315 - RNA, 20 nt, Artificial Sequence
  targeting sequence with ATCN PAM
aaagucauccuugguaugug

SEQ ID NO: 1316 - RNA, 20 nt, Artificial Sequence
  targeting sequence with ATCN PAM
aauaauccaccauagcaauc

SEQ ID NO: 1317 - RNA, 20 nt, Artificial Sequence
  targeting sequence with ATCN PAM
accauagcaauccacaagug

SEQ ID NO: 1318 - RNA, 20 nt, Artificial Sequence
  targeting sequence with ATCN PAM
acaagugucaggcgcuuugg

SEQ ID NO: 1319 - RNA, 20 nt, Artificial Sequence
  targeting sequence with ATCN PAM
aaagcgccugacacuugugg

SEQ ID NO: 1320 - RNA, 20 nt, Artificial Sequence
  targeting sequence with ATCN PAM
uuguuuuguaggugagaaug

SEQ ID NO: 1321 - RNA, 20 nt, Artificial Sequence
  targeting sequence with ATCN PAM
gagcuuucauucucaccuac

SEQ ID NO: 1322 - RNA, 20 nt, Artificial Sequence
  targeting sequence with ATCN PAM
ccuaucugagcuuucauucu

SEQ ID NO: 1323 - RNA, 20 nt, Artificial Sequence
  targeting sequence with ATCN PAM
gcuuuucuggccccacgucc

SEQ ID NO: 1324 - RNA, 20 nt, Artificial Sequence
  targeting sequence with ATCN PAM
cacucuuuccagcugggcaa

SEQ ID NO: 1325 - RNA, 20 nt, Artificial Sequence
  targeting sequence with ATCN PAM
uccuuguuccagcuucuuua

SEQ ID NO: 1326 - RNA, 20 nt, Artificial Sequence
  targeting sequence with ATCN PAM
uuguuccagcuucuuuauca

SEQ ID NO: 1327 - RNA, 20 nt, Artificial Sequence
  targeting sequence with ATCN PAM
gccagcucugugacuaggag

SEQ ID NO: 1328 - RNA, 20 nt, Artificial Sequence
  targeting sequence with ATCN PAM
gggcaguggugccuguccug

SEQ ID NO: 1329 - RNA, 20 nt, Artificial Sequence
  targeting sequence with ATCN PAM
uuacgaaaacauaauguagu

SEQ ID NO: 1330 - RNA, 20 nt, Artificial Sequence
  targeting sequence with ATCN PAM
aauaagauaauguaaguuua

SEQ ID NO: 1331 - RNA, 20 nt, Artificial Sequence
  targeting sequence with ATCN PAM
uauuugauccuuacgaaaac

SEQ ID NO: 1332 - RNA, 20 nt, Artificial Sequence
  targeting sequence with ATCN PAM
gugaaacagguauacaguug

SEQ ID NO: 1333 - RNA, 20 nt, Artificial Sequence
  targeting sequence with ATCN PAM
agcuuuugucaguaacuugg

SEQ ID NO: 1334 - RNA, 20 nt, Artificial Sequence
  targeting sequence with ATCN PAM
aaaaaucaagcuuuugucag

SEQ ID NO: 1335 - RNA, 20 nt, Artificial Sequence
  targeting sequence with ATCN PAM
gaauggauuuccuucucaac

SEQ ID NO: 1336 - RNA, 20 nt, Artificial Sequence
  targeting sequence with ATCN PAM
auucagaugguuggggggcc

SEQ ID NO: 1337 - RNA, 20 nt, Artificial Sequence
  targeting sequence with ATCN PAM
uggccugaaacagucucuca

SEQ ID NO: 1338 - RNA, 20 nt, Artificial Sequence
  targeting sequence with ATCN PAM
acacagacuuuaaguaugau

SEQ ID NO: 1339 - RNA, 20 nt, Artificial Sequence
  targeting sequence with ATCN PAM
uacuuaaagucuguguugau

SEQ ID NO: 1340 - RNA, 20 nt, Artificial Sequence
  targeting sequence with ATCN PAM
uuuaucuuaacccaggcauu

SEQ ID NO: 1341 - RNA, 20 nt, Artificial Sequence
  targeting sequence with ATCN PAM
uaacccaggcauuccuuucu

SEQ ID NO: 1342 - RNA, 20 nt, Artificial Sequence
  targeting sequence with ATCN PAM
cgccacuacacuccagccug

SEQ ID NO: 1343 - RNA, 20 nt, Artificial Sequence
  targeting sequence with ATCN PAM
cagcucacugcaagcuccac

SEQ ID NO: 1344 - RNA, 20 nt, Artificial Sequence
  targeting sequence with ATCN PAM
ucccguguagcugggacuau

SEQ ID NO: 1345 - RNA, 20 nt, Artificial Sequence
  targeting sequence with ATCN PAM
ugcuuggcuaauuuuuugua

SEQ ID NO: 1346 - RNA, 20 nt, Artificial Sequence
  targeting sequence with ATCN PAM
uggcuaacacggugaaaccc

SEQ ID NO: 1347 - RNA, 20 nt, Artificial Sequence
  targeting sequence with ATCN PAM
ugaggucaggagacugagac

SEQ ID NO: 1348 - RNA, 20 nt, Artificial Sequence
  targeting sequence with ATCN PAM
acccaccucggccucccaaa

SEQ ID NO: 1349 - RNA, 20 nt, Artificial Sequence
  targeting sequence with ATCN PAM
cagcacuuugggaggccgag

SEQ ID NO: 1350 - RNA, 20 nt, Artificial Sequence
  targeting sequence with ATCN PAM
aaggaccuagggucggccgg

SEQ ID NO: 1351 - RNA, 20 nt, Artificial Sequence
  targeting sequence with ATCN PAM
accuauaagcuagaagcccc

SEQ ID NO: 1352 - RNA, 20 nt, Artificial Sequence
  targeting sequence with ATCN PAM
uucuggaccaaaccaaugca

SEQ ID NO: 1353 - RNA, 20 nt, Artificial Sequence
  targeting sequence with ATCN PAM
aauacauuuaagaaaugcau

SEQ ID NO: 1354 - RNA, 20 nt, Artificial Sequence
  targeting sequence with ATCN PAM
cuucagauauuuuacagagu

SEQ ID NO: 1355 - RNA, 20 nt, Artificial Sequence
  targeting sequence with ATCN PAM
gaagagauuuauucugagcc

SEQ ID NO: 1356 - RNA, 20 nt, Artificial Sequence
  targeting sequence with ATCN PAM
aacucuguaaaauaucugaa

SEQ ID NO: 1357 - RNA, 20 nt, Artificial Sequence
  targeting sequence with ATCN PAM
ggcuaugugcaagauguugc

SEQ ID NO: 1358 - RNA, 20 nt, Artificial Sequence
  targeting sequence with ATCN PAM
aaauaauuuaauuugacuga

SEQ ID NO: 1359 - RNA, 20 nt, Artificial Sequence
  targeting sequence with ATCN PAM
cuuaaaauauuuugcaguuu

SEQ ID NO: 1360 - RNA, 20 nt, Artificial Sequence
  targeting sequence with ATCN PAM
aucagauacauuuaagaaau

SEQ ID NO: 1361 - RNA, 20 nt, Artificial Sequence
  targeting sequence with ATCN PAM
gauacauuuaagaaauacau

SEQ ID NO: 1362 - RNA, 20 nt, Artificial Sequence
  targeting sequence with ATCN PAM
gauugaugucucaugccucc

SEQ ID NO: 1363 - RNA, 20 nt, Artificial Sequence
  targeting sequence with ATCN PAM
aaccaauguauuucuuaaau

SEQ ID NO: 1364 - RNA, 20 nt, Artificial Sequence
  targeting sequence with ATCN PAM
agaaaggcaggacaacucaa

SEQ ID NO: 1365 - RNA, 20 nt, Artificial Sequence
  targeting sequence with ATCN PAM
caggucuuuaaacaaacuca

SEQ ID NO: 1366 - RNA, 20 nt, Artificial Sequence
  targeting sequence with ATCN PAM
acagaaaggaaugucugggu

SEQ ID NO: 1367 - RNA, 20 nt, Artificial Sequence
  targeting sequence with ATCN PAM
uaacccagacauuccuuucu

SEQ ID NO: 1368 - RNA, 20 nt, Artificial Sequence
  targeting sequence with ATCN PAM
uuuaucuuaacccagacauu

SEQ ID NO: 1369 - RNA, 20 nt, Artificial Sequence
  targeting sequence with ATCN PAM
cggcucacugcaaccucugu

SEQ ID NO: 1370 - RNA, 20 nt, Artificial Sequence
  targeting sequence with ATCN PAM
cagcuacuagggaggcugag

SEQ ID NO: 1371 - RNA, 20 nt, Artificial Sequence
  targeting sequence with ATCN PAM
cgaggucaggaguuugaggc

SEQ ID NO: 1372 - RNA, 20 nt, Artificial Sequence
  targeting sequence with ATCN PAM
gcccgccucggccucccaaa

SEQ ID NO: 1373 - RNA, 20 nt, Artificial Sequence
  targeting sequence with ATCN PAM
cagcguuuugggaggccgag

SEQ ID NO: 1374 - RNA, 20 nt, Artificial Sequence
  targeting sequence with ATCN PAM
uacuuaaagucuguguugau

SEQ ID NO: 1375 - RNA, 20 nt, Artificial Sequence
  targeting sequence with ATCN PAM
acacagacuuuaaguaugau

SEQ ID NO: 1376 - RNA, 20 nt, Artificial Sequence
  targeting sequence with ATCN PAM
ucuucauuaaucuuuuucug

SEQ ID NO: 1377 - RNA, 20 nt, Artificial Sequence
  targeting sequence with ATCN PAM
uuuucugauccucuccuuga

SEQ ID NO: 1378 - RNA, 20 nt, Artificial Sequence
  targeting sequence with ATCN PAM
gaaaaagauuaaugaagaag

SEQ ID NO: 1379 - RNA, 20 nt, Artificial Sequence
  targeting sequence with ATCN PAM
ucuccuugaauuaaaaugcu

SEQ ID NO: 1380 - RNA, 20 nt, Artificial Sequence
  targeting sequence with ATCN PAM
gagauuuguugucucaacag

SEQ ID NO: 1381 - RNA, 20 nt, Artificial Sequence
  targeting sequence with ATCN PAM
cggauauuuaccccagacaa

SEQ ID NO: 1382 - RNA, 20 nt, Artificial Sequence
  targeting sequence with ATCN PAM
uaguuuuccauugcuguuga

SEQ ID NO: 1383 - RNA, 20 nt, Artificial Sequence
  targeting sequence with ATCN PAM
auaaaaccugcauuucacca

SEQ ID NO: 1384 - RNA, 20 nt, Artificial Sequence
  targeting sequence with ATCN PAM
gacaccaccuccucaagcuu

SEQ ID NO: 1385 - RNA, 20 nt, Artificial Sequence
  targeting sequence with ATCN PAM
uuugugcccuauguaaauca

SEQ ID NO: 1386 - RNA, 20 nt, Artificial Sequence
  targeting sequence with ATCN PAM
aucuuuugugcccuauguaa

SEQ ID NO: 1387 - RNA, 20 nt, Artificial Sequence
  targeting sequence with ATCN PAM
aaucaaucuuuugugcccua

SEQ ID NO: 1388 - RNA, 20 nt, Artificial Sequence
  targeting sequence with ATCN PAM
uuuauuaugcaguuggguua

SEQ ID NO: 1389 - RNA, 20 nt, Artificial Sequence
  targeting sequence with ATCN PAM
ugccacugcacuccagucug

SEQ ID NO: 1390 - RNA, 20 nt, Artificial Sequence
  targeting sequence with ATCN PAM
uggcucacugcaaccucugc

SEQ ID NO: 1391 - RNA, 20 nt, Artificial Sequence
  targeting sequence with ATCN PAM
cuagaaccugggaggcagag

SEQ ID NO: 1392 - RNA, 20 nt, Artificial Sequence
  targeting sequence with ATCN PAM
cagcuacucgagaggcugag

SEQ ID NO: 1393 - RNA, 20 nt, Artificial Sequence
  targeting sequence with ATCN PAM
cagcacucugggaggccaag

SEQ ID NO: 1394 - RNA, 20 nt, Artificial Sequence
  targeting sequence with ATCN PAM
auguuugcagcucgauuuuu

SEQ ID NO: 1395 - RNA, 20 nt, Artificial Sequence
  targeting sequence with ATCN PAM
agcugcaaacauagauaggc

SEQ ID NO: 1396 - RNA, 20 nt, Artificial Sequence
  targeting sequence with ATCN PAM
ggcuaaauaauuucuuucua

SEQ ID NO: 1397 - RNA, 20 nt, Artificial Sequence
  targeting sequence with ATCN PAM
cugcgucuuccuccuucgaa

SEQ ID NO: 1398 - RNA, 20 nt, Artificial Sequence
  targeting sequence with ATCN PAM
uguuuucaugugucucuuaa

SEQ ID NO: 1399 - RNA, 20 nt, Artificial Sequence
  targeting sequence with ATCN PAM
gaguacuguucuguauuuca

SEQ ID NO: 1400 - RNA, 20 nt, Artificial Sequence
  targeting sequence with ATCN PAM
aaucuaauaggucauugauu

SEQ ID NO: 1401 - RNA, 20 nt, Artificial Sequence
  targeting sequence with ATCN PAM
aauaggucauugauuauaaa

SEQ ID NO: 1402 - RNA, 20 nt, Artificial Sequence
  targeting sequence with ATCN PAM
augaccuauuagauuggaug

SEQ ID NO: 1403 - RNA, 20 nt, Artificial Sequence
  targeting sequence with ATCN PAM
auaagaaagcaaaaaaugcu

SEQ ID NO: 1404 - RNA, 20 nt, Artificial Sequence
  targeting sequence with ATCN PAM
ucaauuauaagacacaaccu

SEQ ID NO: 1405 - RNA, 20 nt, Artificial Sequence
  targeting sequence with ATCN PAM
auuauaagacacaaccuuag

SEQ ID NO: 1406 - RNA, 20 nt, Artificial Sequence
  targeting sequence with ATCN PAM
auucuaaagcuuacauuuuu

SEQ ID NO: 1407 - RNA, 20 nt, Artificial Sequence
  targeting sequence with ATCN PAM
agugagaaggugugaaacag

SEQ ID NO: 1408 - RNA, 20 nt, Artificial Sequence
  targeting sequence with ATCN PAM
cucccuccccucagggaaau

SEQ ID NO: 1409 - RNA, 20 nt, Artificial Sequence
  targeting sequence with ATCN PAM
uaaucccucccuccccucag

SEQ ID NO: 1410 - RNA, 20 nt, Artificial Sequence
  targeting sequence with ATCN PAM
guucauaucuguuggugccu

SEQ ID NO: 1411 - RNA, 20 nt, Artificial Sequence
  targeting sequence with ATCN PAM
guuggugccuggcaccuaag

SEQ ID NO: 1412 - RNA, 20 nt, Artificial Sequence
  targeting sequence with ATCN PAM
guggauuuacuggcccuuaa

SEQ ID NO: 1413 - RNA, 20 nt, Artificial Sequence
  targeting sequence with ATCN PAM
acagauacuuacugaguccc

SEQ ID NO: 1414 - RNA, 20 nt, Artificial Sequence
  targeting sequence with ATCN PAM
uaaaggcuagacaacaugag

SEQ ID NO: 1415 - RNA, 20 nt, Artificial Sequence
  targeting sequence with ATCN PAM
ggacaaagagcuaacuacug

SEQ ID NO: 1416 - RNA, 20 nt, Artificial Sequence
  targeting sequence with ATCN PAM
acucaguaguuagcucuuug

SEQ ID NO: 1417 - RNA, 20 nt, Artificial Sequence
  targeting sequence with ATCN PAM
ugauugaaugggcugcugug

SEQ ID NO: 1418 - RNA, 20 nt, Artificial Sequence
  targeting sequence with ATCN PAM
ugauccacucaguaguuagc

SEQ ID NO: 1419 - RNA, 20 nt, Artificial Sequence
  targeting sequence with ATCN PAM
uuuugguuccuaauugucuu

SEQ ID NO: 1420 - RNA, 20 nt, Artificial Sequence
  targeting sequence with ATCN PAM
cauuuaagccugauggaacu

SEQ ID NO: 1421 - RNA, 20 nt, Artificial Sequence
  targeting sequence with ATCN PAM
ggcuuaaaugcgaugucauu

SEQ ID NO: 1422 - RNA, 20 nt, Artificial Sequence
  targeting sequence with ATCN PAM
guugaguuccaucaggcuua

SEQ ID NO: 1423 - RNA, 20 nt, Artificial Sequence
  targeting sequence with ATCN PAM
gcuuccggcagccaaaauca

SEQ ID NO: 1424 - RNA, 20 nt, Artificial Sequence
  targeting sequence with ATCN PAM
uaccaguaaucugcuuccgg

SEQ ID NO: 1425 - RNA, 20 nt, Artificial Sequence
  targeting sequence with ATCN PAM
caaaaaaaaaaaaaaagggu

SEQ ID NO: 1426 - RNA, 20 nt, Artificial Sequence
  targeting sequence with ATCN PAM
cuauuaaaaaguaauaggga

SEQ ID NO: 1427 - RNA, 20 nt, Artificial Sequence
  targeting sequence with ATCN PAM
gauaagaaccugugaacaau

SEQ ID NO: 1428 - RNA, 20 nt, Artificial Sequence
  targeting sequence with ATCN PAM
gauaguuuacuugcccguuu

SEQ ID NO: 1429 - RNA, 20 nt, Artificial Sequence
  targeting sequence with ATCN PAM
uucccuuuuuacuuugagac

SEQ ID NO: 1430 - RNA, 20 nt, Artificial Sequence
  targeting sequence with ATCN PAM
caaugccuuugaaacuggac

SEQ ID NO: 1431 - RNA, 20 nt, Artificial Sequence
  targeting sequence with ATCN PAM
gacuuuucauggacacagca

SEQ ID NO: 1432 - RNA, 20 nt, Artificial Sequence
  targeting sequence with ATCN PAM
aaacaguuccauauggaugu

SEQ ID NO: 1433 - RNA, 20 nt, Artificial Sequence
  targeting sequence with ATCN PAM
auauggaacuguuuagauag

SEQ ID NO: 1434 - RNA, 20 nt, Artificial Sequence
  targeting sequence with ATCN PAM
agguauauaaaaguaauuuu

SEQ ID NO: 1435 - RNA, 20 nt, Artificial Sequence
  targeting sequence with ATCN PAM
uacaaagguuuuuuggucaa

SEQ ID NO: 1436 - RNA, 20 nt, Artificial Sequence
  targeting sequence with ATCN PAM
cucuuucugucuaagucuac

SEQ ID NO: 1437 - RNA, 20 nt, Artificial Sequence
  targeting sequence with ATCN PAM
agagacaacagagaagagga

SEQ ID NO: 1438 - RNA, 20 nt, Artificial Sequence
  targeting sequence with ATCN PAM
gucugcguaucuagagacaa

SEQ ID NO: 1439 - RNA, 20 nt, Artificial Sequence
  targeting sequence with ATCN PAM
ccauucuuuguaugguuaac

SEQ ID NO: 1440 - RNA, 20 nt, Artificial Sequence
  targeting sequence with ATCN PAM
uaaaacaugguuaaauuguu

SEQ ID NO: 1441 - RNA, 20 nt, Artificial Sequence
  targeting sequence with ATCN PAM
aaacucuauuaguuuuucua

SEQ ID NO: 1442 - RNA, 20 nt, Artificial Sequence
  targeting sequence with ATCN PAM
uuuccaauacucuaaccauu

SEQ ID NO: 1443 - RNA, 20 nt, Artificial Sequence
  targeting sequence with ATCN PAM
agcggaaacuuucugaaaug

SEQ ID NO: 1444 - RNA, 20 nt, Artificial Sequence
  targeting sequence with ATCN PAM
gagaaaucaagcggaaacuu

SEQ ID NO: 1445 - RNA, 20 nt, Artificial Sequence
  targeting sequence with ATCN PAM
cgucacugcacuccagccug

SEQ ID NO: 1446 - RNA, 20 nt, Artificial Sequence
  targeting sequence with ATCN PAM
cggcuuacugcaagcuccac

SEQ ID NO: 1447 - RNA, 20 nt, Artificial Sequence
  targeting sequence with ATCN PAM
uggcuaacacggagaaaccc

SEQ ID NO: 1448 - RNA, 20 nt, Artificial Sequence
  targeting sequence with ATCN PAM
agaccauccuggcuaacacg

SEQ ID NO: 1449 - RNA, 20 nt, Artificial Sequence
  targeting sequence with ATCN PAM
ccugaccucguaauccaccc

SEQ ID NO: 1450 - RNA, 20 nt, Artificial Sequence
  targeting sequence with ATCN PAM
acccaccucggccucccaaa

SEQ ID NO: 1451 - RNA, 20 nt, Artificial Sequence
  targeting sequence with ATCN PAM
cagcacuuugggaggccgag

SEQ ID NO: 1452 - RNA, 20 nt, Artificial Sequence
  targeting sequence with ATCN PAM
ggccgggcgcgguggcucac

SEQ ID NO: 1453 - RNA, 20 nt, Artificial Sequence
  targeting sequence with ATCN PAM
cuauguggagaguuuaaaaa

SEQ ID NO: 1454 - RNA, 20 nt, Artificial Sequence
  targeting sequence with ATCN PAM
aucacuauguggagaguuua

SEQ ID NO: 1455 - RNA, 20 nt, Artificial Sequence
  targeting sequence with ATCN PAM
aauaccuaaauccauauuac

SEQ ID NO: 1456 - RNA, 20 nt, Artificial Sequence
  targeting sequence with ATCN PAM
auauuacagcuggguuuuau

SEQ ID NO: 1457 - RNA, 20 nt, Artificial Sequence
  targeting sequence with ATCN PAM
augacugcacuacugcacac

SEQ ID NO: 1458 - RNA, 20 nt, Artificial Sequence
  targeting sequence with ATCN PAM
cugcagccucaaacuccugg

SEQ ID NO: 1459 - RNA, 20 nt, Artificial Sequence
  targeting sequence with ATCN PAM
cuuaagcccaggaguuugag

SEQ ID NO: 1460 - RNA, 20 nt, Artificial Sequence
  targeting sequence with ATCN PAM
ucccaccucagccucccgag

SEQ ID NO: 1461 - RNA, 20 nt, Artificial Sequence
  targeting sequence with ATCN PAM
guagccaauaaaaacugcac

SEQ ID NO: 1462 - RNA, 20 nt, Artificial Sequence
  targeting sequence with ATCN PAM
auuagucagaauuccugcag

SEQ ID NO: 1463 - RNA, 20 nt, Artificial Sequence
  targeting sequence with ATCN PAM
cauagauaaucuguauuugu

SEQ ID NO: 1464 - RNA, 20 nt, Artificial Sequence
  targeting sequence with ATCN PAM
augugauaucuauuagucag

SEQ ID NO: 1465 - RNA, 20 nt, Artificial Sequence
  targeting sequence with ATCN PAM
guauuugucucuuuugccag

SEQ ID NO: 1466 - RNA, 20 nt, Artificial Sequence
  targeting sequence with ATCN PAM
gaggugucauaaaccuggca

SEQ ID NO: 1467 - RNA, 20 nt, Artificial Sequence
  targeting sequence with ATCN PAM
uucgcauaugccacacagua

SEQ ID NO: 1468 - RNA, 20 nt, Artificial Sequence
  targeting sequence with ATCN PAM
caaugagcccacccucacua

SEQ ID NO: 1469 - RNA, 20 nt, Artificial Sequence
  targeting sequence with ATCN PAM
cauugccuccugacuucaaa

SEQ ID NO: 1470 - RNA, 20 nt, Artificial Sequence
  targeting sequence with ATCN PAM
gggggaagagagcucuuugc

SEQ ID NO: 1471 - RNA, 20 nt, Artificial Sequence
  targeting sequence with ATCN PAM
cuccucugcugaggaccuuu

SEQ ID NO: 1472 - RNA, 20 nt, Artificial Sequence
  targeting sequence with ATCN PAM
gauuugauuuguauuuuaaa

SEQ ID NO: 1473 - RNA, 20 nt, Artificial Sequence
  targeting sequence with ATCN PAM
gaucccuccucugcugagga

SEQ ID NO: 1474 - RNA, 20 nt, Artificial Sequence
  targeting sequence with ATCN PAM
aaucagaucccuccucugcu

SEQ ID NO: 1475 - RNA, 20 nt, Artificial Sequence
  targeting sequence with ATCN PAM
uuuuaaaauacaaaucaaau

SEQ ID NO: 1476 - RNA, 20 nt, Artificial Sequence
  targeting sequence with ATCN PAM
ucaaaugugcuugcaaaacc

SEQ ID NO: 1477 - RNA, 20 nt, Artificial Sequence
  targeting sequence with ATCN PAM
caguuucaugcaccacuucc

SEQ ID NO: 1478 - RNA, 20 nt, Artificial Sequence
  targeting sequence with ATCN PAM
auguugucccacagcauagg

SEQ ID NO: 1479 - RNA, 20 nt, Artificial Sequence
  targeting sequence with ATCN PAM
uaugcugugggacaacaugg

SEQ ID NO: 1480 - RNA, 20 nt, Artificial Sequence
  targeting sequence with ATCN PAM
ugacucagacucaauaacca

SEQ ID NO: 1481 - RNA, 20 nt, Artificial Sequence
  targeting sequence with ATCN PAM
aauggauaacauugagauaa

SEQ ID NO: 1482 - RNA, 20 nt, Artificial Sequence
  targeting sequence with ATCN PAM
auuugauacaugaagaaauc

SEQ ID NO: 1483 - RNA, 20 nt, Artificial Sequence
  targeting sequence with ATCN PAM
gccaaaagaaguuaaaaacc

SEQ ID NO: 1484 - RNA, 20 nt, Artificial Sequence
  targeting sequence with ATCN PAM
aagaggcccaucagccaaaa

SEQ ID NO: 1485 - RNA, 20 nt, Artificial Sequence
  targeting sequence with ATCN PAM
gauggaagcuuuagaccacu

SEQ ID NO: 1486 - RNA, 20 nt, Artificial Sequence
  targeting sequence with ATCN PAM
gauuaucaaagaggcccauc

SEQ ID NO: 1487 - RNA, 20 nt, Artificial Sequence
  targeting sequence with ATCN PAM
uucuagaaaguggucuaaag

SEQ ID NO: 1488 - RNA, 20 nt, Artificial Sequence
  targeting sequence with ATCN PAM
gacuaaaauuauaugcauga

SEQ ID NO: 1489 - RNA, 20 nt, Artificial Sequence
  targeting sequence with ATCN PAM
uacugaaauccuaaagcucu

SEQ ID NO: 1490 - RNA, 20 nt, Artificial Sequence
  targeting sequence with ATCN PAM
uaaagcucugggagccugag

SEQ ID NO: 1491 - RNA, 20 nt, Artificial Sequence
  targeting sequence with ATCN PAM
ucccaacucaggcucccaga

SEQ ID NO: 1492 - RNA, 20 nt, Artificial Sequence
  targeting sequence with ATCN PAM
ggccugggugacagagcuag

SEQ ID NO: 1493 - RNA, 20 nt, Artificial Sequence
  targeting sequence with ATCN PAM
gcugcauggccuuggcaagu

SEQ ID NO: 1494 - RNA, 20 nt, Artificial Sequence
  targeting sequence with ATCN PAM
uaguggcuguugaggaaugu

SEQ ID NO: 1495 - RNA, 20 nt, Artificial Sequence
  targeting sequence with ATCN PAM
ucaagugcccuaaugguguu

SEQ ID NO: 1496 - RNA, 20 nt, Artificial Sequence
  targeting sequence with ATCN PAM
guaguggcauuugcacagca

SEQ ID NO: 1497 - RNA, 20 nt, Artificial Sequence
  targeting sequence with ATCN PAM
cacuugaugcuuccaacaac

SEQ ID NO: 1498 - RNA, 20 nt, Artificial Sequence
  targeting sequence with ATCN PAM
agugagaugugugugacagg

SEQ ID NO: 1499 - RNA, 20 nt, Artificial Sequence
  targeting sequence with ATCN PAM
ccgcucaaagaugagaaaac

SEQ ID NO: 1500 - RNA, 20 nt, Artificial Sequence
  targeting sequence with ATCN PAM
uugagcggagauaagagucc

SEQ ID NO: 1501 - RNA, 20 nt, Artificial Sequence
  targeting sequence with ATCN PAM
ccuguaauugcuccaagucu

SEQ ID NO: 1502 - RNA, 20 nt, Artificial Sequence
  targeting sequence with ATCN PAM
ugcugccucuucaugacacc

SEQ ID NO: 1503 - RNA, 20 nt, Artificial Sequence
  targeting sequence with ATCN PAM
gcauguaauuucugaacccc

SEQ ID NO: 1504 - RNA, 20 nt, Artificial Sequence
  targeting sequence with ATCN PAM
agcuuauuuuaagaauacaa

SEQ ID NO: 1505 - RNA, 20 nt, Artificial Sequence
  targeting sequence with ATCN PAM
acuuccauuuaaugaagagu

SEQ ID NO: 1506 - RNA, 20 nt, Artificial Sequence
  targeting sequence with ATCN PAM
ucauaaaggucuucaucuuc

SEQ ID NO: 1507 - RNA, 20 nt, Artificial Sequence
  targeting sequence with ATCN PAM
uaaaggucuucaucuucauu

SEQ ID NO: 1508 - RNA, 20 nt, Artificial Sequence
  targeting sequence with ATCN PAM
ucauugucuucagguugaau

SEQ ID NO: 1509 - RNA, 20 nt, Artificial Sequence
  targeting sequence with ATCN PAM
cucuuccuccuccuccuccu

SEQ ID NO: 1510 - RNA, 20 nt, Artificial Sequence
  targeting sequence with ATCN PAM
ccaaucccucuuccuccucc

SEQ ID NO: 1511 - RNA, 20 nt, Artificial Sequence
  targeting sequence with ATCN PAM
ucacaccaaccaugagguaa

SEQ ID NO: 1512 - RNA, 20 nt, Artificial Sequence
  targeting sequence with ATCN PAM
auuuuucaaauaaggaaaug

SEQ ID NO: 1513 - RNA, 20 nt, Artificial Sequence
  targeting sequence with ATCN PAM
ccaucaccugcuaccuacca

SEQ ID NO: 1514 - RNA, 20 nt, Artificial Sequence
  targeting sequence with ATCN PAM
ccugcuaccuaccaggauga

SEQ ID NO: 1515 - RNA, 20 nt, Artificial Sequence
  targeting sequence with ATCN PAM
ugguagguagcaggugaugg

SEQ ID NO: 1516 - RNA, 20 nt, Artificial Sequence
  targeting sequence with ATCN PAM
cuccucccucauccugguag

SEQ ID NO: 1517 - RNA, 20 nt, Artificial Sequence
  targeting sequence with ATCN PAM
uauggcucacccuaauaucu

SEQ ID NO: 1518 - RNA, 20 nt, Artificial Sequence
  targeting sequence with ATCN PAM
acuauuucagcuacuguaaa

SEQ ID NO: 1519 - RNA, 20 nt, Artificial Sequence
  targeting sequence with ATCN PAM
caagcaugagccaccacacc

SEQ ID NO: 1520 - RNA, 20 nt, Artificial Sequence
  targeting sequence with ATCN PAM
cagcacuuugggaagccaag

SEQ ID NO: 1521 - RNA, 20 nt, Artificial Sequence
  targeting sequence with ATCN PAM
acccgccuuggcuucccaaa

SEQ ID NO: 1522 - RNA, 20 nt, Artificial Sequence
  targeting sequence with ATCN PAM
ugaggucaggaguuugagac

SEQ ID NO: 1523 - RNA, 20 nt, Artificial Sequence
  targeting sequence with ATCN PAM
guaaaguaccuuuuuuuuga

SEQ ID NO: 1524 - RNA, 20 nt, Artificial Sequence
  targeting sequence with ATCN PAM
uaguugacucccauaaaaag

SEQ ID NO: 1525 - RNA, 20 nt, Artificial Sequence
  targeting sequence with ATCN PAM
uccucagagucuuuuuaugg

SEQ ID NO: 1526 - RNA, 20 nt, Artificial Sequence
  targeting sequence with ATCN PAM
gaaacacagaggaacaguau

SEQ ID NO: 1527 - RNA, 20 nt, Artificial Sequence
  targeting sequence with ATCN PAM
uaaggacuuuuagacuuuau

SEQ ID NO: 1528 - RNA, 20 nt, Artificial Sequence
  targeting sequence with ATCN PAM
gaucuaucacucuuugcuua

SEQ ID NO: 1529 - RNA, 20 nt, Artificial Sequence
  targeting sequence with ATCN PAM
gauucgcauuuucauacuac

SEQ ID NO: 1530 - RNA, 20 nt, Artificial Sequence
  targeting sequence with ATCN PAM
aucacucuuugcuuaaaacc

SEQ ID NO: 1531 - RNA, 20 nt, Artificial Sequence
  targeting sequence with ATCN PAM
cucuuugcuuaaaaccuuuc

SEQ ID NO: 1532 - RNA, 20 nt, Artificial Sequence
  targeting sequence with ATCN PAM
uaaagcaaugggaagccaaa

SEQ ID NO: 1533 - RNA, 20 nt, Artificial Sequence
  targeting sequence with ATCN PAM
guuccauccauguggauggg

SEQ ID NO: 1534 - RNA, 20 nt, Artificial Sequence
  targeting sequence with ATCN PAM
auguggaugggucugucucc

SEQ ID NO: 1535 - RNA, 20 nt, Artificial Sequence
  targeting sequence with ATCN PAM
acauggauggaacagaugug

SEQ ID NO: 1536 - RNA, 20 nt, Artificial Sequence
  targeting sequence with ATCN PAM
ggcuaagcucugcucauccu

SEQ ID NO: 1537 - RNA, 20 nt, Artificial Sequence
  targeting sequence with ATCN PAM
uuuaggucuccacugaagga

SEQ ID NO: 1538 - RNA, 20 nt, Artificial Sequence
  targeting sequence with ATCN PAM
uucaguggagaccuaaagga

SEQ ID NO: 1539 - RNA, 20 nt, Artificial Sequence
  targeting sequence with ATCN PAM
cauccuuagagaaauguucc

SEQ ID NO: 1540 - RNA, 20 nt, Artificial Sequence
  targeting sequence with ATCN PAM
uuagagaaauguucccucau

SEQ ID NO: 1541 - RNA, 20 nt, Artificial Sequence
  targeting sequence with ATCN PAM
aaauuaggucccccaggaga

SEQ ID NO: 1542 - RNA, 20 nt, Artificial Sequence
  targeting sequence with ATCN PAM
ccugggggaccuaauuuaga

SEQ ID NO: 1543 - RNA, 20 nt, Artificial Sequence
  targeting sequence with ATCN PAM
caaaaauguacuccuuuugu

SEQ ID NO: 1544 - RNA, 20 nt, Artificial Sequence
  targeting sequence with ATCN PAM
auugcacagcauggugacca

SEQ ID NO: 1545 - RNA, 20 nt, Artificial Sequence
  targeting sequence with ATCN PAM
auuccuggccgggaacagug

SEQ ID NO: 1546 - RNA, 20 nt, Artificial Sequence
  targeting sequence with ATCN PAM
gcagugauggauauguuaau

SEQ ID NO: 1547 - RNA, 20 nt, Artificial Sequence
  targeting sequence with ATCN PAM
cugcagauacuuauuuuuuu

SEQ ID NO: 1548 - RNA, 20 nt, Artificial Sequence
  targeting sequence with ATCN PAM
aucacugcagauacuuauuu

SEQ ID NO: 1549 - RNA, 20 nt, Artificial Sequence
  targeting sequence with ATCN PAM
gguuccccaguuauucucuu

SEQ ID NO: 1550 - RNA, 20 nt, Artificial Sequence
  targeting sequence with ATCN PAM
uaugaaagagaauaacuggg

SEQ ID NO: 1551 - RNA, 20 nt, Artificial Sequence
  targeting sequence with ATCN PAM
gugucuuaccauguuguauu

SEQ ID NO: 1552 - RNA, 20 nt, Artificial Sequence
  targeting sequence with ATCN PAM
aacacaaauacaacauggua

SEQ ID NO: 1553 - RNA, 20 nt, Artificial Sequence
  targeting sequence with ATCN PAM
uaaaccagcauuucccagag

SEQ ID NO: 1554 - RNA, 20 nt, Artificial Sequence
  targeting sequence with ATCN PAM
agaagcaaagcgcuugccua

SEQ ID NO: 1555 - RNA, 20 nt, Artificial Sequence
  targeting sequence with ATCN PAM
gcugacaaaagcguuauuau

SEQ ID NO: 1556 - RNA, 20 nt, Artificial Sequence
  targeting sequence with ATCN PAM
ggacaucaaaacuggaaggc

SEQ ID NO: 1557 - RNA, 20 nt, Artificial Sequence
  targeting sequence with ATCN PAM
aaacuggaaggcauucugaa

SEQ ID NO: 1558 - RNA, 20 nt, Artificial Sequence
  targeting sequence with ATCN PAM
aacucauaauacuguacacc

SEQ ID NO: 1559 - RNA, 20 nt, Artificial Sequence
  targeting sequence with ATCN PAM
caguucaucugacauuguag

SEQ ID NO: 1560 - RNA, 20 nt, Artificial Sequence
  targeting sequence with ATCN PAM
gacauuguagacuuuauccc

SEQ ID NO: 1561 - RNA, 20 nt, Artificial Sequence
  targeting sequence with ATCN PAM
cacccccaaccugucaucuu

SEQ ID NO: 1562 - RNA, 20 nt, Artificial Sequence
  targeting sequence with ATCN PAM
uccagugucccugucucaga

SEQ ID NO: 1563 - RNA, 20 nt, Artificial Sequence
  targeting sequence with ATCN PAM
acccagugucaaaugucaga

SEQ ID NO: 1564 - RNA, 20 nt, Artificial Sequence
  targeting sequence with ATCN PAM
guucuuauggaacuuacagg

SEQ ID NO: 1565 - RNA, 20 nt, Artificial Sequence
  targeting sequence with ATCN PAM
auuuuuuguuuuguuuuguu

SEQ ID NO: 1566 - RNA, 20 nt, Artificial Sequence
  targeting sequence with ATCN PAM
ucuuacuucagcuucccaaa

SEQ ID NO: 1567 - RNA, 20 nt, Artificial Sequence
  targeting sequence with ATCN PAM
caguacuuugagaggacugc

SEQ ID NO: 1568 - RNA, 20 nt, Artificial Sequence
  targeting sequence with ATCN PAM
uucucccuuggccgcccaaa

SEQ ID NO: 1569 - RNA, 20 nt, Artificial Sequence
  targeting sequence with ATCN PAM
cagcaguuugggcggccaag

SEQ ID NO: 1570 - RNA, 20 nt, Artificial Sequence
  targeting sequence with ATCN PAM
auucaucuguugauggacac

SEQ ID NO: 1571 - RNA, 20 nt, Artificial Sequence
  targeting sequence with ATCN PAM
guugauggacacuuguguug

SEQ ID NO: 1572 - RNA, 20 nt, Artificial Sequence
  targeting sequence with ATCN PAM
acagaugaauggauaaagaa

SEQ ID NO: 1573 - RNA, 20 nt, Artificial Sequence
  targeting sequence with ATCN PAM
acaaacaauuuuugaaggaa

SEQ ID NO: 1574 - RNA, 20 nt, Artificial Sequence
  targeting sequence with ATCN PAM
uguaccaugcaaggcgucuc

SEQ ID NO: 1575 - RNA, 20 nt, Artificial Sequence
  targeting sequence with ATCN PAM
uuagacaacaaugaaagcug

SEQ ID NO: 1576 - RNA, 20 nt, Artificial Sequence
  targeting sequence with ATCN PAM
ggaaacaugacaaauccuua

SEQ ID NO: 1577 - RNA, 20 nt, Artificial Sequence
  targeting sequence with ATCN PAM
uggucugugaugucuucauu

SEQ ID NO: 1578 - RNA, 20 nt, Artificial Sequence
  targeting sequence with ATCN PAM
cagaccaagaucuggaaaca

SEQ ID NO: 1579 - RNA, 20 nt, Artificial Sequence
  targeting sequence with ATCN PAM
uccauuucugggccuccaca

SEQ ID NO: 1580 - RNA, 20 nt, Artificial Sequence
  targeting sequence with ATCN PAM
guggcuguuacucuuacugu

SEQ ID NO: 1581 - RNA, 20 nt, Artificial Sequence
  targeting sequence with ATCN PAM
ucccaccuuggccuuuaggu

SEQ ID NO: 1582 - RNA, 20 nt, Artificial Sequence
  targeting sequence with ATCN PAM
auccucccaccuuggccuuu

SEQ ID NO: 1583 - RNA, 20 nt, Artificial Sequence
  targeting sequence with ATCN PAM
cuacaaauaagaaaacagug

SEQ ID NO: 1584 - RNA, 20 nt, Artificial Sequence
  targeting sequence with ATCN PAM
ucaguuguagccacugaaau

SEQ ID NO: 1585 - RNA, 20 nt, Artificial Sequence
  targeting sequence with ATCN PAM
uugugguuugcugcauagua

SEQ ID NO: 1586 - RNA, 20 nt, Artificial Sequence
  targeting sequence with ATCN PAM
acaguuguuuacuucccagg

SEQ ID NO: 1587 - RNA, 20 nt, Artificial Sequence
  targeting sequence with ATCN PAM
uugugccugggaaguaaaca

SEQ ID NO: 1588 - RNA, 20 nt, Artificial Sequence
  targeting sequence with ATCN PAM
uauuacucaucaacuggcau

SEQ ID NO: 1589 - RNA, 20 nt, Artificial Sequence
  targeting sequence with ATCN PAM
acuggcaucuuguuccucca

SEQ ID NO: 1590 - RNA, 20 nt, Artificial Sequence
  targeting sequence with ATCN PAM
uguuccuccagugacuuugg

SEQ ID NO: 1591 - RNA, 20 nt, Artificial Sequence
  targeting sequence with ATCN PAM
gaacguaccaaagucacugg

SEQ ID NO: 1592 - RNA, 20 nt, Artificial Sequence
  targeting sequence with ATCN PAM
ggaaucagaacguaccaaag

SEQ ID NO: 1593 - RNA, 20 nt, Artificial Sequence
  targeting sequence with ATCN PAM
gggcuaaaaaugcuaaaaug

SEQ ID NO: 1594 - RNA, 20 nt, Artificial Sequence
  targeting sequence with ATCN PAM
ccauauucugaaugcauuuu

SEQ ID NO: 1595 - RNA, 20 nt, Artificial Sequence
  targeting sequence with ATCN PAM
ugagagaguuaauacuacuu

SEQ ID NO: 1596 - RNA, 20 nt, Artificial Sequence
  targeting sequence with ATCN PAM
gagacuacaggaagggcccc

SEQ ID NO: 1597 - RNA, 20 nt, Artificial Sequence
  targeting sequence with ATCN PAM
uguuaccauuuccuuugcug

SEQ ID NO: 1598 - RNA, 20 nt, Artificial Sequence
  targeting sequence with ATCN PAM
auguuuaugugaaauucuuc

SEQ ID NO: 1599 - RNA, 20 nt, Artificial Sequence
  targeting sequence with ATCN PAM
uggccacggucccgugccag

SEQ ID NO: 1600 - RNA, 20 nt, Artificial Sequence
  targeting sequence with ATCN PAM
accauuaauggaaauaaccu

SEQ ID NO: 1601 - RNA, 20 nt, Artificial Sequence
  targeting sequence with ATCN PAM
gucuguguucguugcuagug

SEQ ID NO: 1602 - RNA, 20 nt, Artificial Sequence
  targeting sequence with ATCN PAM
acuagcaacgaacacagacu

SEQ ID NO: 1603 - RNA, 20 nt, Artificial Sequence
  targeting sequence with ATCN PAM
agugacuucauuguauccac

SEQ ID NO: 1604 - RNA, 20 nt, Artificial Sequence
  targeting sequence with ATCN PAM
cucucaguguuccaguuccc

SEQ ID NO: 1605 - RNA, 20 nt, Artificial Sequence
  targeting sequence with ATCN PAM
aaaaggagcaugcuacucac

SEQ ID NO: 1606 - RNA, 20 nt, Artificial Sequence
  targeting sequence with ATCN PAM
gugagacacagugaguagca

SEQ ID NO: 1607 - RNA, 20 nt, Artificial Sequence
  targeting sequence with ATCN PAM
cuacccucaaggagcuugug

SEQ ID NO: 1608 - RNA, 20 nt, Artificial Sequence
  targeting sequence with ATCN PAM
caccuucuccuaagaccaca

SEQ ID NO: 1609 - RNA, 20 nt, Artificial Sequence
  targeting sequence with ATCN PAM
uuagaacagugccuagcaca

SEQ ID NO: 1610 - RNA, 20 nt, Artificial Sequence
  targeting sequence with ATCN PAM
guagggugggaaugagaaua

SEQ ID NO: 1611 - RNA, 20 nt, Artificial Sequence
  targeting sequence with ATCN PAM
ccuggucuaaaguccaagcc

SEQ ID NO: 1612 - RNA, 20 nt, Artificial Sequence
  targeting sequence with ATCN PAM
guguuccacuaagccugccu

SEQ ID NO: 1613 - RNA, 20 nt, Artificial Sequence
  targeting sequence with ATCN PAM
aacaaguuauuuuuugccuu

SEQ ID NO: 1614 - RNA, 20 nt, Artificial Sequence
  targeting sequence with ATCN PAM
agaagguaacuccagugcac

SEQ ID NO: 1615 - RNA, 20 nt, Artificial Sequence
  targeting sequence with ATCN PAM
gggacaggggggagcaagcc

SEQ ID NO: 1616 - RNA, 20 nt, Artificial Sequence
  targeting sequence with ATCN PAM
gagcugugccucucccaugg

SEQ ID NO: 1617 - RNA, 20 nt, Artificial Sequence
  targeting sequence with ATCN PAM
caacacaugacucuaucuga

SEQ ID NO: 1618 - RNA, 20 nt, Artificial Sequence
  targeting sequence with ATCN PAM
aguuuucuuucauaggucuc

SEQ ID NO: 1619 - RNA, 20 nt, Artificial Sequence
  targeting sequence with ATCN PAM
uuguuauuuuaaaugcuagg

SEQ ID NO: 1620 - RNA, 20 nt, Artificial Sequence
  targeting sequence with ATCN PAM
cugaaaaguuggcuagaacu

SEQ ID NO: 1621 - RNA, 20 nt, Artificial Sequence
  targeting sequence with ATCN PAM
auuuuauuuuucuucugaaa

SEQ ID NO: 1622 - RNA, 20 nt, Artificial Sequence
  targeting sequence with ATCN PAM
uucuuucagaagaaaaauaa

SEQ ID NO: 1623 - RNA, 20 nt, Artificial Sequence
  targeting sequence with ATCN PAM
aucauucuuucagaagaaaa

SEQ ID NO: 1624 - RNA, 20 nt, Artificial Sequence
  targeting sequence with ATCN PAM
uuguaacuuacuaugaaucu

SEQ ID NO: 1625 - RNA, 20 nt, Artificial Sequence
  targeting sequence with ATCN PAM
aguuucccccaguggaucca

SEQ ID NO: 1626 - RNA, 20 nt, Artificial Sequence
  targeting sequence with ATCN PAM
acugggggaaacuggaugaa

SEQ ID NO: 1627 - RNA, 20 nt, Artificial Sequence
  targeting sequence with ATCN PAM
aucuuauguaacuauuauac

SEQ ID NO: 1628 - RNA, 20 nt, Artificial Sequence
  targeting sequence with ATCN PAM
uauguaacuauuauacaaua

SEQ ID NO: 1629 - RNA, 20 nt, Artificial Sequence
  targeting sequence with ATCN PAM
agaccaggaaacugagacug

SEQ ID NO: 1630 - RNA, 20 nt, Artificial Sequence
  targeting sequence with ATCN PAM
cauguguagauugccaucag

SEQ ID NO: 1631 - RNA, 20 nt, Artificial Sequence
  targeting sequence with ATCN PAM
acacaugcgauaaaacaaca

SEQ ID NO: 1632 - RNA, 20 nt, Artificial Sequence
  targeting sequence with ATCN PAM
gcgugacacagaacuaagcc

SEQ ID NO: 1633 - RNA, 20 nt, Artificial Sequence
  targeting sequence with ATCN PAM
ccaugcaguuaccacuuagu

SEQ ID NO: 1634 - RNA, 20 nt, Artificial Sequence
  targeting sequence with ATCN PAM
acucaccuuaccuccaguua

SEQ ID NO: 1635 - RNA, 20 nt, Artificial Sequence
  targeting sequence with ATCN PAM
ccaaacccugguaaccacaa

SEQ ID NO: 1636 - RNA, 20 nt, Artificial Sequence
  targeting sequence with ATCN PAM
guucuccauuucuauaauuu

SEQ ID NO: 1637 - RNA, 20 nt, Artificial Sequence
  targeting sequence with ATCN PAM
uacaguauaugaccuuuuga

SEQ ID NO: 1638 - RNA, 20 nt, Artificial Sequence
  targeting sequence with ATCN PAM
caaaaggucauauacuguac

SEQ ID NO: 1639 - RNA, 20 nt, Artificial Sequence
  targeting sequence with ATCN PAM
uggagauccaucuaaguugu

SEQ ID NO: 1640 - RNA, 20 nt, Artificial Sequence
  targeting sequence with ATCN PAM
ccaggauuuuaugcugaaug

SEQ ID NO: 1641 - RNA, 20 nt, Artificial Sequence
  targeting sequence with ATCN PAM
aucuaaguuguuguauguuu

SEQ ID NO: 1642 - RNA, 20 nt, Artificial Sequence
  targeting sequence with ATCN PAM
aaguuguuguauguuucaau

SEQ ID NO: 1643 - RNA, 20 nt, Artificial Sequence
  targeting sequence with ATCN PAM
aucuucuuuuauauuauugu

SEQ ID NO: 1644 - RNA, 20 nt, Artificial Sequence
  targeting sequence with ATCN PAM
ucuuuuauauuauugugcau

SEQ ID NO: 1645 - RNA, 20 nt, Artificial Sequence
  targeting sequence with ATCN PAM
agcagcaagaucaucugcug

SEQ ID NO: 1646 - RNA, 20 nt, Artificial Sequence
  targeting sequence with ATCN PAM
ugcugcuugauuuguguuug

SEQ ID NO: 1647 - RNA, 20 nt, Artificial Sequence
  targeting sequence with ATCN PAM
ucugcugcagguaagugcag

SEQ ID NO: 1648 - RNA, 20 nt, Artificial Sequence
  targeting sequence with ATCN PAM
gcugcagguaagugcagcuc

SEQ ID NO: 1649 - RNA, 20 nt, Artificial Sequence
  targeting sequence with ATCN PAM
ucagagcugcacuuaccugc

SEQ ID NO: 1650 - RNA, 20 nt, Artificial Sequence
  targeting sequence with ATCN PAM
uaucgucagagcugcacuua

SEQ ID NO: 1651 - RNA, 20 nt, Artificial Sequence
  targeting sequence with ATCN PAM
uccacacagacucucaaaau

SEQ ID NO: 1652 - RNA, 20 nt, Artificial Sequence
  targeting sequence with ATCN PAM
aauuauuucaugcagcagag

SEQ ID NO: 1653 - RNA, 20 nt, Artificial Sequence
  targeting sequence with ATCN PAM
aggagacgaagaaagaagaa

SEQ ID NO: 1654 - RNA, 20 nt, Artificial Sequence
  targeting sequence with ATCN PAM
aaggcacaagucuuucccau

SEQ ID NO: 1655 - RNA, 20 nt, Artificial Sequence
  targeting sequence with ATCN PAM
ugaagcaaaagagaacuaca

SEQ ID NO: 1656 - RNA, 20 nt, Artificial Sequence
  targeting sequence with ATCN PAM
agcuauacugaguggaggcu

SEQ ID NO: 1657 - RNA, 20 nt, Artificial Sequence
  targeting sequence with ATCN PAM
aagugugggagggaaagcuu

SEQ ID NO: 1658 - RNA, 20 nt, Artificial Sequence
  targeting sequence with ATCN PAM
agaaucucucauugacaggc

SEQ ID NO: 1659 - RNA, 20 nt, Artificial Sequence
  targeting sequence with ATCN PAM
cucauugacaggccauguga

SEQ ID NO: 1660 - RNA, 20 nt, Artificial Sequence
  targeting sequence with ATCN PAM
uucugagcuggagcuuuacg

SEQ ID NO: 1661 - RNA, 20 nt, Artificial Sequence
  targeting sequence with ATCN PAM
gacagauagggauaaaaaua

SEQ ID NO: 1662 - RNA, 20 nt, Artificial Sequence
  targeting sequence with ATCN PAM
gucagaugaggaacguaaag

SEQ ID NO: 1663 - RNA, 20 nt, Artificial Sequence
  targeting sequence with ATCN PAM
cuaucugucagaugaggaac

SEQ ID NO: 1664 - RNA, 20 nt, Artificial Sequence
  targeting sequence with ATCN PAM
cgucaagucaguauuuuuau

SEQ ID NO: 1665 - RNA, 20 nt, Artificial Sequence
  targeting sequence with ATCN PAM
cuuccguucagcaucuguug

SEQ ID NO: 1666 - RNA, 20 nt, Artificial Sequence
  targeting sequence with ATCN PAM
guugagcaccuucuacaaag

SEQ ID NO: 1667 - RNA, 20 nt, Artificial Sequence
  targeting sequence with ATCN PAM
ccucccacuuaaagagcacc

SEQ ID NO: 1668 - RNA, 20 nt, Artificial Sequence
  targeting sequence with ATCN PAM
caauccccucccacuuaaag

SEQ ID NO: 1669 - RNA, 20 nt, Artificial Sequence
  targeting sequence with ATCN PAM
cugggccagccaccacuucc

SEQ ID NO: 1670 - RNA, 20 nt, Artificial Sequence
  targeting sequence with ATCN PAM
ccaugccuuuuguugguugu

SEQ ID NO: 1671 - RNA, 20 nt, Artificial Sequence
  targeting sequence with ATCN PAM
uuuguccagcuguguacaca

SEQ ID NO: 1672 - RNA, 20 nt, Artificial Sequence
  targeting sequence with ATCN PAM
ccagcgccagguacugacca

SEQ ID NO: 1673 - RNA, 20 nt, Artificial Sequence
  targeting sequence with ATCN PAM
cauugaacauccccagcgcc

SEQ ID NO: 1674 - RNA, 20 nt, Artificial Sequence
  targeting sequence with ATCN PAM
ucagcauacggaacaaaaau

SEQ ID NO: 1675 - RNA, 20 nt, Artificial Sequence
  targeting sequence with ATCN PAM
gcauacggaacaaaaauggc

SEQ ID NO: 1676 - RNA, 20 nt, Artificial Sequence
  targeting sequence with ATCN PAM
uuacuuucuccucgccauuu

SEQ ID NO: 1677 - RNA, 20 nt, Artificial Sequence
  targeting sequence with ATCN PAM
agcggccggggggcucccuc

SEQ ID NO: 1678 - RNA, 20 nt, Artificial Sequence
  targeting sequence with ATCN PAM
gcuggaacccuucaagguac

SEQ ID NO: 1679 - RNA, 20 nt, Artificial Sequence
  targeting sequence with ATCN PAM
uggacauuuuagcaaagcag

SEQ ID NO: 1680 - RNA, 20 nt, Artificial Sequence
  targeting sequence with ATCN PAM
gcuuugcuaaaauguccagg

SEQ ID NO: 1681 - RNA, 20 nt, Artificial Sequence
  targeting sequence with ATCN PAM
auaguggagcucuuugcugu

SEQ ID NO: 1682 - RNA, 20 nt, Artificial Sequence
  targeting sequence with ATCN PAM
cuaggcuuuagggacgucug

SEQ ID NO: 1683 - RNA, 20 nt, Artificial Sequence
  targeting sequence with ATCN PAM
guauccuuuacagaguccuc

SEQ ID NO: 1684 - RNA, 20 nt, Artificial Sequence
  targeting sequence with ATCN PAM
uuuacagaguccucugaggg

SEQ ID NO: 1685 - RNA, 20 nt, Artificial Sequence
  targeting sequence with ATCN PAM
guaaaaugacauugagcugg

SEQ ID NO: 1686 - RNA, 20 nt, Artificial Sequence
  targeting sequence with ATCN PAM
aguaggcaaccaucuguaaa

SEQ ID NO: 1687 - RNA, 20 nt, Artificial Sequence
  targeting sequence with ATCN PAM
aacagcaggaacucuggggc

SEQ ID NO: 1688 - RNA, 20 nt, Artificial Sequence
  targeting sequence with ATCN PAM
ucucaccucagccucccaag

SEQ ID NO: 1689 - RNA, 20 nt, Artificial Sequence
  targeting sequence with ATCN PAM
aagcuacuugggaggcugag

SEQ ID NO: 1690 - RNA, 20 nt, Artificial Sequence
  targeting sequence with ATCN PAM
caggcacaugccacuacacc

SEQ ID NO: 1691 - RNA, 20 nt, Artificial Sequence
  targeting sequence with ATCN PAM
ggaguucaagaccagccugg

SEQ ID NO: 1692 - RNA, 20 nt, Artificial Sequence
  targeting sequence with ATCN PAM
cgagcgauucacuugccucg

SEQ ID NO: 1693 - RNA, 20 nt, Artificial Sequence
  targeting sequence with ATCN PAM
cucgagaucaggaguucaag

SEQ ID NO: 1694 - RNA, 20 nt, Artificial Sequence
  targeting sequence with ATCN PAM
cagcacuucaggaggccgag

SEQ ID NO: 1695 - RNA, 20 nt, Artificial Sequence
  targeting sequence with ATCN PAM
uggcaaggagccccuggggg

SEQ ID NO: 1696 - RNA, 20 nt, Artificial Sequence
  targeting sequence with ATCN PAM
gcuguagacaguaaguaguu

SEQ ID NO: 1697 - RNA, 20 nt, Artificial Sequence
  targeting sequence with ATCN PAM
agaaacucucccaucggcug

SEQ ID NO: 1698 - RNA, 20 nt, Artificial Sequence
  targeting sequence with ATCN PAM
ucauucucucuguucaucca

SEQ ID NO: 1699 - RNA, 20 nt, Artificial Sequence
  targeting sequence with ATCN PAM
ucggcauccucauucucucu

SEQ ID NO: 1700 - RNA, 20 nt, Artificial Sequence
  targeting sequence with ATCN PAM
guugacaaugacauccucgg

SEQ ID NO: 1701 - RNA, 20 nt, Artificial Sequence
  targeting sequence with ATCN PAM
cuuccacucugaagucagca

SEQ ID NO: 1702 - RNA, 20 nt, Artificial Sequence
  targeting sequence with ATCN PAM
gaaaaguugaacuuucuccu

SEQ ID NO: 1703 - RNA, 20 nt, Artificial Sequence
  targeting sequence with ATCN PAM
ccugaggaaaucacuguuag

SEQ ID NO: 1704 - RNA, 20 nt, Artificial Sequence
  targeting sequence with ATCN PAM
caacugaagagaagaaugac

SEQ ID NO: 1705 - RNA, 20 nt, Artificial Sequence
  targeting sequence with ATCN PAM
uggcuaccccagcuuucccc

SEQ ID NO: 1706 - RNA, 20 nt, Artificial Sequence
  targeting sequence with ATCN PAM
caguuuggcaguagagaucu

SEQ ID NO: 1707 - RNA, 20 nt, Artificial Sequence
  targeting sequence with ATCN PAM
cuacugccaaacugagauau

SEQ ID NO: 1708 - RNA, 20 nt, Artificial Sequence
  targeting sequence with ATCN PAM
agcuugagacuuuccaaacu

SEQ ID NO: 1709 - RNA, 20 nt, Artificial Sequence
  targeting sequence with ATCN PAM
cacccugaggucaugggggc

SEQ ID NO: 1710 - RNA, 20 nt, Artificial Sequence
  targeting sequence with ATCN PAM
cagugccuuugauuguuuca

SEQ ID NO: 1711 - RNA, 20 nt, Artificial Sequence
  targeting sequence with ATCN PAM
aaggcacugagauggggacc

SEQ ID NO: 1712 - RNA, 20 nt, Artificial Sequence
  targeting sequence with ATCN PAM
uacugccccaggagguaaaa

SEQ ID NO: 1713 - RNA, 20 nt, Artificial Sequence
  targeting sequence with ATCN PAM
cugauccaucucacagggac

SEQ ID NO: 1714 - RNA, 20 nt, Artificial Sequence
  targeting sequence with ATCN PAM
gugauuuucaacccccuuuu

SEQ ID NO: 1715 - RNA, 20 nt, Artificial Sequence
  targeting sequence with ATCN PAM
aucucacagggacugagccc

SEQ ID NO: 1716 - RNA, 20 nt, Artificial Sequence
  targeting sequence with ATCN PAM
cacagggacugagcccagcc

SEQ ID NO: 1717 - RNA, 20 nt, Artificial Sequence
  targeting sequence with ATCN PAM
aggagcccagcccaccagug

SEQ ID NO: 1718 - RNA, 20 nt, Artificial Sequence
  targeting sequence with ATCN PAM
gugccagucacacaaagguc

SEQ ID NO: 1719 - RNA, 20 nt, Artificial Sequence
  targeting sequence with ATCN PAM
gcaggcucccucauuaacau

SEQ ID NO: 1720 - RNA, 20 nt, Artificial Sequence
  targeting sequence with ATCN PAM
cucucggucuuugucucuuu

SEQ ID NO: 1721 - RNA, 20 nt, Artificial Sequence
  targeting sequence with ATCN PAM
aguggugcuaccagguuacc

SEQ ID NO: 1722 - RNA, 20 nt, Artificial Sequence
  targeting sequence with ATCN PAM
cagugucuugugguaaccug

SEQ ID NO: 1723 - RNA, 20 nt, Artificial Sequence
  targeting sequence with ATCN PAM
gaaaagcuggaauuaauaaa

SEQ ID NO: 1724 - RNA, 20 nt, Artificial Sequence
  targeting sequence with ATCN PAM
accuaauguugccucuuugu

SEQ ID NO: 1725 - RNA, 20 nt, Artificial Sequence
  targeting sequence with ATCN PAM
ugccacugcacuccagccca

SEQ ID NO: 1726 - RNA, 20 nt, Artificial Sequence
  targeting sequence with ATCN PAM
cggcucacugcaacuuccgc

SEQ ID NO: 1727 - RNA, 20 nt, Artificial Sequence
  targeting sequence with ATCN PAM
cuuagaacccgggaggcgga

SEQ ID NO: 1728 - RNA, 20 nt, Artificial Sequence
  targeting sequence with ATCN PAM
cagcuauuccagaggcugag

SEQ ID NO: 1729 - RNA, 20 nt, Artificial Sequence
  targeting sequence with ATCN PAM
uuacugaaaaugcaaaauua

SEQ ID NO: 1730 - RNA, 20 nt, Artificial Sequence
  targeting sequence with ATCN PAM
ccugaggucaggaguucuag

SEQ ID NO: 1731 - RNA, 20 nt, Artificial Sequence
  targeting sequence with ATCN PAM
accugccucaaccucccaaa

SEQ ID NO: 1732 - RNA, 20 nt, Artificial Sequence
  targeting sequence with ATCN PAM
cgggcugccgcuuuucucuu

SEQ ID NO: 1733 - RNA, 20 nt, Artificial Sequence
  targeting sequence with ATCN PAM
aguucaagagaaaagcggca

SEQ ID NO: 1734 - RNA, 20 nt, Artificial Sequence
  targeting sequence with ATCN PAM
gugcuguggggcugggacug

SEQ ID NO: 1735 - RNA, 20 nt, Artificial Sequence
  targeting sequence with ATCN PAM
ccauagguucucaguuucaa

SEQ ID NO: 1736 - RNA, 20 nt, Artificial Sequence
  targeting sequence with ATCN PAM
aauuuucaaaaaagagcaau

SEQ ID NO: 1737 - RNA, 20 nt, Artificial Sequence
  targeting sequence with ATCN PAM
cuugcagcacaaagacauuu

SEQ ID NO: 1738 - RNA, 20 nt, Artificial Sequence
  targeting sequence with ATCN PAM
ccccacauuuucuaguaugu

SEQ ID NO: 1739 - RNA, 20 nt, Artificial Sequence
  targeting sequence with ATCN PAM
uaguguugcuccccaguaag

SEQ ID NO: 1740 - RNA, 20 nt, Artificial Sequence
  targeting sequence with ATCN PAM
ucuucagcugcagcaguguc

SEQ ID NO: 1741 - RNA, 20 nt, Artificial Sequence
  targeting sequence with ATCN PAM
gcuguuucacugaguccccu

SEQ ID NO: 1742 - RNA, 20 nt, Artificial Sequence
  targeting sequence with ATCN PAM
caggaaggcugaaccucaac

SEQ ID NO: 1743 - RNA, 20 nt, Artificial Sequence
  targeting sequence with ATCN PAM
cguaagacugauugaugggu

SEQ ID NO: 1744 - RNA, 20 nt, Artificial Sequence
  targeting sequence with ATCN PAM
gucuuacgggaugaagcaga

SEQ ID NO: 1745 - RNA, 20 nt, Artificial Sequence
  targeting sequence with ATCN PAM
aucagucuuacgggaugaag

SEQ ID NO: 1746 - RNA, 20 nt, Artificial Sequence
  targeting sequence with ATCN PAM
gcaggcuguggcccuucaua

SEQ ID NO: 1747 - RNA, 20 nt, Artificial Sequence
  targeting sequence with ATCN PAM
ucuguugauuagagaggaac

SEQ ID NO: 1748 - RNA, 20 nt, Artificial Sequence
  targeting sequence with ATCN PAM
acagaagauaaaagagguua

SEQ ID NO: 1749 - RNA, 20 nt, Artificial Sequence
  targeting sequence with ATCN PAM
uggcuguggcugacugggga

SEQ ID NO: 1750 - RNA, 20 nt, Artificial Sequence
  targeting sequence with ATCN PAM
aauugcagucaugccuguua

SEQ ID NO: 1751 - RNA, 20 nt, Artificial Sequence
  targeting sequence with ATCN PAM
cagaaaaugaaaauauaaca

SEQ ID NO: 1752 - RNA, 20 nt, Artificial Sequence
  targeting sequence with ATCN PAM
uugagcaggccaucuuugag

SEQ ID NO: 1753 - RNA, 20 nt, Artificial Sequence
  targeting sequence with ATCN PAM
uugaguuaggcuaaggacau

SEQ ID NO: 1754 - RNA, 20 nt, Artificial Sequence
  targeting sequence with ATCN PAM
cagaguuugugaccugaaaa

SEQ ID NO: 1755 - RNA, 20 nt, Artificial Sequence
  targeting sequence with ATCN PAM
uacccccauguuccucuuca

SEQ ID NO: 1756 - RNA, 20 nt, Artificial Sequence
  targeting sequence with ATCN PAM
ccagccaggcgugguggcag

SEQ ID NO: 1757 - RNA, 20 nt, Artificial Sequence
  targeting sequence with ATCN PAM
caucuccagccaggcguggu

SEQ ID NO: 1758 - RNA, 20 nt, Artificial Sequence
  targeting sequence with ATCN PAM
uauacuguaaguauucagga

SEQ ID NO: 1759 - RNA, 20 nt, Artificial Sequence
  targeting sequence with ATCN PAM
acccuccauggaaacaaguu

SEQ ID NO: 1760 - RNA, 20 nt, Artificial Sequence
  targeting sequence with ATCN PAM
uacuaccaugcucucuauau

SEQ ID NO: 1761 - RNA, 20 nt, Artificial Sequence
  targeting sequence with ATCN PAM
aaaacucuucccucuuacau

SEQ ID NO: 1762 - RNA, 20 nt, Artificial Sequence
  targeting sequence with ATCN PAM
gcucccuuuaucuuuucuuu

SEQ ID NO: 1763 - RNA, 20 nt, Artificial Sequence
  targeting sequence with ATCN PAM
gccaugggaaacugagaaaa

SEQ ID NO: 1764 - RNA, 20 nt, Artificial Sequence
  targeting sequence with ATCN PAM
ucuaguuucccuggcccucu

SEQ ID NO: 1765 - RNA, 20 nt, Artificial Sequence
  targeting sequence with ATCN PAM
aguuucccuggcccucucua

SEQ ID NO: 1766 - RNA, 20 nt, Artificial Sequence
  targeting sequence with ATCN PAM
gcuuaauguguguacaucau

SEQ ID NO: 1767 - RNA, 20 nt, Artificial Sequence
  targeting sequence with ATCN PAM
ucauucaacagauacuuauu

SEQ ID NO: 1768 - RNA, 20 nt, Artificial Sequence
  targeting sequence with ATCN PAM
uucaacagauacuuauuggc

SEQ ID NO: 1769 - RNA, 20 nt, Artificial Sequence
  targeting sequence with ATCN PAM
guugaaugaugauguacaca

SEQ ID NO: 1770 - RNA, 20 nt, Artificial Sequence
  targeting sequence with ATCN PAM
aggaagauuuagaauucaau

SEQ ID NO: 1771 - RNA, 20 nt, Artificial Sequence
  targeting sequence with ATCN PAM
uccuagauugggaagggaag

SEQ ID NO: 1772 - RNA, 20 nt, Artificial Sequence
  targeting sequence with ATCN PAM
uauauugaauucuaaaucuu

SEQ ID NO: 1773 - RNA, 20 nt, Artificial Sequence
  targeting sequence with ATCN PAM
uccuauauugaauucuaaau

SEQ ID NO: 1774 - RNA, 20 nt, Artificial Sequence
  targeting sequence with ATCN PAM
aacccauacuuuuguguuag

SEQ ID NO: 1775 - RNA, 20 nt, Artificial Sequence
  targeting sequence with ATCN PAM
ccuuaaguauuacuaacacu

SEQ ID NO: 1776 - RNA, 20 nt, Artificial Sequence
  targeting sequence with ATCN PAM
ggcuuaauaauaauaauagc

SEQ ID NO: 1777 - RNA, 20 nt, Artificial Sequence
  targeting sequence with ATCN PAM
auauuagaaugucuaucaga

SEQ ID NO: 1778 - RNA, 20 nt, Artificial Sequence
  targeting sequence with ATCN PAM
gauuagucuugcaaugacca

SEQ ID NO: 1779 - RNA, 20 nt, Artificial Sequence
  targeting sequence with ATCN PAM
gauagacauucuaauaugga

SEQ ID NO: 1780 - RNA, 20 nt, Artificial Sequence
  targeting sequence with ATCN PAM
ggccuacuucugauuuuaag

SEQ ID NO: 1781 - RNA, 20 nt, Artificial Sequence
  targeting sequence with ATCN PAM
gaaguaggccagauauggug

SEQ ID NO: 1782 - RNA, 20 nt, Artificial Sequence
  targeting sequence with ATCN PAM
uuccacuuaaaaucagaagu

SEQ ID NO: 1783 - RNA, 20 nt, Artificial Sequence
  targeting sequence with ATCN PAM
acacauugauaucguucugu

SEQ ID NO: 1784 - RNA, 20 nt, Artificial Sequence
  targeting sequence with ATCN PAM
auguguagauucaaaaagcu

SEQ ID NO: 1785 - RNA, 20 nt, Artificial Sequence
  targeting sequence with ATCN PAM
uucugucuuucaccaaaugu

SEQ ID NO: 1786 - RNA, 20 nt, Artificial Sequence
  targeting sequence with ATCN PAM
uggccaaaauguuuucacau

SEQ ID NO: 1787 - RNA, 20 nt, Artificial Sequence
  targeting sequence with ATCN PAM
ugucacaguuuauaguucaa

SEQ ID NO: 1788 - RNA, 20 nt, Artificial Sequence
  targeting sequence with ATCN PAM
ggaaacccuugaacuauaaa

SEQ ID NO: 1789 - RNA, 20 nt, Artificial Sequence
  targeting sequence with ATCN PAM
agucccauuuaaaacuuagu

SEQ ID NO: 1790 - RNA, 20 nt, Artificial Sequence
  targeting sequence with ATCN PAM
cuuaaauauccagucccauu

SEQ ID NO: 1791 - RNA, 20 nt, Artificial Sequence
  targeting sequence with ATCN PAM
guucaaaauuggaugccuua

SEQ ID NO: 1792 - RNA, 20 nt, Artificial Sequence
  targeting sequence with ATCN PAM
aauuuugaacagauuauaaa

SEQ ID NO: 1793 - RNA, 20 nt, Artificial Sequence
  targeting sequence with ATCN PAM
aguuaaagugaacagccaau

SEQ ID NO: 1794 - RNA, 20 nt, Artificial Sequence
  targeting sequence with ATCN PAM
caaaucgucuuuuuauucac

SEQ ID NO: 1795 - RNA, 20 nt, Artificial Sequence
  targeting sequence with ATCN PAM
ucuuuuuauucacaaaagac

SEQ ID NO: 1796 - RNA, 20 nt, Artificial Sequence
  targeting sequence with ATCN PAM
uaacucaaugcaaccuugaa

SEQ ID NO: 1797 - RNA, 20 nt, Artificial Sequence
  targeting sequence with ATCN PAM
uacgacugcauuccagccua

SEQ ID NO: 1798 - RNA, 20 nt, Artificial Sequence
  targeting sequence with ATCN PAM
uuucaugugcuuauuggcca

SEQ ID NO: 1799 - RNA, 20 nt, Artificial Sequence
  targeting sequence with ATCN PAM
uuagccaucaggaaaaugca

SEQ ID NO: 1800 - RNA, 20 nt, Artificial Sequence
  targeting sequence with ATCN PAM
ggaaaaugcaaauugaaacc

SEQ ID NO: 1801 - RNA, 20 nt, Artificial Sequence
  targeting sequence with ATCN PAM
cauugugguuucaauuugca

SEQ ID NO: 1802 - RNA, 20 nt, Artificial Sequence
  targeting sequence with ATCN PAM
ucauacacugcuaaugcaaa

SEQ ID NO: 1803 - RNA, 20 nt, Artificial Sequence
  targeting sequence with ATCN PAM
cagcacuuugggaggccaag

SEQ ID NO: 1804 - RNA, 20 nt, Artificial Sequence
  targeting sequence with ATCN PAM
acccaccuuggccucccaaa

SEQ ID NO: 1805 - RNA, 20 nt, Artificial Sequence
  targeting sequence with ATCN PAM
ucugagcucaggaguuugag

SEQ ID NO: 1806 - RNA, 20 nt, Artificial Sequence
  targeting sequence with ATCN PAM
gagcucaggaguuugagacu

SEQ ID NO: 1807 - RNA, 20 nt, Artificial Sequence
  targeting sequence with ATCN PAM
guagucccagcuacuuggga

SEQ ID NO: 1808 - RNA, 20 nt, Artificial Sequence
  targeting sequence with ATCN PAM
uccuaccucagccucccaag

SEQ ID NO: 1809 - RNA, 20 nt, Artificial Sequence
  targeting sequence with ATCN PAM
cgugaagcugggaaguggag

SEQ ID NO: 1810 - RNA, 20 nt, Artificial Sequence
  targeting sequence with ATCN PAM
uggcuuacugcaaccuccac

SEQ ID NO: 1811 - RNA, 20 nt, Artificial Sequence
  targeting sequence with ATCN PAM
ugaaauaaacaagaauuaaa

SEQ ID NO: 1812 - RNA, 20 nt, Artificial Sequence
  targeting sequence with ATCN PAM
auaaccauugcaauacaauu

SEQ ID NO: 1813 - RNA, 20 nt, Artificial Sequence
  targeting sequence with ATCN PAM
gaggaaaaagaacacacagc

SEQ ID NO: 1814 - RNA, 20 nt, Artificial Sequence
  targeting sequence with ATCN PAM
uuuccaaucugaggaaaaag

SEQ ID NO: 1815 - RNA, 20 nt, Artificial Sequence
  targeting sequence with ATCN PAM
ggcacugaacuuugaccccu

SEQ ID NO: 1816 - RNA, 20 nt, Artificial Sequence
  targeting sequence with ATCN PAM
gcuacuuuacuaaaggcgag

SEQ ID NO: 1817 - RNA, 20 nt, Artificial Sequence
  targeting sequence with ATCN PAM
cuuuucaccaaggauggagu

SEQ ID NO: 1818 - RNA, 20 nt, Artificial Sequence
  targeting sequence with ATCN PAM
uuggugaaaagagauacuug

SEQ ID NO: 1819 - RNA, 20 nt, Artificial Sequence
  targeting sequence with ATCN PAM
gguuucgcuugacacgucca

SEQ ID NO: 1820 - RNA, 20 nt, Artificial Sequence
  targeting sequence with ATCN PAM
cuguaggcauagcgguccuu

SEQ ID NO: 1821 - RNA, 20 nt, Artificial Sequence
  targeting sequence with ATCN PAM
ggugcugcacaaugacguca

SEQ ID NO: 1822 - RNA, 20 nt, Artificial Sequence
  targeting sequence with ATCN PAM
cugagcagaaagguaagagg

SEQ ID NO: 1823 - RNA, 20 nt, Artificial Sequence
  targeting sequence with ATCN PAM
acuuacuucagguguauuca

SEQ ID NO: 1824 - RNA, 20 nt, Artificial Sequence
  targeting sequence with ATCN PAM
gaagccugccuaaguaacug

SEQ ID NO: 1825 - RNA, 20 nt, Artificial Sequence
  targeting sequence with ATCN PAM
ccgggggccacuagugcugu

SEQ ID NO: 1826 - RNA, 20 nt, Artificial Sequence
  targeting sequence with ATCN PAM
aaaguccuauaggacacaau

SEQ ID NO: 1827 - RNA, 20 nt, Artificial Sequence
  targeting sequence with ATCN PAM
caggguucagcagaguugau

SEQ ID NO: 1828 - RNA, 20 nt, Artificial Sequence
  targeting sequence with ATCN PAM
acucugcugaacccugggau

SEQ ID NO: 1829 - RNA, 20 nt, Artificial Sequence
  targeting sequence with ATCN PAM
aauacauacaaucaacucug

SEQ ID NO: 1830 - RNA, 20 nt, Artificial Sequence
  targeting sequence with ATCN PAM
uuagaguaucuaauacauac

SEQ ID NO: 1831 - RNA, 20 nt, Artificial Sequence
  targeting sequence with ATCN PAM
cacuuuaauugccaguagcg

SEQ ID NO: 1832 - RNA, 20 nt, Artificial Sequence
  targeting sequence with ATCN PAM
uuuacuuagcgcuacuggca

SEQ ID NO: 1833 - RNA, 20 nt, Artificial Sequence
  targeting sequence with ATCN PAM
aguucuagcaagagguuguu

SEQ ID NO: 1834 - RNA, 20 nt, Artificial Sequence
  targeting sequence with ATCN PAM
gaacugucaaagaaaaaaau

SEQ ID NO: 1835 - RNA, 20 nt, Artificial Sequence
  targeting sequence with ATCN PAM
ucuugacaagcucuuugcau

SEQ ID NO: 1836 - RNA, 20 nt, Artificial Sequence
  targeting sequence with ATCN PAM
acagaaaucgauuggcuauc

SEQ ID NO: 1837 - RNA, 20 nt, Artificial Sequence
  targeting sequence with ATCN PAM
auuggcuauccaacugccag

SEQ ID NO: 1838 - RNA, 20 nt, Artificial Sequence
  targeting sequence with ATCN PAM
auuucuguagauggcaaucu

SEQ ID NO: 1839 - RNA, 20 nt, Artificial Sequence
  targeting sequence with ATCN PAM
aacugccagagaaaauccuc

SEQ ID NO: 1840 - RNA, 20 nt, Artificial Sequence
  targeting sequence with ATCN PAM
ucaucuaugaguuguauuca

SEQ ID NO: 1841 - RNA, 20 nt, Artificial Sequence
  targeting sequence with ATCN PAM
augaguuguauucagaggac

SEQ ID NO: 1842 - RNA, 20 nt, Artificial Sequence
  targeting sequence with ATCN PAM
gacaugcauuaccggguaaa

SEQ ID NO: 1843 - RNA, 20 nt, Artificial Sequence
  targeting sequence with ATCN PAM
ucuccuuuacccgguaaugc

SEQ ID NO: 1844 - RNA, 20 nt, Artificial Sequence
  targeting sequence with ATCN PAM
agaaguuugagugcaaccuc

SEQ ID NO: 1845 - RNA, 20 nt, Artificial Sequence
  targeting sequence with ATCN PAM
caucauccugugccaggugg

SEQ ID NO: 1846 - RNA, 20 nt, Artificial Sequence
  targeting sequence with ATCN PAM
uccugugccaggugggcagc

SEQ ID NO: 1847 - RNA, 20 nt, Artificial Sequence
  targeting sequence with ATCN PAM
ugugccaggugggcagcagc

SEQ ID NO: 1848 - RNA, 20 nt, Artificial Sequence
  targeting sequence with ATCN PAM
gcaagucaugagccauaaac

SEQ ID NO: 1849 - RNA, 20 nt, Artificial Sequence
  targeting sequence with ATCN PAM
caguacuuuaggaagcugga

SEQ ID NO: 1850 - RNA, 20 nt, Artificial Sequence
  targeting sequence with ATCN PAM
ucauucuguacaccaauuua

SEQ ID NO: 1851 - RNA, 20 nt, Artificial Sequence
  targeting sequence with ATCN PAM
auaaaaacuaucuucauucu

SEQ ID NO: 1852 - RNA, 20 nt, Artificial Sequence
  targeting sequence with ATCN PAM
acucaguaauugucaaggaa

SEQ ID NO: 1853 - RNA, 20 nt, Artificial Sequence
  targeting sequence with ATCN PAM
uucaggaauuaaaacuuccu

SEQ ID NO: 1854 - RNA, 20 nt, Artificial Sequence
  targeting sequence with ATCN PAM
ugagaaauauuuuucuauga

SEQ ID NO: 1855 - RNA, 20 nt, Artificial Sequence
  targeting sequence with ATCN PAM
uggaaguagagguggauuua

SEQ ID NO: 1856 - RNA, 20 nt, Artificial Sequence
  targeting sequence with ATCN PAM
accucuacuuccaagaugcu

SEQ ID NO: 1857 - RNA, 20 nt, Artificial Sequence
  targeting sequence with ATCN PAM
ccuccaacagaacuauguaa

SEQ ID NO: 1858 - RNA, 20 nt, Artificial Sequence
  targeting sequence with ATCN PAM
aaguuagaacuccaagcggu

SEQ ID NO: 1859 - RNA, 20 nt, Artificial Sequence
  targeting sequence with ATCN PAM
uguaauuuguagcaacccua

SEQ ID NO: 1860 - RNA, 20 nt, Artificial Sequence
  targeting sequence with ATCN PAM
auccuguaauuuguagcaac

SEQ ID NO: 1861 - RNA, 20 nt, Artificial Sequence
  targeting sequence with ATCN PAM
ucaaugcaaacccccaccca

SEQ ID NO: 1862 - RNA, 20 nt, Artificial Sequence
  targeting sequence with ATCN PAM
gaggcugaauugggcuccgu

SEQ ID NO: 1863 - RNA, 20 nt, Artificial Sequence
  targeting sequence with ATCN PAM
aagacuccaugcaaggcuuc

SEQ ID NO: 1864 - RNA, 20 nt, Artificial Sequence
  targeting sequence with ATCN PAM
uuaauccaagacuccaugca

SEQ ID NO: 1865 - RNA, 20 nt, Artificial Sequence
  targeting sequence with ATCN PAM
uggggucuacauuggguuag

SEQ ID NO: 1866 - RNA, 20 nt, Artificial Sequence
  targeting sequence with ATCN PAM
aacccaauguagaccccacg

SEQ ID NO: 1867 - RNA, 20 nt, Artificial Sequence
  targeting sequence with ATCN PAM
aucuaacccaauguagaccc

SEQ ID NO: 1868 - RNA, 20 nt, Artificial Sequence
  targeting sequence with ATCN PAM
aucuaucuaacccaauguag

SEQ ID NO: 1869 - RNA, 20 nt, Artificial Sequence
  targeting sequence with ATCN PAM
uucugucccuaaggggagaa

SEQ ID NO: 1870 - RNA, 20 nt, Artificial Sequence
  targeting sequence with ATCN PAM
ccuuggggaggucugggggc

SEQ ID NO: 1871 - RNA, 20 nt, Artificial Sequence
  targeting sequence with ATCN PAM
gccacucccgcuccuucacu

SEQ ID NO: 1872 - RNA, 20 nt, Artificial Sequence
  targeting sequence with ATCN PAM
aggugaucgguggcccuccu

SEQ ID NO: 1873 - RNA, 20 nt, Artificial Sequence
  targeting sequence with ATCN PAM
ccuugauguaacgaaugaga

SEQ ID NO: 1874 - RNA, 20 nt, Artificial Sequence
  targeting sequence with ATCN PAM
guggcccuccuggaagagaa

SEQ ID NO: 1875 - RNA, 20 nt, Artificial Sequence
  targeting sequence with ATCN PAM
gccugacaggagacgugagg

SEQ ID NO: 1876 - RNA, 20 nt, Artificial Sequence
  targeting sequence with ATCN PAM
gcaugcacacgugggugacc

SEQ ID NO: 1877 - RNA, 20 nt, Artificial Sequence
  targeting sequence with ATCN PAM
cccaccuucuggagaccuua

SEQ ID NO: 1878 - RNA, 20 nt, Artificial Sequence
  targeting sequence with ATCN PAM
cuaacaaaucucccaccuuc

SEQ ID NO: 1879 - RNA, 20 nt, Artificial Sequence
  targeting sequence with ATCN PAM
acagaagcaacaucucuaac

SEQ ID NO: 1880 - RNA, 20 nt, Artificial Sequence
  targeting sequence with ATCN PAM
cugccucccucuagaaaucc

SEQ ID NO: 1881 - RNA, 20 nt, Artificial Sequence
  targeting sequence with ATCN PAM
uuaccuaggucagcuccuga

SEQ ID NO: 1882 - RNA, 20 nt, Artificial Sequence
  targeting sequence with ATCN PAM
ggagcugaccuagguaacga

SEQ ID NO: 1883 - RNA, 20 nt, Artificial Sequence
  targeting sequence with ATCN PAM
acucgcugcccuaaucagga

SEQ ID NO: 1884 - RNA, 20 nt, Artificial Sequence
  targeting sequence with ATCN PAM
ugaggacccagcauucuuua

SEQ ID NO: 1885 - RNA, 20 nt, Artificial Sequence
  targeting sequence with ATCN PAM
guaucuugaggacccagcau

SEQ ID NO: 1886 - RNA, 20 nt, Artificial Sequence
  targeting sequence with ATCN PAM
aucaguaucuugaggaccca

SEQ ID NO: 1887 - RNA, 20 nt, Artificial Sequence
  targeting sequence with ATCN PAM
aacuggccaaagggcccauu

SEQ ID NO: 1888 - RNA, 20 nt, Artificial Sequence
  targeting sequence with ATCN PAM
cacaucuaacuggccaaagg

SEQ ID NO: 1889 - RNA, 20 nt, Artificial Sequence
  targeting sequence with ATCN PAM
agguuacacaaaauucugug

SEQ ID NO: 1890 - RNA, 20 nt, Artificial Sequence
  targeting sequence with ATCN PAM
gcugcacagcuuggcuguca

SEQ ID NO: 1891 - RNA, 20 nt, Artificial Sequence
  targeting sequence with ATCN PAM
ccagcaaagaccugacaagc

SEQ ID NO: 1892 - RNA, 20 nt, Artificial Sequence
  targeting sequence with ATCN PAM
ugggcaggucacuuuaccuc

SEQ ID NO: 1893 - RNA, 20 nt, Artificial Sequence
  targeting sequence with ATCN PAM
ucauguaaaaccagccucac

SEQ ID NO: 1894 - RNA, 20 nt, Artificial Sequence
  targeting sequence with ATCN PAM
caguggcuauucacagguau

SEQ ID NO: 1895 - RNA, 20 nt, Artificial Sequence
  targeting sequence with ATCN PAM
gccugggcaacauagcaaga

SEQ ID NO: 1896 - RNA, 20 nt, Artificial Sequence
  targeting sequence with ATCN PAM
cuaaaaaaaauuuuuuuuaa

SEQ ID NO: 1897 - RNA, 20 nt, Artificial Sequence
  targeting sequence with ATCN PAM
cugguuuaaaaaaaauuuuu

SEQ ID NO: 1898 - RNA, 20 nt, Artificial Sequence
  targeting sequence with ATCN PAM
guaaaugauagcuaucauga

SEQ ID NO: 1899 - RNA, 20 nt, Artificial Sequence
  targeting sequence with ATCN PAM
uuuacugauaucccugguuu

SEQ ID NO: 1900 - RNA, 20 nt, Artificial Sequence
  targeting sequence with ATCN PAM
ugaucacuaucaucauuauu

SEQ ID NO: 1901 - RNA, 20 nt, Artificial Sequence
  targeting sequence with ATCN PAM
ugauagcuaucauuuacuga

SEQ ID NO: 1902 - RNA, 20 nt, Artificial Sequence
  targeting sequence with ATCN PAM
cuaucaucauuauuauaauu

SEQ ID NO: 1903 - RNA, 20 nt, Artificial Sequence
  targeting sequence with ATCN PAM
ucauuauuauaauuuucuac

SEQ ID NO: 1904 - RNA, 20 nt, Artificial Sequence
  targeting sequence with ATCN PAM
uuauuauaauuuucuaccac

SEQ ID NO: 1905 - RNA, 20 nt, Artificial Sequence
  targeting sequence with ATCN PAM
gagucacgaacuaacacagg

SEQ ID NO: 1906 - RNA, 20 nt, Artificial Sequence
  targeting sequence with ATCN PAM
cugcuagguggcaucuccua

SEQ ID NO: 1907 - RNA, 20 nt, Artificial Sequence
  targeting sequence with ATCN PAM
ccuaaagcugcaguuugggu

SEQ ID NO: 1908 - RNA, 20 nt, Artificial Sequence
  targeting sequence with ATCN PAM
acaaauccccaguccgaaca

SEQ ID NO: 1909 - RNA, 20 nt, Artificial Sequence
  targeting sequence with ATCN PAM
ccaguccgaacagacacuga

SEQ ID NO: 1910 - RNA, 20 nt, Artificial Sequence
  targeting sequence with ATCN PAM
gaggcugcagaaguaaugac

SEQ ID NO: 1911 - RNA, 20 nt, Artificial Sequence
  targeting sequence with ATCN PAM
uuaggaggccagaagcgagg

SEQ ID NO: 1912 - RNA, 20 nt, Artificial Sequence
  targeting sequence with ATCN PAM
aaagaaagaggggggugggg

SEQ ID NO: 1913 - RNA, 20 nt, Artificial Sequence
  targeting sequence with ATCN PAM
caugugcucugcaagaacaa

SEQ ID NO: 1914 - RNA, 20 nt, Artificial Sequence
  targeting sequence with ATCN PAM
uggcccacugccaggccguu

SEQ ID NO: 1915 - RNA, 20 nt, Artificial Sequence
  targeting sequence with ATCN PAM
uguugccauggugacugaca

SEQ ID NO: 1916 - RNA, 20 nt, Artificial Sequence
  targeting sequence with ATCN PAM
ggcaaaauuucagcgaaaac

SEQ ID NO: 1917 - RNA, 20 nt, Artificial Sequence
  targeting sequence with ATCN PAM
ugaagaucuucguggacaau

SEQ ID NO: 1918 - RNA, 20 nt, Artificial Sequence
  targeting sequence with ATCN PAM
ucaggaucuggcaaaauuuc

SEQ ID NO: 1919 - RNA, 20 nt, Artificial Sequence
  targeting sequence with ATCN PAM
ucguggacaaucucuuugcu

SEQ ID NO: 1920 - RNA, 20 nt, Artificial Sequence
  targeting sequence with ATCN PAM
cuuugcuaucguccugcuga

SEQ ID NO: 1921 - RNA, 20 nt, Artificial Sequence
  targeting sequence with ATCN PAM
uccugcugaagcaggccaca

SEQ ID NO: 1922 - RNA, 20 nt, Artificial Sequence
  targeting sequence with ATCN PAM
accacggccagcuucuuacg

SEQ ID NO: 1923 - RNA, 20 nt, Artificial Sequence
  targeting sequence with ATCN PAM
acaccaaggagcugcuuuuu

SEQ ID NO: 1924 - RNA, 20 nt, Artificial Sequence
  targeting sequence with ATCN PAM
uccuuugauuagagacucuc

SEQ ID NO: 1925 - RNA, 20 nt, Artificial Sequence
  targeting sequence with ATCN PAM
uuugauuagagacucuccuc

SEQ ID NO: 1926 - RNA, 20 nt, Artificial Sequence
  targeting sequence with ATCN PAM
aaggaugaugucccugggcc

SEQ ID NO: 1927 - RNA, 20 nt, Artificial Sequence
  targeting sequence with ATCN PAM
ccccauucacugagugccaa

SEQ ID NO: 1928 - RNA, 20 nt, Artificial Sequence
  targeting sequence with ATCN PAM
aucgccccauucacugagug

SEQ ID NO: 1929 - RNA, 20 nt, Artificial Sequence
  targeting sequence with ATCN PAM
uguuuccuucccacgcugua

SEQ ID NO: 1930 - RNA, 20 nt, Artificial Sequence
  targeting sequence with ATCN PAM
gaaagggggaaggggauggg

SEQ ID NO: 1931 - RNA, 20 nt, Artificial Sequence
  targeting sequence with ATCN PAM
ccuucccccuuucagaugac

SEQ ID NO: 1932 - RNA, 20 nt, Artificial Sequence
  targeting sequence with ATCN PAM
aagcacuucgcauucugcug

SEQ ID NO: 1933 - RNA, 20 nt, Artificial Sequence
  targeting sequence with ATCN PAM
uugggguuguaggcguuguu

SEQ ID NO: 1934 - RNA, 20 nt, Artificial Sequence
  targeting sequence with ATCN PAM
agcccuguggccugaggaag

SEQ ID NO: 1935 - RNA, 20 nt, Artificial Sequence
  targeting sequence with ATCN PAM
ggaaacccugcaguggccga

SEQ ID NO: 1936 - RNA, 20 nt, Artificial Sequence
  targeting sequence with ATCN PAM
gcccauaacaucaggaaacc

SEQ ID NO: 1937 - RNA, 20 nt, Artificial Sequence
  targeting sequence with ATCN PAM
augggggaggggucuggagu

SEQ ID NO: 1938 - RNA, 20 nt, Artificial Sequence
  targeting sequence with ATCN PAM
auucugcugcugagaacaag

SEQ ID NO: 1939 - RNA, 20 nt, Artificial Sequence
  targeting sequence with ATCN PAM
cuuacugugugaucuuaagu

SEQ ID NO: 1940 - RNA, 20 nt, Artificial Sequence
  targeting sequence with ATCN PAM
cacaguaagggaugcaggca

SEQ ID NO: 1941 - RNA, 20 nt, Artificial Sequence
  targeting sequence with ATCN PAM
uaaguuagugagccucucug

SEQ ID NO: 1942 - RNA, 20 nt, Artificial Sequence
  targeting sequence with ATCN PAM
aguguauuccuguagcaauu

SEQ ID NO: 1943 - RNA, 20 nt, Artificial Sequence
  targeting sequence with ATCN PAM
ccuccccuagccugccauag

SEQ ID NO: 1944 - RNA, 20 nt, Artificial Sequence
  targeting sequence with ATCN PAM
gcauucccagcuguaacauu

SEQ ID NO: 1945 - RNA, 20 nt, Artificial Sequence
  targeting sequence with ATCN PAM
ugugagaaccacccugggcu

SEQ ID NO: 1946 - RNA, 20 nt, Artificial Sequence
  targeting sequence with ATCN PAM
ccacugucccuguuccccag

SEQ ID NO: 1947 - RNA, 20 nt, Artificial Sequence
  targeting sequence with ATCN PAM
aagccagcaccuucccugug

SEQ ID NO: 1948 - RNA, 20 nt, Artificial Sequence
  targeting sequence with ATCN PAM
uggagccauuguagccgacc

SEQ ID NO: 1949 - RNA, 20 nt, Artificial Sequence
  targeting sequence with ATCN PAM
ucugccuccaugucuucucc

SEQ ID NO: 1950 - RNA, 20 nt, Artificial Sequence
  targeting sequence with ATCN PAM
cuuccuuuauggcuaucuuc

SEQ ID NO: 1951 - RNA, 20 nt, Artificial Sequence
  targeting sequence with ATCN PAM
ucucauuucaccucacauuc

SEQ ID NO: 1952 - RNA, 20 nt, Artificial Sequence
  targeting sequence with ATCN PAM
cugucuaugaagugcuggcu

SEQ ID NO: 1953 - RNA, 20 nt, Artificial Sequence
  targeting sequence with ATCN PAM
ggccuuuucacucaacaauc

SEQ ID NO: 1954 - RNA, 20 nt, Artificial Sequence
  targeting sequence with ATCN PAM
ccuaaagcaucguucugugu

SEQ ID NO: 1955 - RNA, 20 nt, Artificial Sequence
  targeting sequence with ATCN PAM
uucugugucaguaaauggua

SEQ ID NO: 1956 - RNA, 20 nt, Artificial Sequence
  targeting sequence with ATCN PAM
cuguauuauuuccuacaauu

SEQ ID NO: 1957 - RNA, 20 nt, Artificial Sequence
  targeting sequence with ATCN PAM
cuuaaacccuuugccuaguu

SEQ ID NO: 1958 - RNA, 20 nt, Artificial Sequence
  targeting sequence with ATCN PAM
cucuagagcuaugcacacug

SEQ ID NO: 1959 - RNA, 20 nt, Artificial Sequence
  targeting sequence with ATCN PAM
ucccacccauguuggcaugu

SEQ ID NO: 1960 - RNA, 20 nt, Artificial Sequence
  targeting sequence with ATCN PAM
cccaccacagucauggcacu

SEQ ID NO: 1961 - RNA, 20 nt, Artificial Sequence
  targeting sequence with ATCN PAM
acaagacacaauaaaaugca

SEQ ID NO: 1962 - RNA, 20 nt, Artificial Sequence
  targeting sequence with ATCN PAM
uucuagcuagguccuugcac

SEQ ID NO: 1963 - RNA, 20 nt, Artificial Sequence
  targeting sequence with ATCN PAM
acuuagaagaagugggcucu

SEQ ID NO: 1964 - RNA, 20 nt, Artificial Sequence
  targeting sequence with ATCN PAM
ucaacuuagaagaagugggc

SEQ ID NO: 1965 - RNA, 20 nt, Artificial Sequence
  targeting sequence with ATCN PAM
uccaugccugacacagauca

SEQ ID NO: 1966 - RNA, 20 nt, Artificial Sequence
  targeting sequence with ATCN PAM
augccugacacagaucagcu

SEQ ID NO: 1967 - RNA, 20 nt, Artificial Sequence
  targeting sequence with ATCN PAM
gugucaggcauggaugaugg

SEQ ID NO: 1968 - RNA, 20 nt, Artificial Sequence
  targeting sequence with ATCN PAM
gcuauucaagaaauguuagu

SEQ ID NO: 1969 - RNA, 20 nt, Artificial Sequence
  targeting sequence with ATCN PAM
gaauuccacuaacauuucuu

SEQ ID NO: 1970 - RNA, 20 nt, Artificial Sequence
  targeting sequence with ATCN PAM
gaggaaaaagaccagaaagc

SEQ ID NO: 1971 - RNA, 20 nt, Artificial Sequence
  targeting sequence with ATCN PAM
uugucugccccauuacaaac

SEQ ID NO: 1972 - RNA, 20 nt, Artificial Sequence
  targeting sequence with ATCN PAM
accaggaacucaucucccuc

SEQ ID NO: 1973 - RNA, 20 nt, Artificial Sequence
  targeting sequence with ATCN PAM
cccucaauugccccaaacua

SEQ ID NO: 1974 - RNA, 20 nt, Artificial Sequence
  targeting sequence with ATCN PAM
ugggagaaaaccuuuuaaua

SEQ ID NO: 1975 - RNA, 20 nt, Artificial Sequence
  targeting sequence with ATCN PAM
ugaccucaaaaauaaaugca

SEQ ID NO: 1976 - RNA, 20 nt, Artificial Sequence
  targeting sequence with ATCN PAM
uaaaguccuggcagaggaag

SEQ ID NO: 1977 - RNA, 20 nt, Artificial Sequence
  targeting sequence with ATCN PAM
ugcugacgcagcgggucagg

SEQ ID NO: 1978 - RNA, 20 nt, Artificial Sequence
  targeting sequence with ATCN PAM
gucgccucugccuccggcca

SEQ ID NO: 1979 - RNA, 20 nt, Artificial Sequence
  targeting sequence with ATCN PAM
ugugguuuuggcccagagag

SEQ ID NO: 1980 - RNA, 20 nt, Artificial Sequence
  targeting sequence with ATCN PAM
gacccagucuuggaauuuuu

SEQ ID NO: 1981 - RNA, 20 nt, Artificial Sequence
  targeting sequence with ATCN PAM
aacagcaagauaaaguauag

SEQ ID NO: 1982 - RNA, 20 nt, Artificial Sequence
  targeting sequence with ATCN PAM
ugcuguuggauuucaaacau

SEQ ID NO: 1983 - RNA, 20 nt, Artificial Sequence
  targeting sequence with ATCN PAM
aucauaugcucagcugugau

SEQ ID NO: 1984 - RNA, 20 nt, Artificial Sequence
  targeting sequence with ATCN PAM
uaugcucagcugugauaugc

SEQ ID NO: 1985 - RNA, 20 nt, Artificial Sequence
  targeting sequence with ATCN PAM
cagcugagcauaugauggau

SEQ ID NO: 1986 - RNA, 20 nt, Artificial Sequence
  targeting sequence with ATCN PAM
caagcagcuguaacuagagc

SEQ ID NO: 1987 - RNA, 20 nt, Artificial Sequence
  targeting sequence with ATCN PAM
uucagguuucgucaagccaa

SEQ ID NO: 1988 - RNA, 20 nt, Artificial Sequence
  targeting sequence with ATCN PAM
ccuggaagcuuucucaaacu

SEQ ID NO: 1989 - RNA, 20 nt, Artificial Sequence
  targeting sequence with ATCN PAM
aguuucaccaucuccuggaa

SEQ ID NO: 1990 - RNA, 20 nt, Artificial Sequence
  targeting sequence with ATCN PAM
gagcccugagaggucuggaa

SEQ ID NO: 1991 - RNA, 20 nt, Artificial Sequence
  targeting sequence with ATCN PAM
cccaggcucuccagucuugu

SEQ ID NO: 1992 - RNA, 20 nt, Artificial Sequence
  targeting sequence with ATCN PAM
uuaccuucacuguauuuucu

SEQ ID NO: 1993 - RNA, 20 nt, Artificial Sequence
  targeting sequence with ATCN PAM
ugccugcauuuugcccagug

SEQ ID NO: 1994 - RNA, 20 nt, Artificial Sequence
  targeting sequence with ATCN PAM
cuccuuugcccaugguagcc

SEQ ID NO: 1995 - RNA, 20 nt, Artificial Sequence
  targeting sequence with ATCN PAM
aaacagaaguuaauggauuu

SEQ ID NO: 1996 - RNA, 20 nt, Artificial Sequence
  targeting sequence with ATCN PAM
auuaacuucuguuuagaugu

SEQ ID NO: 1997 - RNA, 20 nt, Artificial Sequence
  targeting sequence with ATCN PAM
uaggcuggugacuuuuuggg

SEQ ID NO: 1998 - RNA, 20 nt, Artificial Sequence
  targeting sequence with ATCN PAM
cuccucauuggcacauuaaa

SEQ ID NO: 1999 - RNA, 20 nt, Artificial Sequence
  targeting sequence with ATCN PAM
uuuccaccaugccaucucuc

SEQ ID NO: 2000 - RNA, 20 nt, Artificial Sequence
  targeting sequence with ATCN PAM
gccaggaccucugugcuaau

SEQ ID NO: 2001 - RNA, 20 nt, Artificial Sequence
  targeting sequence with ATCN PAM
cuccuggcuuccugggcagg

SEQ ID NO: 2002 - RNA, 20 nt, Artificial Sequence
  targeting sequence with ATCN PAM
uuaacaaggaaaggccuugc

SEQ ID NO: 2003 - RNA, 20 nt, Artificial Sequence
  targeting sequence with ATCN PAM
uguaggagggcaucuguccc

SEQ ID NO: 2004 - RNA, 20 nt, Artificial Sequence
  targeting sequence with ATCN PAM
guccccagggcagggaucag

SEQ ID NO: 2005 - RNA, 20 nt, Artificial Sequence
  targeting sequence with ATCN PAM
cugcccuggggacagaugcc

SEQ ID NO: 2006 - RNA, 20 nt, Artificial Sequence
  targeting sequence with ATCN PAM
ggagagcuguuuccagaggc

SEQ ID NO: 2007 - RNA, 20 nt, Artificial Sequence
  targeting sequence with ATCN PAM
cuuaccuuucuuggacucag

SEQ ID NO: 2008 - RNA, 20 nt, Artificial Sequence
  targeting sequence with ATCN PAM
gccucccucagcagaacccc

SEQ ID NO: 2009 - RNA, 20 nt, Artificial Sequence
  targeting sequence with ATCN PAM
cagguugugccgcaguuaca

SEQ ID NO: 2010 - RNA, 20 nt, Artificial Sequence
  targeting sequence with ATCN PAM
ggacaaagggcagaggaagc

SEQ ID NO: 2011 - RNA, 20 nt, Artificial Sequence
  targeting sequence with ATCN PAM
uauggcgaggcaggccugua

SEQ ID NO: 2012 - RNA, 20 nt, Artificial Sequence
  targeting sequence with ATCN PAM
uccccuccuucccaccuaca

SEQ ID NO: 2013 - RNA, 20 nt, Artificial Sequence
  targeting sequence with ATCN PAM
ugcaccucucucaugacugg

SEQ ID NO: 2014 - RNA, 20 nt, Artificial Sequence
  targeting sequence with ATCN PAM
gcacccugcccagccugccc

SEQ ID NO: 2015 - RNA, 20 nt, Artificial Sequence
  targeting sequence with ATCN PAM
ucccacgcaucuggaggcag

SEQ ID NO: 2016 - RNA, 20 nt, Artificial Sequence
  targeting sequence with ATCN PAM
cacgcaucuggaggcaggcu

SEQ ID NO: 2017 - RNA, 20 nt, Artificial Sequence
  targeting sequence with ATCN PAM
ggaggcaggcucuguaugca

SEQ ID NO: 2018 - RNA, 20 nt, Artificial Sequence
  targeting sequence with ATCN PAM
gguucuuuccauggcucuga

SEQ ID NO: 2019 - RNA, 20 nt, Artificial Sequence
  targeting sequence with ATCN PAM
agggaaaaaaagaagacugu

SEQ ID NO: 2020 - RNA, 20 nt, Artificial Sequence
  targeting sequence with ATCN PAM
ugcaguccgcucccauguac

SEQ ID NO: 2021 - RNA, 20 nt, Artificial Sequence
  targeting sequence with ATCN PAM
agguacugguacaugggagc

SEQ ID NO: 2022 - RNA, 20 nt, Artificial Sequence
  targeting sequence with ATCN PAM
gguaggcuuccuugaacagu

SEQ ID NO: 2023 - RNA, 20 nt, Artificial Sequence
  targeting sequence with ATCN PAM
gugucugugacacccaagca

SEQ ID NO: 2024 - RNA, 20 nt, Artificial Sequence
  targeting sequence with ATCN PAM
aaaccuucuagcgcuuccau

SEQ ID NO: 2025 - RNA, 20 nt, Artificial Sequence
  targeting sequence with ATCN PAM
agccagcaggagcuggaguu

SEQ ID NO: 2026 - RNA, 20 nt, Artificial Sequence
  targeting sequence with ATCN PAM
gccuucuuaagggaccccac

SEQ ID NO: 2027 - RNA, 20 nt, Artificial Sequence
  targeting sequence with ATCN PAM
cgccaugaagguacguggga

SEQ ID NO: 2028 - RNA, 20 nt, Artificial Sequence
  targeting sequence with ATCN PAM
aguccaugaaucccgccaug

SEQ ID NO: 2029 - RNA, 20 nt, Artificial Sequence
  targeting sequence with ATCN PAM
cucuagcuuucauagacuag

SEQ ID NO: 2030 - RNA, 20 nt, Artificial Sequence
  targeting sequence with ATCN PAM
gagguucuagauggaaacac

SEQ ID NO: 2031 - RNA, 20 nt, Artificial Sequence
  targeting sequence with ATCN PAM
ccccacagucaauuaaugag

SEQ ID NO: 2032 - RNA, 20 nt, Artificial Sequence
  targeting sequence with ATCN PAM
cgucccucuuugccacuccu

SEQ ID NO: 2033 - RNA, 20 nt, Artificial Sequence
  targeting sequence with ATCN PAM
aacccaaggcgggcaucacg

SEQ ID NO: 2034 - RNA, 20 nt, Artificial Sequence
  targeting sequence with ATCN PAM
agacuuguaggcaugaagag

SEQ ID NO: 2035 - RNA, 20 nt, Artificial Sequence
  targeting sequence with ATCN PAM
caguuaagccucaugacugc

SEQ ID NO: 2036 - RNA, 20 nt, Artificial Sequence
  targeting sequence with ATCN PAM
gggaugguugugcagaugcu

SEQ ID NO: 2037 - RNA, 20 nt, Artificial Sequence
  targeting sequence with ATCN PAM
cugauuuaaauuccccuuua

SEQ ID NO: 2038 - RNA, 20 nt, Artificial Sequence
  targeting sequence with ATCN PAM
gcacaaccaucccugauuua

SEQ ID NO: 2039 - RNA, 20 nt, Artificial Sequence
  targeting sequence with ATCN PAM
cuucccuuguuuaguaaugg

SEQ ID NO: 2040 - RNA, 20 nt, Artificial Sequence
  targeting sequence with ATCN PAM
uuguguaacaaugaucuaga

SEQ ID NO: 2041 - RNA, 20 nt, Artificial Sequence
  targeting sequence with ATCN PAM
uuguuacacaacgaucacuu

SEQ ID NO: 2042 - RNA, 20 nt, Artificial Sequence
  targeting sequence with ATCN PAM
agauuauauuuuuagauguc

SEQ ID NO: 2043 - RNA, 20 nt, Artificial Sequence
  targeting sequence with ATCN PAM
agaucauuguuacacaacga

SEQ ID NO: 2044 - RNA, 20 nt, Artificial Sequence
  targeting sequence with ATCN PAM
aaaaauauaaucuagaucau

SEQ ID NO: 2045 - RNA, 20 nt, Artificial Sequence
  targeting sequence with ATCN PAM
ccacuuuccuacacugagga

SEQ ID NO: 2046 - RNA, 20 nt, Artificial Sequence
  targeting sequence with ATCN PAM
uagcacuuugggaggccgag

SEQ ID NO: 2047 - RNA, 20 nt, Artificial Sequence
  targeting sequence with ATCN PAM
gcacaccucggccucccaaa

SEQ ID NO: 2048 - RNA, 20 nt, Artificial Sequence
  targeting sequence with ATCN PAM
caaggucaggagaucgagac

SEQ ID NO: 2049 - RNA, 20 nt, Artificial Sequence
  targeting sequence with ATCN PAM
cuauggagggagcuucccuc

SEQ ID NO: 2050 - RNA, 20 nt, Artificial Sequence
  targeting sequence with ATCN PAM
cuagaauagaaaggauugua

SEQ ID NO: 2051 - RNA, 20 nt, Artificial Sequence
  targeting sequence with ATCN PAM
uuucuauucuagggauuugu

SEQ ID NO: 2052 - RNA, 20 nt, Artificial Sequence
  targeting sequence with ATCN PAM
guaaacacucauauuaaacc

SEQ ID NO: 2053 - RNA, 20 nt, Artificial Sequence
  targeting sequence with ATCN PAM
cagcacuuugggaggcugag

SEQ ID NO: 2054 - RNA, 20 nt, Artificial Sequence
  targeting sequence with ATCN PAM
ggcuggguguggugguuuau

SEQ ID NO: 2055 - RNA, 20 nt, Artificial Sequence
  targeting sequence with ATCN PAM
auuguguacaacaugcuguu

SEQ ID NO: 2056 - RNA, 20 nt, Artificial Sequence
  targeting sequence with ATCN PAM
uguggcuuuuucaaaacagc

SEQ ID NO: 2057 - RNA, 20 nt, Artificial Sequence
  targeting sequence with ATCN PAM
ucaauaucauguggcuuuuu

SEQ ID NO: 2058 - RNA, 20 nt, Artificial Sequence
  targeting sequence with ATCN PAM
agccuaucuucaauaucaug

SEQ ID NO: 2059 - RNA, 20 nt, Artificial Sequence
  targeting sequence with ATCN PAM
aaaucccgaguaccccaccu

SEQ ID NO: 2060 - RNA, 20 nt, Artificial Sequence
  targeting sequence with ATCN PAM
cgaguaccccaccucuuuac

SEQ ID NO: 2061 - RNA, 20 nt, Artificial Sequence
  targeting sequence with ATCN PAM
aagcuggugagccugagugc

SEQ ID NO: 2062 - RNA, 20 nt, Artificial Sequence
  targeting sequence with ATCN PAM
cuaggaaccacuauauccaa

SEQ ID NO: 2063 - RNA, 20 nt, Artificial Sequence
  targeting sequence with ATCN PAM
ccacuagauggcagagaaga

SEQ ID NO: 2064 - RNA, 20 nt, Artificial Sequence
  targeting sequence with ATCN PAM
aguggggauggcuguccauc

SEQ ID NO: 2065 - RNA, 20 nt, Artificial Sequence
  targeting sequence with ATCN PAM
guuuccgaguuccuucaacc

SEQ ID NO: 2066 - RNA, 20 nt, Artificial Sequence
  targeting sequence with ATCN PAM
uagacacuagcacagcugag

SEQ ID NO: 2067 - RNA, 20 nt, Artificial Sequence
  targeting sequence with ATCN PAM
ucuuuguggaaaggggccug

SEQ ID NO: 2068 - RNA, 20 nt, Artificial Sequence
  targeting sequence with ATCN PAM
ggguuuccuuaaagcgccuu

SEQ ID NO: 2069 - RNA, 20 nt, Artificial Sequence
  targeting sequence with ATCN PAM
agagggugauguguaagacc

SEQ ID NO: 2070 - RNA, 20 nt, Artificial Sequence
  targeting sequence with ATCN PAM
cccucuagaucuggguuucc

SEQ ID NO: 2071 - RNA, 20 nt, Artificial Sequence
  targeting sequence with ATCN PAM
caugggccaaggaacacagg

SEQ ID NO: 2072 - RNA, 20 nt, Artificial Sequence
  targeting sequence with ATCN PAM
gagucagaaccuggcaaaca

SEQ ID NO: 2073 - RNA, 20 nt, Artificial Sequence
  targeting sequence with ATCN PAM
guguucuccaggcauguggu

SEQ ID NO: 2074 - RNA, 20 nt, Artificial Sequence
  targeting sequence with ATCN PAM
ugacaccucccagagcuaag

SEQ ID NO: 2075 - RNA, 20 nt, Artificial Sequence
  targeting sequence with ATCN PAM
guuuaauugaccagcuuucc

SEQ ID NO: 2076 - RNA, 20 nt, Artificial Sequence
  targeting sequence with ATCN PAM
cacaggaccaggcuuccugu

SEQ ID NO: 2077 - RNA, 20 nt, Artificial Sequence
  targeting sequence with ATCN PAM
uuucaucccacaggaccagg

SEQ ID NO: 2078 - RNA, 20 nt, Artificial Sequence
  targeting sequence with ATCN PAM
cccgaggucuuuucaggagg

SEQ ID NO: 2079 - RNA, 20 nt, Artificial Sequence
  targeting sequence with ATCN PAM
ucccuccugaaaagaccucg

SEQ ID NO: 2080 - RNA, 20 nt, Artificial Sequence
  targeting sequence with ATCN PAM
ugaccacuugcagccucugc

SEQ ID NO: 2081 - RNA, 20 nt, Artificial Sequence
  targeting sequence with ATCN PAM
gaaagcagcaaaacuagcuu

SEQ ID NO: 2082 - RNA, 20 nt, Artificial Sequence
  targeting sequence with ATCN PAM
caccaagucuguggaaggca

SEQ ID NO: 2083 - RNA, 20 nt, Artificial Sequence
  targeting sequence with ATCN PAM
gucuuuauacccucucagcu

SEQ ID NO: 2084 - RNA, 20 nt, Artificial Sequence
  targeting sequence with ATCN PAM
uggcaacauggguagaaugc

SEQ ID NO: 2085 - RNA, 20 nt, Artificial Sequence
  targeting sequence with ATCN PAM
guccaugcaucucauccucu

SEQ ID NO: 2086 - RNA, 20 nt, Artificial Sequence
  targeting sequence with ATCN PAM
cauccucuccugcugugaug

SEQ ID NO: 2087 - RNA, 20 nt, Artificial Sequence
  targeting sequence with ATCN PAM
ucuccugcugugaugcugcg

SEQ ID NO: 2088 - RNA, 20 nt, Artificial Sequence
  targeting sequence with ATCN PAM
cagcaggagaggaugagaug

SEQ ID NO: 2089 - RNA, 20 nt, Artificial Sequence
  targeting sequence with ATCN PAM
cgguuuuguuuuaccugauc

SEQ ID NO: 2090 - RNA, 20 nt, Artificial Sequence
  targeting sequence with ATCN PAM
gguaaaacaaaaccgugaug

SEQ ID NO: 2091 - RNA, 20 nt, Artificial Sequence
  targeting sequence with ATCN PAM
caaaaugacugaugcaacug

SEQ ID NO: 2092 - RNA, 20 nt, Artificial Sequence
  targeting sequence with ATCN PAM
gucauuuugagaucagguaa

SEQ ID NO: 2093 - RNA, 20 nt, Artificial Sequence
  targeting sequence with ATCN PAM
caguugcaucagucauuuug

SEQ ID NO: 2094 - RNA, 20 nt, Artificial Sequence
  targeting sequence with ATCN PAM
cauggauaaagccaugccuc

SEQ ID NO: 2095 - RNA, 20 nt, Artificial Sequence
  targeting sequence with ATCN PAM
augggauuggaccauguaaa

SEQ ID NO: 2096 - RNA, 20 nt, Artificial Sequence
  targeting sequence with ATCN PAM
ugcgugcaggagguuauacc

SEQ ID NO: 2097 - RNA, 20 nt, Artificial Sequence
  targeting sequence with ATCN PAM
ucgugcgugcaggagguuau

SEQ ID NO: 2098 - RNA, 20 nt, Artificial Sequence
  targeting sequence with ATCN PAM
gugcuugcucccuuccucuc

SEQ ID NO: 2099 - RNA, 20 nt, Artificial Sequence
  targeting sequence with ATCN PAM
agacagugagccacagagga

SEQ ID NO: 2100 - RNA, 20 nt, Artificial Sequence
  targeting sequence with ATCN PAM
cccacuuuugaagccaagaa

SEQ ID NO: 2101 - RNA, 108 nt, Artificial Sequence
  CasX variant scaffold
uacuggcgcuuuuaucucauuacuuugagagccaucaccagcgacuaugucguauggguaaagcgcaggugggacgaccucucggucguccuaucugaagcaucaaag

SEQ ID NO: 2102 - RNA, 99 nt, Artificial Sequence
  CasX variant scaffold
uacuggcgcuuuuaucucauuacuuugagagccaucaccagcgacuaugucguauggguaaagcgcugcucgacgcguccucgagcagaagcaucaaag

SEQ ID NO: 2103 - RNA, 97 nt, Artificial Sequence
  CasX variant scaffold
uacuggcgcuuuuaucucauuacuuugagagccaucaccagcgacuaugucguauggguaaagcgcugcucgcuccguucgagcagaagcaucaaag

SEQ ID NO: 2104 - RNA, 91 nt, Artificial Sequence
  CasX variant scaffold
guacuggcgcuuuuaucucauuacuuugagagccaucaccagcgacuaugucguauggguaaagcgcccucuucggagggaagcaucaaag

SEQ ID NO: 2105 - RNA, 99 nt, Artificial Sequence
  CasX variant scaffold
uacuggcgcuuuuaucucauuacuuugagagccaucaccagcgacuaugucguauggguaaagcgcaggaguuucuauggaaacccugaagcaucaaag

SEQ ID NO: 2106 - RNA, 99 nt, Artificial Sequence
  CasX variant scaffold
guacuggcgccuuuaucucauuacuuugagagccaucaccagcgacuaugucguauggguaaagcgcuuacggacuucgguccguaagaagcaucaaag

SEQ ID NO: 2107 - RNA, 90 nt, Artificial Sequence
  CasX variant scaffold
uacuggcgcuuuuaucucauuacuuugagagccaucaccagcgacuaugucguauggguaaagcgcugcgcuugcgcagaagcaucaaag

SEQ ID NO: 2108 - RNA, 108 nt, Artificial Sequence
  CasX variant scaffold
uacuggcgcuuuuaucugauuacuuugagagccaucaccagcgacuaugucguauggguaaagcgcuuauuuaucggagagaaauccgauaaauaagaagcaucaaag

SEQ ID NO: 2109 - RNA, 108 nt, Artificial Sequence
  CasX variant scaffold
uacuggcgcuuuuaucgcauuacuuugagagccaucaccagcgacuaugucguauggguaaagcgcuuauuuaucggagagaaauccgauaaauaagaagcaucaaag

SEQ ID NO: 2110 - RNA, 110 nt, Artificial Sequence
  CasX variant scaffold
uacuggcgcuuuuaucucauuacuuugagagccaucaccagcgacuaugucguauggguaaagcgcuuauuuaucggagacuucgguccgauaaauaagaagcaucaaag

SEQ ID NO: 2111 - RNA, 97 nt, Artificial Sequence
  CasX variant scaffold
uacuggcgcuuuuaucucauuacuuugagagccaucaccagcgacuaugucguauggguaaagcgcacaugaggauuacccaugugaagcaucaaag

SEQ ID NO: 2112 - RNA, 106 nt, Artificial Sequence
  CasX variant scaffold
gcuggcgcuuuuaucucauuacuuugagagccaucaccagcgacuaugucguauggguaaagcgcuuauuuaucgugagaaauccgauaaauaagaagcaucaaag

SEQ ID NO: 2113 - RNA, 96 nt, Artificial Sequence
  CasX variant scaffold
uacuggcgcuuuuaucucauuacuuugagagccaucaccagcgacuaugucguauggguaaagcgcugcaugucuaagacagcagaagcaucaaag

SEQ ID NO: 2114 - RNA, 90 nt, Artificial Sequence
  CasX variant scaffold
uacuggcgcuuuuaucucauuacuuugagagccaucaccagcgacuaugucguauggguaaagcgcagggcuucggccgaagcaucaaag

SEQ ID NO: 2115 - RNA, 98 nt, Artificial Sequence
  CasX variant scaffold
uacuggcgcuuuuaucucauuacuuugagagccaucaccagcgacuaugucguauggguaaagcgcaauccauugcacuccggauugaagcaucaaag

SEQ ID NO: 2116 - RNA, 108 nt, Artificial Sequence
  CasX variant scaffold
uacuggcgcuuuucucgcauuacuuugagagccaucaccagcgacuaugucguauggguaaagcgcuuauuuaucggagagaaauccgauaaauaagaagcaucaaag

SEQ ID NO: 2117 - RNA, 108 nt, Artificial Sequence
  CasX variant scaffold
uacuggcgcuuuuaucucauuacuuugagagccaucaccagcgacuaugucguauggguaaagcgcuuauuuaucggacuucgguccgauaaauaagaagcaucaaag

SEQ ID NO: 2118 - RNA, 100 nt, Artificial Sequence
  CasX variant scaffold
uacuggcgcuuuuaucucauuacuuugagagccaucaccagcgacuaugucguauggguaaagcgcugcucguuugcggcuacgagcagaagcaucaaag

SEQ ID NO: 2119 - RNA, 100 nt, Artificial Sequence
  CasX variant scaffold
uacuggcgcuuuuaucucauuacuuugagagccaucaccagcgacuaugucguauggguaaagcgcuuauuuaucgagagauaaauaagaagcaucaaag

SEQ ID NO: 2120 - RNA, 107 nt, Artificial Sequence
  CasX variant scaffold
uacggcgcuuuuaucucauuacuuugagagccaucaccagcgacuaugucguauggguaaagcgcuuauuuaucggagagaaauccgauaaauaagaagcaucaaag

SEQ ID NO: 2121 - RNA, 99 nt, Artificial Sequence
  CasX variant scaffold
uacuggcgccuuuuaucucauuacuuugagagccaucaccagcgacuaugucguauggguaaagcgcuuacggacuucgguccguaagaagcaucaaag

SEQ ID NO: 2122 - RNA, 108 nt, Artificial Sequence
  CasX variant scaffold
uacuggcgcuuuuaucucauuacuuugagagccaucaccagcgacuaugucguaucgguaaagcgcuuauuuaucggagagaaauccgauaaauaagaagcaucaaag

SEQ ID NO: 2123 - RNA, 108 nt, Artificial Sequence
  CasX variant scaffold
uacuggcgccuuuaucucauuacuuugagagccaucaccagcgacuaugucguauggguaaagcgcuuauuuaucggacuucgguccgauaaauaagaagcaucaaag

SEQ ID NO: 2124 - RNA, 105 nt, Artificial Sequence
  CasX variant scaffold
uacuggcgcuuuuaucucauuacuuugagagccaucaccagcgacuaugucguauggguaaagcgcuuauuuaucgagaaauccgauaaauaagaagcaucaaag

SEQ ID NO: 2125 - RNA, 103 nt, Artificial Sequence
  CasX variant scaffold
gcgcuuuuaucucauuacuuugagagccaucaccagcgacuaugucguauggguaaagcgcuuauuuaucggagagaaauccgauaaauaagaagcaucaaag

SEQ ID NO: 2126 - RNA, 103 nt, Artificial Sequence
  CasX variant scaffold
uacuggcgcuuuuaucucauuacuuugagagccaucaccagcgacuaugucguauggguaaagcgcuuauuuaucggagagagauaaauaagaagcaucaaag

SEQ ID NO: 2127 - RNA, 108 nt, Artificial Sequence
  CasX variant scaffold
uacuggcgcuuuuaucucauuacuuuggagagccaucaccagcgacuaugucguauggguaaagcgcuuauuuaucggagaguauccgauaaauaagaagcaucaaag

SEQ ID NO: 2128 - RNA, 109 nt, Artificial Sequence
  CasX variant scaffold
uacuggcgcuuuuaucucauuacuuugagagccaucaccagcgacuauguucguauggguaaagcgcuuauuuaucggagagaaauccgauaaauaagaagcaucaaag

SEQ ID NO: 2129 - RNA, 105 nt, Artificial Sequence
  CasX variant scaffold
agcgcuuuuaucucauuacuuugagagccaucaccagcgacuaugucguauggguaaagcgcuuauuuaucggagagaaaugccgauaaauaagaagcaucaaag

SEQ ID NO: 2130 - RNA, 109 nt, Artificial Sequence
  CasX variant scaffold
uacuggcgcuuuuaucucauuacuuugagagccaucaccagcgacuaugucguauggguaaagcgcuuauuuaucggagagaaauccgauaaaauaagaagcaucaaag

SEQ ID NO: 2131 - RNA, 109 nt, Artificial Sequence
  CasX variant scaffold
uacuggcgcuuuuaucucauuacuuugagagccaucaccagcgacuaugucguauggguaaagcgcuuauuguaucggagagaaauccgauaaauaagaagcaucaaag

SEQ ID NO: 2132 - RNA, 102 nt, Artificial Sequence
  CasX variant scaffold
gcgcuuuuaucucauuacuuugagagccaucaccagcgacuaugucguauggguaaagcgcuuauuuaucggacuucgguccgauaaauaagcgcaucaaag

SEQ ID NO: 2133 - RNA, 108 nt, Artificial Sequence
  CasX variant scaffold
uacuggcgcuuuucucucauuacuuugagagccaucaccagcgacuaugucguauggguaaagcgcuuauuuaucggagagaaauccgauaaauaagaagcaucaaag

SEQ ID NO: 2134 - RNA, 106 nt, Artificial Sequence
  CasX variant scaffold
guggcgcuuuuaucucauuacuuugagagccaucaccagcgacuaugucguauggguaaagcgcuuauuuaucggagagaaauccgauaaauaagaagcaucaaag

SEQ ID NO: 2135 - RNA, 110 nt, Artificial Sequence
  CasX variant scaffold
uacuggcgcuuuuaucucauuacuuugagagccaucaccagcgaccuuaugucguauggguaaagcgcuuauuuaucggagagaaauccgauaaauaagaagcaucaaag

SEQ ID NO: 2136 - RNA, 107 nt, Artificial Sequence
  CasX variant scaffold
gauggcgcuuuuaucucauuacuuugagagccaucaccagcgacuaugucguauggguaaagcgcuuauuuaucggacuucgguccgauaaauaagaagcaucaaag

SEQ ID NO: 2137 - RNA, 106 nt, Artificial Sequence
  CasX variant scaffold
uacuggcgcuuuuaucucauuacuuugagagccaucaccagcgacuaugucguauggguaaagcgcuuauuuaucggagagaaauccgauaaaagaagcaucaaag

SEQ ID NO: 2138 - RNA, 109 nt, Artificial Sequence
  CasX variant scaffold
uacuggcgcuuuuaucucauuacuuugagagccaucaccagcgaucuaugucguauggguaaagcgcuuauuuaucggagagaaauccgauaaauaagaagcaucaaag

SEQ ID NO: 2139 - RNA, 106 nt, Artificial Sequence
  CasX variant scaffold
uacuggcgcuuuuaucucauuacuuugagagccaucaccagcgacuaugucguauggguaaaggcuuauuuaucggagagaaauccgauaaaaagaagcaucaaag

SEQ ID NO: 2140 - RNA, 107 nt, Artificial Sequence
  CasX variant scaffold
uacuggcgcuuuuaucucauuacuuugagagccaucaccagcgacuaugucguauggguaaagcgcuuauuuaucggagagaaauccgauaaaaagaagcaucaaag

SEQ ID NO: 2141 - RNA, 107 nt, Artificial Sequence
  CasX variant scaffold
uacuggcgcuuuaucucauuacuuugagagccaucaccagcgacuaugucguauggguaaagcgcuuauuuaucggacuucgguccgauaaauaagaagcaucaaag

SEQ ID NO: 2142 - RNA, 98 nt, Artificial Sequence
  CasX variant scaffold
cggcgcuuuucucgcauuacuuugagagccaucaccagcgacuaugucguauggguaaagcgcuuauuguaucgagagauaaauaagaagcaucaaag

SEQ ID NO: 2143 - RNA, 107 nt, Artificial Sequence
  CasX variant scaffold
cacuggcgcuuuuaucucauuacuuugagagccaucaccagcgacuaugucguauggguaaagcgcuuauuuucggagagaaauccgauaaauaagaagcaucaaag

SEQ ID NO: 2144 - RNA, 106 nt, Artificial Sequence
  CasX variant scaffold
uacuggcgcuuuaucucauuacuuugagagccaucaccagcgacuucggucguauggguaaagcgcuuauguaucggcuucggccgauacauaagaagcaucaaag

SEQ ID NO: 2145 - RNA, 107 nt, Artificial Sequence
  CasX variant scaffold
uacuggcgcuuuuaucucauuacuuugagagccaucaccagcgacuucggucguauggguaaagcgcuuauguaucggcuucggccgauacauaagaagcaucaaag

SEQ ID NO: 2146 - RNA, 109 nt, Artificial Sequence
  CasX variant scaffold
uacuggcgcuuuuaucucauuacuuugagagccaucaccagcgacuaugucguaugggugaaagcgcuuauuuaucggagagaaauccgauaaauaagaagcaucaaag

SEQ ID NO: 2147 - RNA, 64 nt, Artificial Sequence
  CasX variant scaffold
uacuggcgcuuuuaucucauuacuuugagagccaucaccagcgacuucggucguauggguaaag

SEQ ID NO: 2148 - RNA, 62 nt, Artificial Sequence
  CasX variant scaffold
gaugggcuuuuaucucauuacuuugagagccaucaccagcgacuucggucguauggguaaag

SEQ ID NO: 2149 - RNA, 105 nt, Artificial Sequence
  CasX variant scaffold
gaugggcuuuuaucucauuacuuugagagccaucaccagcgacuucggucguauggguaaagcgcuuauuuaucggcuucggccgauaaauaagaagcaucaaag

SEQ ID NO: 2150 - RNA, 156 nt, Artificial Sequence
  CasX variant scaffold
uacuggcgcuuuuaucucauuacuuugagagccaucaccagcgacuaugucguauggguaaagcgcuacacugggaucgcugaauuagagaucggcguccuuucauucuauauacuuuggaguuuuaaaaugucucuaaguacagaagcaucaaag

SEQ ID NO: 2151 - RNA, 103 nt, Artificial Sequence
  CasX variant scaffold
ggcgcuuuuaucucauuacuuugagagccaucaccagcgacuucggucguauggguaaagcgcuuauuuaucggcuucggccgauaaauaagaagcaucaaag

SEQ ID NO: 2152 - RNA, 106 nt, Artificial Sequence
  CasX variant scaffold
gcuggcgcuuuuaucucauuacuuugagagccaucaccagcgacuucggucguauggguaaagcgcuuauuuaucggcuucggccgauaaauaagaagcaucaaag

SEQ ID NO: 2153 - RNA, 109 nt, Artificial Sequence
  CasX variant scaffold
uacuggcgcuuuuaucucauuacuuugagagccaucaccagcgacuucggucguauggguaaagcgcuuauuuaucggagagaaauccgauaaauaagaagcaucaaag

SEQ ID NO: 2154 - RNA, 112 nt, Artificial Sequence
  CasX variant scaffold
uacuggcgcuuuuaucucauuacuuugagagccaugcuccaccagcgacuaugucguauggguaaagcgcuuauuuaucggagagaaauccgauaaauaagaagcaucaaag

SEQ ID NO: 2155 - RNA, 97 nt, Artificial Sequence
  CasX variant scaffold
uacuggcgcuuuuaucucauuacuuugagagccaucaccagcgacuaugucguauggguaaagcgggguuaggguuaggguuagggaagcaucaaag

SEQ ID NO: 2156 - RNA, 96 nt, Artificial Sequence
  CasX variant scaffold
uacuggcgcuuuuaucucauuacuuugagagccaucaccagcgacuaugucguauggguaaagcggagggagggagggagagggaaagcaucaaag

SEQ ID NO: 2157 - RNA, 101 nt, Artificial Sequence
  CasX variant scaffold
uacuggcgcuuuuaucucauuacuuugagagccaucaccagcgacuaugucguauggguaaagcguuggguuaggguuaggguuagggaaaagcaucaaag

SEQ ID NO: 2158 - RNA, 91 nt, Artificial Sequence
  CasX variant scaffold
uacuggcgcuuuuaucucauuacuuugagagccaucaccagcgacuaugucguauggguaaagcgcagggcuucggccggaagcaucaaag

SEQ ID NO: 2159 - RNA, 103 nt, Artificial Sequence
  CasX variant scaffold
uacuggcgcuuuuaucucauuacuuugagagccaucaccagcgacuaugucguauggguaaagcgccugcucaguacgagaggaaccgcaggaagcaucaaag

SEQ ID NO: 2160 - RNA, 90 nt, Artificial Sequence
  CasX variant scaffold
uacuggcgcuuuuaucugauuacuuugagagccaucaccagcgacuaugucguauggguaaagcgcccucuucggagggaagcaucaaag

SEQ ID NO: 2161 - RNA, 98 nt, Artificial Sequence
  CasX variant scaffold
uacuggcgccuuuaucugauuacuuugagagccaucaccagcgacuaugucguauggguaaagcgcuuacggacuucgguccguaagaagcaucaaag

SEQ ID NO: 2162 - RNA, 98 nt, Artificial Sequence
  CasX variant scaffold
uacuggcgcuuuuaucugauuacuuugagagccaucaccagcgacuaugucguauggguaaagcgcggacgaccucucggucguccgaagcaucaaag

SEQ ID NO: 2163 - RNA, 108 nt, Artificial Sequence
  CasX variant scaffold
uacuggcgcuuuuaucugauuacuuugagagccaucaccagcgacuaugucguauggguaaagcgcaggugggacgaccucucggucguccuaucugaagcaucaaag

SEQ ID NO: 2164 - RNA, 99 nt, Artificial Sequence
  CasX variant scaffold
uacuggcgccuuuaucugcauuacuuugagagccaucaccagcgacuaugucguauggguaaagcgcuuacggacuucgguccguaagaagcaucaaag

SEQ ID NO: 2165 - RNA, 97 nt, Artificial Sequence
  CasX variant scaffold
gcuggcgcuuuuaucugauuacuuugagagccaucaccagcgacuaugucguauggguaaagcgcuuacggacuucgguccguaagaagcaucaaag

SEQ ID NO: 2166 - RNA, 108 nt, Artificial Sequence
  CasX variant scaffold
uacuggcgccuuuaucugauuacuuugagagccaucaccagcgacuaugucguauggguaaagcgcaggugggacgaccucucggucguccuaucugaagcaucaaag

SEQ ID NO: 2167 - RNA, 98 nt, Artificial Sequence
  CasX variant scaffold
uacuggcgccuuuaucugauuacuuugagagccaucaccagcgacuaugucguauggguaaagcgcggacgaccucucggucguccgaagcaucaaag

SEQ ID NO: 2168 - RNA, 90 nt, Artificial Sequence
  CasX variant scaffold
uacuggcgccuuuaucucauuacuuugagagccaucaccagcgacuaugucguauggguaaagcgcccucuucggagggaagcaucaaag

SEQ ID NO: 2169 - RNA, 98 nt, Artificial Sequence
  CasX variant scaffold
uacuggcgcuuuuaucucauuacuuugagagccaucaccagcgacuaugucguauggguaaagcgcuuacggacuucgguccguaagaagcaucaaag

SEQ ID NO: 2170 - RNA, 99 nt, Artificial Sequence
  CasX variant scaffold
uacuggcgccuuuaucaucauuacuuugagagccaucaccagcgacuaugucguauggguaaagcgcuuacggacuucgguccguaagaagcaucaaag

SEQ ID NO: 2171 - RNA, 194 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagggccggcauggucccagccuccucgcuggcgccggcugggcaacauuccgaggggaccguccccucgguaauggcgaaugggaccc

SEQ ID NO: 2172 - RNA, 108 nt, Artificial Sequence
  CasX variant scaffold
uacuggcgccuuuaucucauuacuuugagagccaucaccagcgacuaugucguauggguaaagcgcaggugggacgaccucucggucguccuaucugaagcaucaaag

SEQ ID NO: 2173 - RNA, 106 nt, Artificial Sequence
  CasX variant scaffold
uacuggcgcuuuuaucucauuacuuugagagccaucaccagcgacuaugucguauggguaaagcgcuuauuuaucggagaaauccgauaaauaagaagcaucaaag

SEQ ID NO: 2174 - RNA, 98 nt, Artificial Sequence
  CasX variant scaffold
uacuggcgccuuuaucucauuacuuugagagccaucaccagcgacuaugucguauggguaaagcgcggacgaccucucggucguccgaagcaucaaag

SEQ ID NO: 2175 - RNA, 92 nt, Artificial Sequence
  CasX variant scaffold
uacuggcgcuuuuaucucauuacuuugagagccaucaccagcgacuaugucguauggguaaagcgccggacuucgguccggaagcaucaaag

SEQ ID NO: 2176 - RNA, 108 nt, Artificial Sequence
  CasX variant scaffold
uacuggcgcuuuuaucggauuacuuugagagccaucaccagcgacuaugucguauggguaaagcgcuuauuuaucggagagaaauccgauaaauaagaagcaucaaag

SEQ ID NO: 2177 - RNA, 98 nt, Artificial Sequence
  CasX variant scaffold
uacuggcgcuuuuaucucauuacuuugagagccaucaccagcgacuaugucguauggguaaagcgcggacgaccucucggucguccgaagcaucaaag

SEQ ID NO: 2178 - RNA, 89 nt, Artificial Sequence
  CasX variant scaffold
gcuggcgcuuuuaucugauuacuuugagagccaucaccagcgacuaugucguauggguaaagcgcccucuucggagggaagcaucaaag

SEQ ID NO: 2179 - RNA, 88 nt, Artificial Sequence
  CasX variant scaffold
gcuggcgccuuuaucugauuacuuugagagccaucaccagcgacuaugucguauggguaaagcucccucuucggagggagcaucaaag

SEQ ID NO: 2180 - RNA, 197 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaaggggucggcauggcaucuccaccuccucgcgguccgaccugggcauccgaaggaggacgcacguccacucggauggcuaagggagagcca

SEQ ID NO: 2181 - RNA, 88 nt, Artificial Sequence
  CasX variant scaffold
gcuggcgccuuuaucugauuacuuugagagccaucaccagcgacuaugucguauggguaaagcgcccucuucggagggcgcaucaaag

SEQ ID NO: 2182 - RNA, 186 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaaguuuuggccggcauggucccagccuccucgcuggcgccggcugggcaacaugcuucggcauggcgaaugggaccccggg

SEQ ID NO: 2183 - RNA, 97 nt, Artificial Sequence
  CasX variant scaffold
gauggcgccuuuaucucauuacuuugagagccaucaccagcgacuaugucguauggguaaagcgcuuacggacuucgguccguaagaagcaucaaag

SEQ ID NO: 2184 - RNA, 89 nt, Artificial Sequence
  CasX variant scaffold
gcuggcgcuuuuaucucauuacuuugagagccaucaccagcgacuaugucguauggguaaagcgcccucuucggagggaagcaucaaag

SEQ ID NO: 2185 - RNA, 96 nt, Artificial Sequence
  CasX variant scaffold
gcuggcgccuuuaucugauuacuuugagagccaucaccagcgacuaugucguauggguaaagcucuuacggacuucgguccguaagagcaucaaag

SEQ ID NO: 2186 - RNA, 96 nt, Artificial Sequence
  CasX variant scaffold
gcuggcgccuuuaucugauuacuuugagagccaucaccagcgacuaugucguauggguaaagcucggacgaccucucggucguccgagcaucaaag

SEQ ID NO: 2187 - RNA, 160 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagccugucaccggaugugcuuuccggucugaugaguccgugaggacgaaacagg

SEQ ID NO: 2188 - RNA, 97 nt, Artificial Sequence
  CasX variant scaffold
gcuggcgcuuuuaucugauuacuuugagagccaucaccagcgacuaugucguauggguaaagcgcggacgaccucucggucguccgaagcaucaaag

SEQ ID NO: 2189 - RNA, 97 nt, Artificial Sequence
  CasX variant scaffold
gcuggcgccuuuaucugauuacuuugagagccaucaccagcgacuaugucguauggguaaagcgcggacgaccucucggucguccgaagcaucaaag

SEQ ID NO: 2190 - RNA, 106 nt, Artificial Sequence
  CasX variant scaffold
gcuggcgccuuuaucugauuacuuugagagccaucaccagcgacuaugucguauggguaaagcucaggugggacgaccucucggucguccuaucugagcaucaaag

SEQ ID NO: 2191 - RNA, 177 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaaggauggccggcauggucccagccuccucgcuggcgccggcugggcaacaccuucggguggcgaaugggac

SEQ ID NO: 2192 - RNA, 107 nt, Artificial Sequence
  CasX variant scaffold
gcuggcgcuuuuaucugauuacuuugagagccaucaccagcgacuaugucguauggguaaagcgcaggugggacgaccucucggucguccuaucugaagcaucaaag

SEQ ID NO: 2193 - RNA, 109 nt, Artificial Sequence
  CasX variant scaffold
uacuggcgcuuuuaucucauuacuuugagagccaucaccagcgacuaugucguacuggguaaagcgcuuauuuaucggagagaaauccgauaaauaagaagcaucaaag

SEQ ID NO: 2194 - RNA, 107 nt, Artificial Sequence
  CasX variant scaffold
uacuggcgcuuuuaucucauuacuuugagagccaucaccagcgacuaugucguauggguaaagcgcuuauuuaucgugagaaauccgauaaauaagaagcaucaaag

SEQ ID NO: 2195 - RNA, 109 nt, Artificial Sequence
  CasX variant scaffold
guacuggcgcuuuuaucucauuacuuugagagccaucaccagcgacuaugucguauggguaaagcgcuuauuuaucggagagaaauccgauaaauaagaagcaucaaag

SEQ ID NO: 2196 - RNA, 97 nt, Artificial Sequence
  CasX variant scaffold
gcuggcgcuuuuaucucauuacuuugagagccaucaccagcgacuaugucguauggguaaagcgcggacgaccucucggucguccgaagcaucaaag

SEQ ID NO: 2197 - RNA, 97 nt, Artificial Sequence
  CasX variant scaffold
gcuggcgccuuuaucugauuacuuugagagccaucaccagcgacuaugucguauggguaaagcgcuuacggacuucgguccguaagaagcaucaaag

SEQ ID NO: 2198 - RNA, 107 nt, Artificial Sequence
  CasX variant scaffold
gcuggcgcuuuuaucucauuacuuugagagccaucaccagcgacuaugucguauggguaaagcgcuuauuuaucggagagaaauccgauaaauaagaagcaucaaag

SEQ ID NO: 2199 - RNA, 97 nt, Artificial Sequence
  CasX variant scaffold
gcuggcgccuuuaucucauuacuuugagagccaucaccagcgacuaugucguauggguaaagcgcuuacggacuucgguccguaagaagcaucaaag

SEQ ID NO: 2200 - RNA, 89 nt, Artificial Sequence
  CasX variant scaffold
gcuggcgccuuuaucugauuacuuugagagccaucaccagcgacuaugucguauggguaaagcgcccucuucggagggaagcaucaaag

SEQ ID NO: 2201 - RNA, 107 nt, Artificial Sequence
  CasX variant scaffold
gcuggcgcuuuuaucucauuacuuugagagccaucaccagcgacuaugucguauggguaaagcgcaggugggacgaccucucggucguccuaucugaagcaucaaag

SEQ ID NO: 2202 - RNA, 107 nt, Artificial Sequence
  CasX variant scaffold
gcuggcgccuuuaucucauuacuuugagagccaucaccagcgacuaugucguauggguaaagcgcaggugggacgaccucucggucguccuaucugaagcaucaaag

SEQ ID NO: 2203 - RNA, 107 nt, Artificial Sequence
  CasX variant scaffold
gcuggcgccuuuaucugauuacuuugagagccaucaccagcgacuaugucguauggguaaagcgcaggugggacgaccucucggucguccuaucugaagcaucaaag

SEQ ID NO: 2204 - RNA, 98 nt, Artificial Sequence
  CasX variant scaffold
uacuggcgcuuuuaucugauuacuuugagagccaucaccagcgacuaugucguauggguaaagcgcuuacggacuucgguccguaagaagcaucaaag

SEQ ID NO: 2205 - RNA, 89 nt, Artificial Sequence
  CasX variant scaffold
gcuggcgccuuuaucucauuacuuugagagccaucaccagcgacuaugucguauggguaaagcgcccucuucggagggaagcaucaaag

SEQ ID NO: 2206 - RNA, 97 nt, Artificial Sequence
  CasX variant scaffold
gcuggcgcuuuuaucucauuacuuugagagccaucaccagcgacuaugucguauggguaaagcgcuuacggacuucgguccguaagaagcaucaaag

SEQ ID NO: 2207 - RNA, 97 nt, Artificial Sequence
  CasX variant scaffold
gcuggcgccuuuaucucauuacuuugagagccaucaccagcgacuaugucguauggguaaagcgcggacgaccucucggucguccgaagcaucaaag

SEQ ID NO: 2208 - RNA, 177 nt, Artificial Sequence
  CasX variant scaffold
gauggccggcauggucccagccuccucgcuggcgccggcugggcaacaccuucggguggcgaaugggacuacuggcgcuuuuaucucauuacuuugagagccaucaccagcgacuaugucguauggguaaagcgcuuauuuaucggagagaaauccgauaaauaagaagcaucaaag

SEQ ID NO: 2209 - RNA, 194 nt, Artificial Sequence
  CasX variant scaffold
ggccggcauggucccagccuccucgcuggcgccggcugggcaacauuccgaggggaccguccccucgguaauggcgaaugggacccuacuggcgcuuuuaucucauuacuuugagagccaucaccagcgacuaugucguauggguaaagcgcuuauuuaucggagagaaauccgauaaauaagaagcaucaaag

SEQ ID NO: 2210 - RNA, 96 nt, Artificial Sequence
  CasX variant scaffold
gcuggcgccuuuaucugauuacuuugagagccaucaccagcgacuaugucguauggguaaagcgcuuacggacuucgguccguaagcgcaucaaag

SEQ ID NO: 2211 - RNA, 172 nt, Artificial Sequence
  CasX variant scaffold
cgugguuagggccacguuaaauaguugcuuaagcccuaagcguugaucuucggaucaggugcaauacuggcgcuuuuaucucauuacuuugagagccaucaccagcgacuaugucguauggguaaagcgcuuauuuaucggagagaaauccgauaaauaagaagcaucaaag

SEQ ID NO: 2212 - RNA, 197 nt, Artificial Sequence
  CasX variant scaffold
gggucggcauggcaucuccaccuccucgcgguccgaccugggcauccgaaggaggacgcacguccacucggauggcuaagggagagccauacuggcgcuuuuaucucauuacuuugagagccaucaccagcgacuaugucguauggguaaagcgcuuauuuaucggagagaaauccgauaaauaagaagcaucaaag

SEQ ID NO: 2213 - RNA, 171 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagccaguacugaugaguccgugaggacgaaacgaguaagcucgucuacuggcgcuuuuaucucau

SEQ ID NO: 2214 - RNA, 99 nt, Artificial Sequence
  CasX variant scaffold
uacuggcgccuuuaucucauuacuuuagagagccaucaccagcgacuaugucguauggguaaagcgcuuacggacuucgguccguaagaagcaucaaag

SEQ ID NO: 2215 - RNA, 157 nt, Artificial Sequence
  CasX variant scaffold
cgacuacugaugaguccgugaggacgaaacgaguaagcucgucuagucguacuggcgcuuuuaucucauuacuuugagagccaucaccagcgacuaugucguauggguaaagcgcuuauuuaucggagagaaauccgauaaauaagaagcaucaaag

SEQ ID NO: 2216 - RNA, 106 nt, Artificial Sequence
  CasX variant scaffold
gcuggcgccuuuaucugauuacuuugagagccaucaccagcgacuaugucguauggguaaagcgcaggugggacgaccucucggucguccuaucugcgcaucaaag

SEQ ID NO: 2217 - RNA, 97 nt, Artificial Sequence
  CasX variant scaffold
uacuggcgccuuuaucucauuacuuuagagccaucaccagcgacuaugucguauggguaaagcgcuuacggacuucgguccguaagaagcaucaaag

SEQ ID NO: 2218 - RNA, 186 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagcauuccucagaaaaugacaaaccuguggggcguaaguagaucuucggaucuaugaucgugcagacguuaaaaucaggu

SEQ ID NO: 2219 - RNA, 171 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucgcguguagcgaagca

SEQ ID NO: 2220 - RNA, 186 nt, Artificial Sequence
  CasX variant scaffold
cauuccucagaaaaugacaaaccuguggggcguaaguagaucuucggaucuaugaucgugcagacguuaaaaucagguuacuggcgcuuuuaucucauuacuuugagagccaucaccagcgacuaugucguauggguaaagcgcuuauuuaucggagagaaauccgauaaauaagaagcaucaaag

SEQ ID NO: 2221 - RNA, 186 nt, Artificial Sequence
  CasX variant scaffold
uuuuggccggcauggucccagccuccucgcuggcgccggcugggcaacaugcuucggcauggcgaaugggaccccggguacuggcgcuuuuaucucauuacuuugagagccaucaccagcgacuaugucguauggguaaagcgcuuauuuaucggagagaaauccgauaaauaagaagcaucaaag

SEQ ID NO: 2222 - RNA, 171 nt, Artificial Sequence
  CasX variant scaffold
cgacuacugaugaguccgugaggacgaaacgaguaagcucgucuagucgcguguagcgaagcauacuggcgcuuuuaucucauuacuuugagagccaucaccagcgacuaugucguauggguaaagcgcuuauuuaucggagagaaauccgauaaauaagaagcaucaaag

SEQ ID NO: 2223 - RNA, 168 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaaggggagccccgcugaugaggucggggagaccgaaagggacuucggucccuacggggcuccc

SEQ ID NO: 2224 - RNA, 144 nt, Artificial Sequence
  CasX variant scaffold
ccacccccaccaccacccccacccccaccaccacccuacuggcgcuuuuaucucauuacuuugagagccaucaccagcgacuaugucguauggguaaagcgcuuauuuaucggagagaaauccgauaaauaagaagcaucaaag

SEQ ID NO: 2225 - RNA, 157 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucg

SEQ ID NO: 2226 - RNA, 172 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagcgugguuagggccacguuaaauaguugcuuaagcccuaagcguugaucuucggaucaggugcaa

SEQ ID NO: 2227 - RNA, 184 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagggcaauaaagcgguuacaagcccgcaaaaauagcagaguaaugucgcgauagcgcggcauuaaugcagcuuuauug

SEQ ID NO: 2228 - RNA, 122 nt, Artificial Sequence
  CasX variant scaffold
uacuggcgcuuuuaucucauuacuauuaucucauuacuuugagagccaucaccagcgacuaugucguauggguaaagcgcuuauuuaucggagagaaauccgauaaauaagaagcaucaaag

SEQ ID NO: 2229 - RNA, 184 nt, Artificial Sequence
  CasX variant scaffold
ggcaauaaagcgguuacaagcccgcaaaaauagcagaguaaugucgcgauagcgcggcauuaaugcagcuuuauuguacuggcgcuuuuaucucauuacuuugagagccaucaccagcgacuaugucguauggguaaagcgcuuauuuaucggagagaaauccgauaaauaagaagcaucaaag

SEQ ID NO: 2230 - RNA, 185 nt, Artificial Sequence
  CasX variant scaffold
uacuggcgcuuuuaucucauuacuuugagagccaucaccagcgacuaugucguauggguaaagcgcuuauuuaucggagagaaauccgauaaauaagaagcaucaaagacccgcaaggccgacggcauccgccgccgcuggugcaaguccagccgccccuucgggggcgggcgcucauggguaac

SEQ ID NO: 2231 - RNA, 63 nt, Artificial Sequence
  CasX variant scaffold
uacuggcgcuuuuaucucauuacuuugagagccaucaccagcgacuaugucguauggguaaag

SEQ ID NO: 2232 - RNA, 168 nt, Artificial Sequence
  CasX variant scaffold
gggagccccgcugaugaggucggggagaccgaaagggacuucggucccuacggggcucccuacuggcgcuuuuaucucauuacuuugagagccaucaccagcgacuaugucguauggguaaagcgcuuauuuaucggagagaaauccgauaaauaagaagcaucaaag

SEQ ID NO: 2233 - RNA, 171 nt, Artificial Sequence
  CasX variant scaffold
ccaguacugaugaguccgugaggacgaaacgaguaagcucgucuacuggcgcuuuuaucucauuacuggcgcuuuuaucucauuacuuugagagccaucaccagcgacuaugucguauggguaaagcgcuuauuuaucggagagaaauccgauaaauaagaagcaucaaag

SEQ ID NO: 2234 - RNA, 185 nt, Artificial Sequence
  CasX variant scaffold
acccgcaaggccgacggcauccgccgccgcuggugcaaguccagccgccccuucgggggcgggcgcucauggguaacuacuggcgcuuuuaucucauuacuuugagagccaucaccagcgacuaugucguauggguaaagcgcuuauuuaucggagagaaauccgauaaauaagaagcaucaaag

SEQ ID NO: 2235 - RNA, 160 nt, Artificial Sequence
  CasX variant scaffold
ccugucaccggaugugcuuuccggucugaugaguccgugaggacgaaacagguacuggcgcuuuuaucucauuacuuugagagccaucaccagcgacuaugucguauggguaaagcgcuuauuuaucggagagaaauccgauaaauaagaagcaucaaag

SEQ ID NO: 2236 - RNA, 100 nt, Artificial Sequence
  CasX variant scaffold
guacuggcgccuuuaucucauuacuuugagagccaucaccagcgacuaugucguaguggguaaagcgcuuacggacuucgguccguaagaagcaucaaag

SEQ ID NO: 2237 - RNA, 91 nt, Artificial Sequence
  CasX variant scaffold
guacuggcgcuuuuaucugauuacuuugagagccaucaccagcgacuaugucguaguggguaaagcucccucuucggagggagcaucaaag

SEQ ID NO: 2238 - RNA, 89 nt, Artificial Sequence
  CasX variant scaffold
acuggcgcuuuuaucugauuacuuugagagccaucaccagcgacuaugucguaguggguaaagcucccucuucggagggagcaucaaag

SEQ ID NO: 2239 - RNA, 97 nt, Artificial Sequence
  CasX variant scaffold
acuggcgccuuuaucucauuacuuugagagccaucaccagcgacuaugucguauggguaaagcgcuuacggacuucgguccguaagaagcaucaaag

SEQ ID NO: 2240 - RNA, 89 nt, Artificial Sequence
  CasX variant scaffold
gcuggcgcuuuuaucugauuacuuugagagccaucaccagcgacuaugucguaguggguaaagcucccucuucggagggagcaucaaag

SEQ ID NO: 2241 - RNA, 88 nt, Artificial Sequence
  CasX variant scaffold
acuggcgcuuuuaucugauuacuuugagagccaucaccagcgacuaugucguauggguaaagcucccucuucggagggagcaucaaag

SEQ ID NO: 2242 - RNA, 97 nt, Artificial Sequence
  CasX variant scaffold
acuggcgccuuuaucugauuacuuugagagccaucaccagcgacuaugucguauggguaaagcgcuuacggacuucgguccguaagaagcaucaaag

SEQ ID NO: 2243 - RNA, 97 nt, Artificial Sequence
  CasX variant scaffold
acuggcgcuuuuaucugauuacuuugagagccaucaccagcgacuaugucguauggguaaagcgcuuacggacuucgguccguaagaagcaucaaag

SEQ ID NO: 2244 - RNA, 98 nt, Artificial Sequence
  CasX variant scaffold
acuggcgcuuuuaucugauuacuuugagagccaucaccagcgacuaugucguaguggguaaagcgcuuacggacuucgguccguaagaagcaucaaag

SEQ ID NO: 2245 - RNA, 89 nt, Artificial Sequence
  CasX variant scaffold
acuggcgcuuuuaucugauuacuuugagagccaucaccagcgacuaugucguauuggguaaagcucccucuucggagggagcaucaaag

SEQ ID NO: 2246 - RNA, 98 nt, Artificial Sequence
  CasX variant scaffold
acuggcgcuuuuaucugauuacuuugagagccaucaccagcgacuaugucguauuggguaaagcgcuuacggacuucgguccguaagaagcaucaaag

SEQ ID NO: 2247 - RNA, 98 nt, Artificial Sequence
  CasX variant scaffold
acuggcgccuuuaucaucauuacuuugagagccaucaccagcgacuaugucguauggguaaagcgcuuacggacuucgguccguaagaagcaucaaag

SEQ ID NO: 2248 - RNA, 90 nt, Artificial Sequence
  CasX variant scaffold
acuggcgcuuuuaucugauuacuuugagagccaucaccagcgacuaugucguaguggguaaagcgcccucuucggagggaagcaucaaag

SEQ ID NO: 2249 - RNA, 96 nt, Artificial Sequence
  CasX variant scaffold
acuggcgcuuuuaucugauuacuuugagagccaucaccagcgacuaugucguaguggguaaagcucacaugaggaucacccaugugagcaucaaag

SEQ ID NO: 2250 - RNA, 89 nt, Artificial Sequence
  CasX variant scaffold
acuggcacuuuuaccugauuacuuugagagccaacaccagcgacuaugucguaguggguaaagcucccucuucggagggagcaucaaag

SEQ ID NO: 2251 - RNA, 89 nt, Artificial Sequence
  CasX variant scaffold
acuggcacuuuuaucugauuacuuugagagccaucaccagcgacuaugucguaguggguaaagcucccucuucggagggagcaucaaag

SEQ ID NO: 2252 - RNA, 89 nt, Artificial Sequence
  CasX variant scaffold
acuggcccuuuuaucugauuacuuugagagccaucaccagcgacuaugucguaguggguaaagcucccucuucggagggagcaucaaag

SEQ ID NO: 2253 - RNA, 89 nt, Artificial Sequence
  CasX variant scaffold
acuggcgcuuuuaccugauuacuuugagagccaucaccagcgacuaugucguaguggguaaagcucccucuucggagggagcaucaaag

SEQ ID NO: 2254 - RNA, 89 nt, Artificial Sequence
  CasX variant scaffold
acuggcgcuuuuaucugauuacuuugagagccaacaccagcgacuaugucguaguggguaaagcucccucuucggagggagcaucaaag

SEQ ID NO: 2255 - RNA, 97 nt, Artificial Sequence
  CasX variant scaffold
acuggcaccuuuaccugauuacuuugagagccaacaccagcgacuaugucguauggguaaagcgcuuacggacuucgguccguaagaagcaucaaag

SEQ ID NO: 2256 - RNA, 97 nt, Artificial Sequence
  CasX variant scaffold
acuggcaccuuuaucugauuacuuugagagccaucaccagcgacuaugucguauggguaaagcgcuuacggacuucgguccguaagaagcaucaaag

SEQ ID NO: 2257 - RNA, 97 nt, Artificial Sequence
  CasX variant scaffold
acuggccccuuuaucugauuacuuugagagccaucaccagcgacuaugucguauggguaaagcgcuuacggacuucgguccguaagaagcaucaaag

SEQ ID NO: 2258 - RNA, 97 nt, Artificial Sequence
  CasX variant scaffold
acuggcgccuuuaucugauuacuuugagagccaacaccagcgacuaugucguauggguaaagcgcuuacggacuucgguccguaagaagcaucaaag

SEQ ID NO: 2259 - RNA, 89 nt, Artificial Sequence; identical to SEQ ID NO: 2240
  CasX variant scaffold

SEQ ID NO: 2260 - RNA, 90 nt, Artificial Sequence
  CasX variant scaffold
gacuggcgcuuuuaucugauuacuuugagagccaucaccagcgacuaugucguaguggguaaagcucccucuucggagggagcaucaaag

SEQ ID NO: 2261 - RNA, 90 nt, Artificial Sequence
  CasX variant scaffold
acuggcgccuuuaucugauuacuuuggagagccaucaccagcgacuaugucguaguggguaaagcucccucuucggagggagcaucaaag

SEQ ID NO: 2262 - RNA, 89 nt, Artificial Sequence
  CasX variant scaffold
acuggcgcauuuaucugauuacuuugugagccaucaccagcgacuaugucguaguggguaaagcucccucuucggagggagcaucaaag

SEQ ID NO: 2263 - RNA, 89 nt, Artificial Sequence
  CasX variant scaffold
acuggcgccuuuaucugauuacuuugagagccaucaccagcgacuaugucguaguggguaaagcucccucuucggagggagcaucaaag

SEQ ID NO: 2264 - RNA, 90 nt, Artificial Sequence
  CasX variant scaffold
acuggcgcuuuuaucugauuacuuuggagagccaucaccagcgacuaugucguaguggguaaagcucccucuucggagggagcaucaaag

SEQ ID NO: 2265 - RNA, 89 nt, Artificial Sequence
  CasX variant scaffold
acuggcgcauuuaucugauuacuuugagagccaucaccagcgacuaugucguaguggguaaagcucccucuucggagggagcaucaaag

SEQ ID NO: 2266 - RNA, 89 nt, Artificial Sequence
  CasX variant scaffold
acuggcgcuuuuaucugauuacuuugugagccaucaccagcgacuaugucguaguggguaaagcucccucuucggagggagcaucaaag

SEQ ID NO: 2267 - RNA, 90 nt, Artificial Sequence
  CasX variant scaffold
acuggcgcuuuuauucugauuacuuugagagccaucaccagcgacuaugucguaguggguaaagcucccucuucggagggagcaucaaag

SEQ ID NO: 2268 - RNA, 88 nt, Artificial Sequence
  CasX variant scaffold
acggcgcuuuuaucugauuacuuugagagccaucaccagcgacuaugucguaguggguaaagcucccucuucggagggagcaucaaag

SEQ ID NO: 2269 - RNA, 89 nt, Artificial Sequence
  CasX variant scaffold
acuggcgcuuuuauaugauuacuuugagagccaucaccagcgacuaugucguaguggguaaagcucccucuucggagggagcaucaaag

SEQ ID NO: 2270 - RNA, 90 nt, Artificial Sequence
  CasX variant scaffold
acuggcgcuuuuaucuugauuacuuugagagccaucaccagcgacuaugucguaguggguaaagcucccucuucggagggagcaucaaag

SEQ ID NO: 2271 - RNA, 89 nt, Artificial Sequence
  CasX variant scaffold
acuggcgcuuuuaucugauuacuuugagagccagcaccagcgacuaugucguaguggguaaagcucccucuucggagggagcaucaaag

SEQ ID NO: 2272 - RNA, 89 nt, Artificial Sequence
  CasX variant scaffold
acuggcgcuguuaucugauuacuucgagagccaucaccagcgacuaugucguaguggguaaagcucccucuucggagggagcaucgaag

SEQ ID NO: 2273 - RNA, 89 nt, Artificial Sequence
  CasX variant scaffold
acuggcgcucuuaucugauuacuucgagagccaucaccagcgacuaugucguaguggguaaagcucccucuucggagggagcaucgaag

SEQ ID NO: 2274 - RNA, 89 nt, Artificial Sequence
  CasX variant scaffold
acuggcgcuuguaucugauuacucugagagccaucaccagcgacuaugucguaguggguaaagcucccucuucggagggagcaucagag

SEQ ID NO: 2275 - RNA, 89 nt, Artificial Sequence
  CasX variant scaffold
acuggcgcuucuaucugauuacucugagagccaucaccagcgacuaugucguaguggguaaagcucccucuucggagggagcaucagag

SEQ ID NO: 2276 - RNA, 89 nt, Artificial Sequence
  CasX variant scaffold
acuggcgcuuugaucugauuaccuugagagccaucaccagcgacuaugucguaguggguaaagcucccucuucggagggagcaucaagg

SEQ ID NO: 2277 - RNA, 89 nt, Artificial Sequence
  CasX variant scaffold
acuggcgcuuucaucugauuaccuugagagccaucaccagcgacuaugucguaguggguaaagcucccucuucggagggagcaucaagg

SEQ ID NO: 2278 - RNA, 89 nt, Artificial Sequence
  CasX variant scaffold
acuggcgcuguuaucugauuacuuugagagccaucaccagcgacuaugucguaguggguaaagcucccucuucggagggagcaucaaag

SEQ ID NO: 2279 - RNA, 89 nt, Artificial Sequence
  CasX variant scaffold
acuggcgcuuuuaucugauuacuuugagagccaucaccagcgacuaugucguaguggguaaagcucccucuucggagggagcaucgaag

SEQ ID NO: 2280 - RNA, 89 nt, Artificial Sequence
  CasX variant scaffold
acuggcgcuuuuaucugauuacuucgagagccaucaccagcgacuaugucguaguggguaaagcucccucuucggagggagcaucaaag

SEQ ID NO: 2281 - RNA, 98 nt, Artificial Sequence
  CasX variant scaffold
acuggcacuucuaucugauuacucugagagccaucaccagcgacuaugucguauggguaaagccgcuuacggacuucgguccguaagaggcaucagag

SEQ ID NO: 2282 - RNA, 89 nt, Artificial Sequence
  CasX variant scaffold
acuggcacuucuaucugauuacucugagagccaucaccagcgacuaugucguaguggguaaagcucccucuucggagggagcaucagag

SEQ ID NO: 2283 - RNA, 98 nt, Artificial Sequence
  CasX variant scaffold
acuggcaccuuuaucugauuacuuugagagccaucaccagcgacuaugucguauggguaaagccgcuuacggacuucgguccguaagaggcaucaaag

SEQ ID NO: 2284 - RNA, 98 nt, Artificial Sequence
  CasX variant scaffold
acuggcacuuguaucugauuacucugagagccaucaccagcgacuaugucguauggguaaagccgcuuacggacuucgguccguaagaggcaucagag

SEQ ID NO: 2285 - RNA, 89 nt, Artificial Sequence
  CasX variant scaffold
acuggcacuuguaucugauuacucugagagccaucaccagcgacuaugucguaguggguaaagcucccucuucggagggagcaucagag

SEQ ID NO: 2286 - RNA, 20 nt, Artificial Sequence
  targeting sequence with ATCN PAM
gaguacaagaccuccgauau

SEQ ID NO: 2287 - RNA, 20 nt, Artificial Sequence
  targeting sequence with ATCN PAM
gaggucuuguacucugauga

SEQ ID NO: 2288 - RNA, 20 nt, Artificial Sequence
  targeting sequence with ATCN PAM
gcagcauugagguaaaagau

SEQ ID NO: 2289 - RNA, 20 nt, Artificial Sequence
  targeting sequence with ATCN PAM
uuuaccucaaugcugcugau

SEQ ID NO: 2290 - RNA, 20 nt, Artificial Sequence
  targeting sequence with ATCN PAM
gggccacagccuugcuccgg

SEQ ID NO: 2291 - RNA, 20 nt, Artificial Sequence
  targeting sequence with ATCN PAM
cacaacagcucacacuaccu

SEQ ID NO: 2292 - RNA, 20 nt, Artificial Sequence
  targeting sequence with ATCN PAM
ggaacccaugugccucaccc

SEQ ID NO: 2293 - RNA, 20 nt, Artificial Sequence
  targeting sequence with ATCN PAM
cuccaggguuggguuucuag

SEQ ID NO: 2294 - RNA, 20 nt, Artificial Sequence
  targeting sequence with ATCN PAM
cuuuucacagacuagaaacc

SEQ ID NO: 2295 - RNA, 20 nt, Artificial Sequence
  targeting sequence with ATCN PAM
aaacccaauaggccugcagu

SEQ ID NO: 2296 - RNA, 20 nt, Artificial Sequence
  targeting sequence with ATCN PAM
cagugcugucuggcugucug

SEQ ID NO: 2297 - RNA, 20 nt, Artificial Sequence
  targeting sequence with ATCN PAM
cacauucccauaccuucaca

SEQ ID NO: 2298 - RNA, 20 nt, Artificial Sequence
  targeting sequence with ATCN PAM
ucuugcugagccuuaauuuc

SEQ ID NO: 2299 - RNA, 20 nt, Artificial Sequence
  targeting sequence with ATCN PAM
ccauggguccauagccaaaa

SEQ ID NO: 2300 - RNA, 20 nt, Artificial Sequence
  targeting sequence with ATCN PAM
guauauucugggguuuaccu

SEQ ID NO: 2301 - RNA, 20 nt, Artificial Sequence
  targeting sequence with ATCN PAM
acuggccuggaucugggggu

SEQ ID NO: 2302 - RNA, 20 nt, Artificial Sequence
  targeting sequence with ATCN PAM
aggccaguggauuuacaagu

SEQ ID NO: 2303 - RNA, 20 nt, Artificial Sequence
  targeting sequence with ATCN PAM
gggggucuucaccugaagcc

SEQ ID NO: 2304 - RNA, 20 nt, Artificial Sequence
  targeting sequence with ATCN PAM
uacuggggucaaaauguagu

SEQ ID NO: 2305 - RNA, 20 nt, Artificial Sequence
  targeting sequence with ATCN PAM
uaggaguuuacuuuaacgca

SEQ ID NO: 2306 - RNA, 20 nt, Artificial Sequence
  targeting sequence with ATCN PAM
acugccugcagacuuauuug

SEQ ID NO: 2307 - RNA, 20 nt, Artificial Sequence
  targeting sequence with ATCN PAM
gggugcucagcauaauucca

SEQ ID NO: 2308 - RNA, 20 nt, Artificial Sequence
  targeting sequence with ATCN PAM
gcaguucucuggaauuaugc

SEQ ID NO: 2309 - RNA, 20 nt, Artificial Sequence
  targeting sequence with ATCN PAM
uuagugggugccuuuuggau

SEQ ID NO: 2310 - RNA, 20 nt, Artificial Sequence
  targeting sequence with ATCN PAM
aaaaggcacccacuaaggau

SEQ ID NO: 2311 - RNA, 20 nt, Artificial Sequence
  targeting sequence with ATCN PAM
ccccuauccaaaaggcaccc

SEQ ID NO: 2312 - RNA, 20 nt, Artificial Sequence
  targeting sequence with ATCN PAM
auggcacucagcaggugcau

SEQ ID NO: 2313 - RNA, 20 nt, Artificial Sequence
  targeting sequence with ATCN PAM
uuuuuauuggucauggugau

SEQ ID NO: 2314 - RNA, 20 nt, Artificial Sequence
  targeting sequence with ATCN PAM
ccaugaccaauaaaaacgau

SEQ ID NO: 2315 - RNA, 20 nt, Artificial Sequence
  targeting sequence with ATCN PAM
uggggccuagaauggauaug

SEQ ID NO: 2316 - RNA, 20 nt, Artificial Sequence
  targeting sequence with ATCN PAM
auucuaggccccaggauauc

SEQ ID NO: 2317 - RNA, 20 nt, Artificial Sequence
  targeting sequence with ATCN PAM
cugcaaaaaaaaaacaaaca

SEQ ID NO: 2318 - RNA, 20 nt, Artificial Sequence
  targeting sequence with ATCN PAM
cuugagcccaggaguuguag

SEQ ID NO: 2319 - RNA, 20 nt, Artificial Sequence
  targeting sequence with ATCN PAM
uccucuuuugaccucccaaa

SEQ ID NO: 2320 - RNA, 20 nt, Artificial Sequence
  targeting sequence with ATCN PAM
cuacacuuugggaggucaaa

SEQ ID NO: 2321 - RNA, 20 nt, Artificial Sequence
  targeting sequence with ATCN PAM
cagguguaagccaccauguc

SEQ ID NO: 2322 - RNA, 20 nt, Artificial Sequence
  targeting sequence with ATCN PAM
aucuuuuaucucacggcaag

SEQ ID NO: 2323 - RNA, 20 nt, Artificial Sequence
  targeting sequence with ATCN PAM
uuuaucucacggcaagauuu

SEQ ID NO: 2324 - RNA, 20 nt, Artificial Sequence
  targeting sequence with ATCN PAM
cacggcaagauuucaauuca

SEQ ID NO: 2325 - RNA, 20 nt, Artificial Sequence
  targeting sequence with ATCN PAM
ugccgugagauaaaagauug

SEQ ID NO: 2326 - RNA, 20 nt, Artificial Sequence
  targeting sequence with ATCN PAM
aacaaacuaacuccuaauag

SEQ ID NO: 2327 - RNA, 20 nt, Artificial Sequence
  targeting sequence with ATCN PAM
uucuaaaaaccugcacacag

SEQ ID NO: 2328 - RNA, 20 nt, Artificial Sequence
  targeting sequence with ATCN PAM
aacucuuagacaagcuggug

SEQ ID NO: 2329 - RNA, 20 nt, Artificial Sequence
  targeting sequence with ATCN PAM
uccuccaauaugcugcucuu

SEQ ID NO: 2330 - RNA, 20 nt, Artificial Sequence
  targeting sequence with ATCN PAM
uagcugugcuaagugugugu

SEQ ID NO: 2331 - RNA, 20 nt, Artificial Sequence
  targeting sequence with ATCN PAM
cuugcuucaaaagacuacau

SEQ ID NO: 2332 - RNA, 20 nt, Artificial Sequence
  targeting sequence with ATCN PAM
cacaauguagucuuuugaag

SEQ ID NO: 2333 - RNA, 20 nt, Artificial Sequence
  targeting sequence with ATCN PAM
ggagucagacagaacugcgu

SEQ ID NO: 2334 - RNA, 20 nt, Artificial Sequence
  targeting sequence with ATCN PAM
acuagguucuggguauauac

SEQ ID NO: 2335 - RNA, 20 nt, Artificial Sequence
  targeting sequence with ATCN PAM
cgcaugcugaacauccacua

SEQ ID NO: 2336 - RNA, 20 nt, Artificial Sequence
  targeting sequence with ATCN PAM
cuacuucuaaagagaaggua

SEQ ID NO: 2337 - RNA, 20 nt, Artificial Sequence
  targeting sequence with ATCN PAM
uaagacuugucauccuauuu

SEQ ID NO: 2338 - RNA, 20 nt, Artificial Sequence
  targeting sequence with ATCN PAM
uauuuuauuggucucccucu

SEQ ID NO: 2339 - RNA, 20 nt, Artificial Sequence
  targeting sequence with ATCN PAM
ccaugagccacaacucugcc

SEQ ID NO: 2340 - RNA, 20 nt, Artificial Sequence
  targeting sequence with ATCN PAM
gcaggccccguuuggcagag

SEQ ID NO: 2341 - RNA, 20 nt, Artificial Sequence
  targeting sequence with ATCN PAM
cccaaauccgcaggccccgu

SEQ ID NO: 2342 - RNA, 20 nt, Artificial Sequence
  targeting sequence with ATCN PAM
ugggagcuuaggggucaugg

SEQ ID NO: 2343 - RNA, 20 nt, Artificial Sequence
  targeting sequence with ATCN PAM
augaccccuaagcucccaag

SEQ ID NO: 2344 - RNA, 20 nt, Artificial Sequence
  targeting sequence with ATCN PAM
uuuuuugaucuuugcuuguc

SEQ ID NO: 2345 - RNA, 20 nt, Artificial Sequence
  targeting sequence with ATCN PAM
aaaaaagaugcaaaccuuug

SEQ ID NO: 2346 - RNA, 20 nt, Artificial Sequence
  targeting sequence with ATCN PAM
uugcuugucugguaaaagcc

SEQ ID NO: 2347 - RNA, 20 nt, Artificial Sequence
  targeting sequence with ATCN PAM
aaccuuuguaaaggcugcuu

SEQ ID NO: 2348 - RNA, 20 nt, Artificial Sequence
  targeting sequence with ATCN PAM
gccagaaacaggucauuguu

SEQ ID NO: 2349 - RNA, 20 nt, Artificial Sequence
  targeting sequence with ATCN PAM
uuucugagaccauugcuagu

SEQ ID NO: 2350 - RNA, 20 nt, Artificial Sequence
  targeting sequence with ATCN PAM
acagccacugguugaaacuc

SEQ ID NO: 2351 - RNA, 20 nt, Artificial Sequence
  targeting sequence with ATCN PAM
gugacagggcuggauggcug

SEQ ID NO: 2352 - RNA, 20 nt, Artificial Sequence
  targeting sequence with ATCN PAM
agcccugucacugaugaagg

SEQ ID NO: 2353 - RNA, 20 nt, Artificial Sequence
  targeting sequence with ATCN PAM
cuucauugaguugagggcuc

SEQ ID NO: 2354 - RNA, 20 nt, Artificial Sequence
  targeting sequence with ATCN PAM
ucucaauccuugucaggagc

SEQ ID NO: 2355 - RNA, 20 nt, Artificial Sequence
  targeting sequence with ATCN PAM
uugucaggagccgccaagaa

SEQ ID NO: 2356 - RNA, 20 nt, Artificial Sequence
  targeting sequence with ATCN PAM
gugucuucaggcaggagccg

SEQ ID NO: 2357 - RNA, 20 nt, Artificial Sequence
  targeting sequence with ATCN PAM
gcaggaccggcuccugccug

SEQ ID NO: 2358 - RNA, 20 nt, Artificial Sequence
  targeting sequence with ATCN PAM
ugcaggacgacauggugccu

SEQ ID NO: 2359 - RNA, 20 nt, Artificial Sequence
  targeting sequence with ATCN PAM
gcaggugcuaugggaaacuu

SEQ ID NO: 2360 - RNA, 20 nt, Artificial Sequence
  targeting sequence with ATCN PAM
cccacugcaaccacauggua

SEQ ID NO: 2361 - RNA, 20 nt, Artificial Sequence
  targeting sequence with ATCN PAM
cugccaucacccacugcaac

SEQ ID NO: 2362 - RNA, 20 nt, Artificial Sequence
  targeting sequence with ATCN PAM
ggagccugguccaggaagcu

SEQ ID NO: 2363 - RNA, 20 nt, Artificial Sequence
  targeting sequence with ATCN PAM
aggggcuuuguuaaccugcc

SEQ ID NO: 2364 - RNA, 20 nt, Artificial Sequence
  targeting sequence with ATCN PAM
gccauaaccuauuggugggc

SEQ ID NO: 2365 - RNA, 20 nt, Artificial Sequence
  targeting sequence with ATCN PAM
ugaacuugugagcuggagaa

SEQ ID NO: 2366 - RNA, 20 nt, Artificial Sequence
  targeting sequence with ATCN PAM
uccccacuuuuuucugcuuu

SEQ ID NO: 2367 - RNA, 20 nt, Artificial Sequence
  targeting sequence with ATCN PAM
ucaggaauagaaaagcagaa

SEQ ID NO: 2368 - RNA, 20 nt, Artificial Sequence
  targeting sequence with ATCN PAM
caggccaccaaacacaccuu

SEQ ID NO: 2369 - RNA, 20 nt, Artificial Sequence
  targeting sequence with ATCN PAM
ggacuuggacgagcuccugg

SEQ ID NO: 2370 - RNA, 20 nt, Artificial Sequence
  targeting sequence with ATCN PAM
cuaaggugaaaagacaggcu

SEQ ID NO: 2371 - RNA, 20 nt, Artificial Sequence
  targeting sequence with ATCN PAM
ucuaggugucuuuggugggg

SEQ ID NO: 2372 - RNA, 20 nt, Artificial Sequence
  targeting sequence with ATCN PAM
caguaugaauguguuaugaa

SEQ ID NO: 2373 - RNA, 20 nt, Artificial Sequence
  targeting sequence with ATCN PAM
ccagagucagugcaucucug

SEQ ID NO: 2374 - RNA, 20 nt, Artificial Sequence
  targeting sequence with ATCN PAM
cugcuuccggggauaacaaa

SEQ ID NO: 2375 - RNA, 20 nt, Artificial Sequence
  targeting sequence with ATCN PAM
ccggaagcagagaugcacug

SEQ ID NO: 2376 - RNA, 20 nt, Artificial Sequence
  targeting sequence with ATCN PAM
ugaguuaaaauuuuguuauc

SEQ ID NO: 2377 - RNA, 20 nt, Artificial Sequence
  targeting sequence with ATCN PAM
cuuaaggguucauccugagu

SEQ ID NO: 2378 - RNA, 20 nt, Artificial Sequence
  targeting sequence with ATCN PAM
agacccuagagguagaauuu

SEQ ID NO: 2379 - RNA, 20 nt, Artificial Sequence
  targeting sequence with ATCN PAM
acccacuucagccucccaaa

SEQ ID NO: 2380 - RNA, 20 nt, Artificial Sequence
  targeting sequence with ATCN PAM
uuccaccuuagccucccagu

SEQ ID NO: 2381 - RNA, 20 nt, Artificial Sequence
  targeting sequence with ATCN PAM
uggcucacugcaacuuccac

SEQ ID NO: 2382 - RNA, 20 nt, Artificial Sequence
  targeting sequence with ATCN PAM
cgccacugcauuccagccug

SEQ ID NO: 2383 - RNA, 20 nt, Artificial Sequence
  targeting sequence with ATCN PAM
cacagaaagaaacugcacuc

SEQ ID NO: 2384 - RNA, 20 nt, Artificial Sequence
  targeting sequence with ATCN PAM
gagaagggaagggagguuug

SEQ ID NO: 2385 - RNA, 20 nt, Artificial Sequence
  targeting sequence with ATCN PAM
caugacuaaacugagcuguc

SEQ ID NO: 2386 - RNA, 20 nt, Artificial Sequence
  targeting sequence with ATCN PAM
uucuacagguuggcauuucu

SEQ ID NO: 2387 - RNA, 20 nt, Artificial Sequence
  targeting sequence with ATCN PAM
uccuaaucuuucuacagguu

SEQ ID NO: 2388 - RNA, 20 nt, Artificial Sequence
  targeting sequence with ATCN PAM
acucuguggucacguguggc

SEQ ID NO: 2389 - RNA, 20 nt, Artificial Sequence
  targeting sequence with ATCN PAM
aaaacuaaaaccaaaaacaa

SEQ ID NO: 2390 - RNA, 20 nt, Artificial Sequence
  targeting sequence with ATCN PAM
cuauuccaaggagguugguu

SEQ ID NO: 2391 - RNA, 20 nt, Artificial Sequence
  targeting sequence with ATCN PAM
ccccugcccccaccugguag

SEQ ID NO: 2392 - RNA, 20 nt, Artificial Sequence
  targeting sequence with ATCN PAM
cccccaccccccacauaaug

SEQ ID NO: 2393 - RNA, 20 nt, Artificial Sequence
  targeting sequence with ATCN PAM
aguccugauuaacguggcau

SEQ ID NO: 2394 - RNA, 20 nt, Artificial Sequence
  targeting sequence with ATCN PAM
ggacuagaucucccccaccc

SEQ ID NO: 2395 - RNA, 20 nt, Artificial Sequence
  targeting sequence with ATCN PAM
ugggaagcaauuuucaagua

SEQ ID NO: 2396 - RNA, 20 nt, Artificial Sequence
  targeting sequence with ATCN PAM
gguuuucagaaaauuuuaaa

SEQ ID NO: 2397 - RNA, 20 nt, Artificial Sequence
  targeting sequence with ATCN PAM
agaaagcauacaauuuauuu

SEQ ID NO: 2398 - RNA, 20 nt, Artificial Sequence
  targeting sequence with ATCN PAM
ccauauaaacaugucacuua

SEQ ID NO: 2399 - RNA, 20 nt, Artificial Sequence
  targeting sequence with ATCN PAM
aaaucaccaagcaugagaac

SEQ ID NO: 2400 - RNA, 20 nt, Artificial Sequence
  targeting sequence with ATCN PAM
ccaagcaugagaacacuguu

SEQ ID NO: 2401 - RNA, 20 nt, Artificial Sequence
  targeting sequence with ATCN PAM
cucagcacagccucuuucug

SEQ ID NO: 2402 - RNA, 20 nt, Artificial Sequence
  targeting sequence with ATCN PAM
ggggccauggcaaagacuug

SEQ ID NO: 2403 - RNA, 20 nt, Artificial Sequence
  targeting sequence with ATCN PAM
uaggagacuagaaauguccu

SEQ ID NO: 2404 - RNA, 20 nt, Artificial Sequence
  targeting sequence with ATCN PAM
gcgccauagcagcugccaga

SEQ ID NO: 2405 - RNA, 20 nt, Artificial Sequence
  targeting sequence with ATCN PAM
ggguauacaaugcgcuuucc

SEQ ID NO: 2406 - RNA, 20 nt, Artificial Sequence
  targeting sequence with ATCN PAM
uauauuaggccgaccuaaua

SEQ ID NO: 2407 - RNA, 20 nt, Artificial Sequence
  targeting sequence with ATCN PAM
acuugaacaauuagcucgcu

SEQ ID NO: 2408 - RNA, 20 nt, Artificial Sequence
  targeting sequence with ATCN PAM
uggggaaaggagugcuuuuu

SEQ ID NO: 2409 - RNA, 20 nt, Artificial Sequence
  targeting sequence with ATCN PAM
ggccuagggccuguguuccu

SEQ ID NO: 2410 - RNA, 20 nt, Artificial Sequence
  targeting sequence with ATCN PAM
cugagccuccaggaccacag

SEQ ID NO: 2411 - RNA, 20 nt, Artificial Sequence
  targeting sequence with ATCN PAM
cuuccuucucagguccucuc

SEQ ID NO: 2412 - RNA, 20 nt, Artificial Sequence
  targeting sequence with ATCN PAM
gaggcagggaaggugcucag

SEQ ID NO: 2413 - RNA, 20 nt, Artificial Sequence
  targeting sequence with ATCN PAM
gacagugggacagcaggagg

SEQ ID NO: 2414 - RNA, 20 nt, Artificial Sequence
  targeting sequence with ATCN PAM
gguucucaccccugcagacc

SEQ ID NO: 2415 - RNA, 20 nt, Artificial Sequence
  targeting sequence with ATCN PAM
ugugcugaggucaggucugc

SEQ ID NO: 2416 - RNA, 20 nt, Artificial Sequence
  targeting sequence with ATCN PAM
cuaaccauucagcugagaag

SEQ ID NO: 2417 - RNA, 20 nt, Artificial Sequence
  targeting sequence with ATCN PAM
cucugguuaguugcuucuca

SEQ ID NO: 2418 - RNA, 20 nt, Artificial Sequence
  targeting sequence with ATCN PAM
guuccaggaaaguaacuggg

SEQ ID NO: 2419 - RNA, 20 nt, Artificial Sequence
  targeting sequence with ATCN PAM
cauugucuuugccccaguua

SEQ ID NO: 2420 - RNA, 20 nt, Artificial Sequence
  targeting sequence with ATCN PAM
ucacauugucuuugccccag

SEQ ID NO: 2421 - RNA, 20 nt, Artificial Sequence
  targeting sequence with ATCN PAM
cccauaugaucugaauaaga

SEQ ID NO: 2422 - RNA, 20 nt, Artificial Sequence
  targeting sequence with ATCN PAM
uaugggugauaccacaugcu

SEQ ID NO: 2423 - RNA, 20 nt, Artificial Sequence
  targeting sequence with ATCN PAM
gaauaagaugacaggucucg

SEQ ID NO: 2424 - RNA, 20 nt, Artificial Sequence
  targeting sequence with ATCN PAM
uauucagaucauauggguga

SEQ ID NO: 2425 - RNA, 20 nt, Artificial Sequence
  targeting sequence with ATCN PAM
agaccugucaucuuauucag

SEQ ID NO: 2426 - RNA, 20 nt, Artificial Sequence
  targeting sequence with ATCN PAM
ggcugucucucucucacaua

SEQ ID NO: 2427 - RNA, 20 nt, Artificial Sequence
  targeting sequence with ATCN PAM
ugaacccccgacccugcaga

SEQ ID NO: 2428 - RNA, 20 nt, Artificial Sequence
  targeting sequence with ATCN PAM
gcuaaacaacacuuucuaga

SEQ ID NO: 2429 - RNA, 20 nt, Artificial Sequence
  targeting sequence with ATCN PAM
gggacgcuggcccccagugc

SEQ ID NO: 2430 - RNA, 20 nt, Artificial Sequence
  targeting sequence with ATCN PAM
ugggacagcaucagggacgc

SEQ ID NO: 2431 - RNA, 20 nt, Artificial Sequence
  targeting sequence with ATCN PAM
cccaggaacaccugcagggc

SEQ ID NO: 2432 - RNA, 20 nt, Artificial Sequence
  targeting sequence with ATCN PAM
caggcugcccugcagguguu

SEQ ID NO: 2433 - RNA, 20 nt, Artificial Sequence
  targeting sequence with ATCN PAM
cucuucccgagaccugggac

SEQ ID NO: 2434 - RNA, 20 nt, Artificial Sequence
  targeting sequence with ATCN PAM
ggcuuuucuagcagcaaggg

SEQ ID NO: 2435 - RNA, 20 nt, Artificial Sequence
  targeting sequence with ATCN PAM
gaacuuccugugccagcguu

SEQ ID NO: 2436 - RNA, 20 nt, Artificial Sequence
  targeting sequence with ATCN PAM
agaguguuuuuguuuguugu

SEQ ID NO: 2437 - RNA, 20 nt, Artificial Sequence
  targeting sequence with ATCN PAM
ugaggaagcacaacaaacaa

SEQ ID NO: 2438 - RNA, 20 nt, Artificial Sequence
  targeting sequence with ATCN PAM
aaggaaauccugaggaagca

SEQ ID NO: 2439 - RNA, 20 nt, Artificial Sequence
  targeting sequence with ATCN PAM
ggagaccccaaagaaacaaa

SEQ ID NO: 2440 - RNA, 20 nt, Artificial Sequence
  targeting sequence with ATCN PAM
uuguuucuuuggggucucca

SEQ ID NO: 2441 - RNA, 20 nt, Artificial Sequence
  targeting sequence with ATCN PAM
ccaaacaggcugacugggcc

SEQ ID NO: 2442 - RNA, 20 nt, Artificial Sequence
  targeting sequence with ATCN PAM
aggagcccaaagccgccgug

SEQ ID NO: 2443 - RNA, 20 nt, Artificial Sequence
  targeting sequence with ATCN PAM
ccacggcggcuuugggcucc

SEQ ID NO: 2444 - RNA, 20 nt, Artificial Sequence
  targeting sequence with ATCN PAM
cagcaggagagcacgucaag

SEQ ID NO: 2445 - RNA, 20 nt, Artificial Sequence
  targeting sequence with ATCN PAM
agaucuguggugaccauggc

SEQ ID NO: 2446 - RNA, 20 nt, Artificial Sequence
  targeting sequence with ATCN PAM
cgauggccuugacgugcucu

SEQ ID NO: 2447 - RNA, 20 nt, Artificial Sequence
  targeting sequence with ATCN PAM
guggugaccauggcuggguu

SEQ ID NO: 2448 - RNA, 20 nt, Artificial Sequence
  targeting sequence with ATCN PAM
caugucaccucuugacugac

SEQ ID NO: 2449 - RNA, 20 nt, Artificial Sequence
  targeting sequence with ATCN PAM
aaagcuaaugugauaguggc

SEQ ID NO: 2450 - RNA, 20 nt, Artificial Sequence
  targeting sequence with ATCN PAM
cauuagcuuuagauaauuag

SEQ ID NO: 2451 - RNA, 20 nt, Artificial Sequence
  targeting sequence with ATCN PAM
cugugucuccugaagaaccu

SEQ ID NO: 2452 - RNA, 20 nt, Artificial Sequence
  targeting sequence with ATCN PAM
cuuccccuagugacuccaca

SEQ ID NO: 2453 - RNA, 20 nt, Artificial Sequence
  targeting sequence with ATCN PAM
cagcugccauuugcugagcg

SEQ ID NO: 2454 - RNA, 20 nt, Artificial Sequence
  targeting sequence with ATCN PAM
cagcgucuggguuguaguga

SEQ ID NO: 2455 - RNA, 20 nt, Artificial Sequence
  targeting sequence with ATCN PAM
gggcuggugucuccucgccc

SEQ ID NO: 2456 - RNA, 20 nt, Artificial Sequence
  targeting sequence with ATCN PAM
gcaaggugggcgaggagaca

SEQ ID NO: 2457 - RNA, 20 nt, Artificial Sequence
  targeting sequence with ATCN PAM
ucugcaaggugggcgaggag

SEQ ID NO: 2458 - RNA, 20 nt, Artificial Sequence
  targeting sequence with ATCN PAM
ggacuuugggaauaacuugu

SEQ ID NO: 2459 - RNA, 20 nt, Artificial Sequence
  targeting sequence with ATCN PAM
gaggcuaaagcucagcucua

SEQ ID NO: 2460 - RNA, 20 nt, Artificial Sequence
  targeting sequence with ATCN PAM
gcuggaugucgaugccaacu

SEQ ID NO: 2461 - RNA, 20 nt, Artificial Sequence
  targeting sequence with ATCN PAM
agcagaucagaggcuaaagc

SEQ ID NO: 2462 - RNA, 20 nt, Artificial Sequence
  targeting sequence with ATCN PAM
acauccagcagaucagaggc

SEQ ID NO: 2463 - RNA, 20 nt, Artificial Sequence
  targeting sequence with ATCN PAM
aucagggaagaauucuuaug

SEQ ID NO: 2464 - RNA, 20 nt, Artificial Sequence
  targeting sequence with ATCN PAM
gggaagaauucuuaugggag

SEQ ID NO: 2465 - RNA, 20 nt, Artificial Sequence
  targeting sequence with ATCN PAM
augguuccucccauaagaau

SEQ ID NO: 2466 - RNA, 20 nt, Artificial Sequence
  targeting sequence with ATCN PAM
ucucuuaggagacacucuuu

SEQ ID NO: 2467 - RNA, 20 nt, Artificial Sequence
  targeting sequence with ATCN PAM
cuauuuaccucuuggaauuc

SEQ ID NO: 2468 - RNA, 20 nt, Artificial Sequence
  targeting sequence with ATCN PAM
uuucccgccaucucuauuua

SEQ ID NO: 2469 - RNA, 20 nt, Artificial Sequence
  targeting sequence with ATCN PAM
gaggcccuuccaguguggcc

SEQ ID NO: 2470 - RNA, 20 nt, Artificial Sequence
  targeting sequence with ATCN PAM
aagcaccuccguuuggcauc

SEQ ID NO: 2471 - RNA, 20 nt, Artificial Sequence
  targeting sequence with ATCN PAM
ggucuccauucuaccugccu

SEQ ID NO: 2472 - RNA, 20 nt, Artificial Sequence
  targeting sequence with ATCN PAM
caggguguuggggcaguggu

SEQ ID NO: 2473 - RNA, 20 nt, Artificial Sequence
  targeting sequence with ATCN PAM
ugucucagugcugccccacc

SEQ ID NO: 2474 - RNA, 20 nt, Artificial Sequence
  targeting sequence with ATCN PAM
auccugucucagugcugccc

SEQ ID NO: 2475 - RNA, 20 nt, Artificial Sequence
  targeting sequence with ATCN PAM
uguccuuugccuaccgcagc

SEQ ID NO: 2476 - RNA, 20 nt, Artificial Sequence
  targeting sequence with ATCN PAM
acagccuuuaggacccagcc

SEQ ID NO: 2477 - RNA, 20 nt, Artificial Sequence
  targeting sequence with ATCN PAM
uggcugggccacugcuaccu

SEQ ID NO: 2478 - RNA, 20 nt, Artificial Sequence
  targeting sequence with ATCN PAM
ccaaauccuggcugggccac

SEQ ID NO: 2479 - RNA, 20 nt, Artificial Sequence
  targeting sequence with ATCN PAM
uuaaccagccucuuccauau

SEQ ID NO: 2480 - RNA, 20 nt, Artificial Sequence
  targeting sequence with ATCN PAM
aggucccuuugugaggggcc

SEQ ID NO: 2481 - RNA, 20 nt, Artificial Sequence
  targeting sequence with ATCN PAM
aucaaggucccuuugugagg

SEQ ID NO: 2482 - RNA, 20 nt, Artificial Sequence
  targeting sequence with ATCN PAM
uuuucuuguccgauaguaau

SEQ ID NO: 2483 - RNA, 20 nt, Artificial Sequence
  targeting sequence with ATCN PAM
gacaagaaaaagauggggug

SEQ ID NO: 2484 - RNA, 20 nt, Artificial Sequence
  targeting sequence with ATCN PAM
gugccucugucuuuaaaaaa

SEQ ID NO: 2485 - RNA, 20 nt, Artificial Sequence
  targeting sequence with ATCN PAM
gccuggcucucuucuauaug

SEQ ID NO: 2486 - RNA, 20 nt, Artificial Sequence
  targeting sequence with ATCN PAM
gguuacccugaggguacuug

SEQ ID NO: 2487 - RNA, 20 nt, Artificial Sequence
  targeting sequence with ATCN PAM
ggaaagcaagcagaacaugc

SEQ ID NO: 2488 - RNA, 20 nt, Artificial Sequence
  targeting sequence with ATCN PAM
cacccaacgucccuggagga

SEQ ID NO: 2489 - RNA, 20 nt, Artificial Sequence
  targeting sequence with ATCN PAM
aaaaauaacacugcucagca

SEQ ID NO: 2490 - RNA, 20 nt, Artificial Sequence
  targeting sequence with ATCN PAM
cugucuggagacaggcaagg

SEQ ID NO: 2491 - RNA, 20 nt, Artificial Sequence
  targeting sequence with ATCN PAM
aggccucauguccccaugag

SEQ ID NO: 2492 - RNA, 20 nt, Artificial Sequence
  targeting sequence with ATCN PAM
cucauggggacaugaggccu

SEQ ID NO: 2493 - RNA, 20 nt, Artificial Sequence
  targeting sequence with ATCN PAM
acuuuuccgugagaauuccu

SEQ ID NO: 2494 - RNA, 20 nt, Artificial Sequence
  targeting sequence with ATCN PAM
gagagauggaaauaaucaug

SEQ ID NO: 2495 - RNA, 20 nt, Artificial Sequence
  targeting sequence with ATCN PAM
cucagaugagaagaauaaag

SEQ ID NO: 2496 - RNA, 20 nt, Artificial Sequence
  targeting sequence with ATCN PAM
ugcccaccucuuaggguggu

SEQ ID NO: 2497 - RNA, 20 nt, Artificial Sequence
  targeting sequence with ATCN PAM
ucaccacccuaagagguggg

SEQ ID NO: 2498 - RNA, 20 nt, Artificial Sequence
  targeting sequence with ATCN PAM
gaaucuucaccacccuaaga

SEQ ID NO: 2499 - RNA, 20 nt, Artificial Sequence
  targeting sequence with ATCN PAM
ggguaccugguaggggauua

SEQ ID NO: 2500 - RNA, 20 nt, Artificial Sequence
  targeting sequence with ATCN PAM
accuggagagggaaggggca

SEQ ID NO: 2501 - RNA, 20 nt, Artificial Sequence
  targeting sequence with ATCN PAM
acaucgcccgcaaacuggac

SEQ ID NO: 2502 - RNA, 20 nt, Artificial Sequence
  targeting sequence with ATCN PAM
cccgcaaacuggacaaggcu

SEQ ID NO: 2503 - RNA, 20 nt, Artificial Sequence
  targeting sequence with ATCN PAM
ucagguaggucucagcagca

SEQ ID NO: 2504 - RNA, 20 nt, Artificial Sequence
  targeting sequence with ATCN PAM
cagcgcugggucuccacgug

SEQ ID NO: 2505 - RNA, 20 nt, Artificial Sequence
  targeting sequence with ATCN PAM
gaaccccaaagggccccugu

SEQ ID NO: 2506 - RNA, 20 nt, Artificial Sequence
  targeting sequence with ATCN PAM
cgagggcagcuucucuccau

SEQ ID NO: 2507 - RNA, 20 nt, Artificial Sequence
  targeting sequence with ATCN PAM
uggagggccuuuccacuugu

SEQ ID NO: 2508 - RNA, 20 nt, Artificial Sequence
  targeting sequence with ATCN PAM
uuacugacagccagcucugc

SEQ ID NO: 2509 - RNA, 20 nt, Artificial Sequence
  targeting sequence with ATCN PAM
ccggugccugucaccacccu

SEQ ID NO: 2510 - RNA, 20 nt, Artificial Sequence
  targeting sequence with ATCN PAM
gccaugugucugagccugug

SEQ ID NO: 2511 - RNA, 20 nt, Artificial Sequence
  targeting sequence with ATCN PAM
ccacaucagccaugugucug

SEQ ID NO: 2512 - RNA, 20 nt, Artificial Sequence
  targeting sequence with ATCN PAM
gugcuuuccagauccagacu

SEQ ID NO: 2513 - RNA, 20 nt, Artificial Sequence
  targeting sequence with ATCN PAM
ggaaagcacagauggugcuu

SEQ ID NO: 2514 - RNA, 20 nt, Artificial Sequence
  targeting sequence with ATCN PAM
agacugugagagccauuuca

SEQ ID NO: 2515 - RNA, 20 nt, Artificial Sequence
  targeting sequence with ATCN PAM
gcugcuucugccagccugag

SEQ ID NO: 2516 - RNA, 20 nt, Artificial Sequence
  targeting sequence with ATCN PAM
auccccgagaggauuaggag

SEQ ID NO: 2517 - RNA, 20 nt, Artificial Sequence
  targeting sequence with ATCN PAM
ccgagaggauuaggagcugu

SEQ ID NO: 2518 - RNA, 20 nt, Artificial Sequence
  targeting sequence with ATCN PAM
ucucggggauggauuucucu

SEQ ID NO: 2519 - RNA, 20 nt, Artificial Sequence
  targeting sequence with ATCN PAM
uggcacagcuccuaauccuc

SEQ ID NO: 2520 - RNA, 20 nt, Artificial Sequence
  targeting sequence with ATCN PAM
ucccccgacucacccaccca

SEQ ID NO: 2521 - RNA, 20 nt, Artificial Sequence
  targeting sequence with ATCN PAM
ugguccauuuuagagugaaa

SEQ ID NO: 2522 - RNA, 20 nt, Artificial Sequence
  targeting sequence with ATCN PAM
ccucaccaauggagcuguuc

SEQ ID NO: 2523 - RNA, 20 nt, Artificial Sequence
  targeting sequence with ATCN PAM
aauaaauuucucuugagaag

SEQ ID NO: 2524 - RNA, 20 nt, Artificial Sequence
  targeting sequence with ATCN PAM
augcugcuugggaaaucuaa

SEQ ID NO: 2525 - RNA, 20 nt, Artificial Sequence
  targeting sequence with ATCN PAM
uagaaugacucagaccucgc

SEQ ID NO: 2526 - RNA, 20 nt, Artificial Sequence
  targeting sequence with ATCN PAM
ggcagacuuucucaccaugg

SEQ ID NO: 2527 - RNA, 20 nt, Artificial Sequence
  targeting sequence with ATCN PAM
uugacaacugauaagaagug

SEQ ID NO: 2528 - RNA, 20 nt, Artificial Sequence
  targeting sequence with ATCN PAM
guugucaaagaugacugugg

SEQ ID NO: 2529 - RNA, 20 nt, Artificial Sequence
  targeting sequence with ATCN PAM
ccacuucuuaucaguuguca

SEQ ID NO: 2530 - RNA, 20 nt, Artificial Sequence
  targeting sequence with ATCN PAM
ucaccacuucuuaucaguug

SEQ ID NO: 2531 - RNA, 20 nt, Artificial Sequence
  targeting sequence with ATCN PAM
ucaucaccacuucuuaucag

SEQ ID NO: 2532 - RNA, 20 nt, Artificial Sequence
  targeting sequence with ATCN PAM
guuugcagcacuacaggagc

SEQ ID NO: 2533 - RNA, 20 nt, Artificial Sequence
  targeting sequence with ATCN PAM
gaaacauuuuauuuugaggg

SEQ ID NO: 2534 - RNA, 20 nt, Artificial Sequence
  targeting sequence with ATCN PAM
agucgcuugcauauugcugu

SEQ ID NO: 2535 - RNA, 20 nt, Artificial Sequence
  targeting sequence with ATCN PAM
gcucuucgaaaacaaaaggc

SEQ ID NO: 2536 - RNA, 20 nt, Artificial Sequence
  targeting sequence with ATCN PAM
uauuuugccagccugacaac

SEQ ID NO: 2537 - RNA, 20 nt, Artificial Sequence
  targeting sequence with ATCN PAM
auuagggacaucauauuuug

SEQ ID NO: 2538 - RNA, 20 nt, Artificial Sequence
  targeting sequence with ATCN PAM
ugaguuuaaggaugacaucu

SEQ ID NO: 2539 - RNA, 20 nt, Artificial Sequence
  targeting sequence with ATCN PAM
uuaaacucaggaugcuucuc

SEQ ID NO: 2540 - RNA, 20 nt, Artificial Sequence
  targeting sequence with ATCN PAM
acaugccguaugcucagugg

SEQ ID NO: 2541 - RNA, 20 nt, Artificial Sequence
  targeting sequence with ATCN PAM
uucucugcuagccacugagc

SEQ ID NO: 2542 - RNA, 20 nt, Artificial Sequence
  targeting sequence with ATCN PAM
cuuugaggaagcccagaaag

SEQ ID NO: 2543 - RNA, 20 nt, Artificial Sequence
  targeting sequence with ATCN PAM
ucccguuuaauccucgcaac

SEQ ID NO: 2544 - RNA, 20 nt, Artificial Sequence
  targeting sequence with ATCN PAM
ucgcaacagcccuaugguau

SEQ ID NO: 2545 - RNA, 20 nt, Artificial Sequence
  targeting sequence with ATCN PAM
uuaugauucccauuuugcag

SEQ ID NO: 2546 - RNA, 20 nt, Artificial Sequence
  targeting sequence with ATCN PAM
uaaugaugguagcuauacca

SEQ ID NO: 2547 - RNA, 20 nt, Artificial Sequence
  targeting sequence with ATCN PAM
gcaaaaugggaaucauaaug

SEQ ID NO: 2548 - RNA, 20 nt, Artificial Sequence
  targeting sequence with ATCN PAM
ucccuuauuguccucauggu

SEQ ID NO: 2549 - RNA, 20 nt, Artificial Sequence
  targeting sequence with ATCN PAM
gagccagaaauagaagcuga

SEQ ID NO: 2550 - RNA, 20 nt, Artificial Sequence
  targeting sequence with ATCN PAM
gaaauaggaguuaaagcaag

SEQ ID NO: 2551 - RNA, 20 nt, Artificial Sequence
  targeting sequence with ATCN PAM
gcgaaaguucuauacuugcu

SEQ ID NO: 2552 - RNA, 20 nt, Artificial Sequence
  targeting sequence with ATCN PAM
uauuuuuuaaaguugacuuc

SEQ ID NO: 2553 - RNA, 20 nt, Artificial Sequence
  targeting sequence with ATCN PAM
ugccaacagcugugcaagga

SEQ ID NO: 2554 - RNA, 20 nt, Artificial Sequence
  targeting sequence with ATCN PAM
agucagcagcagagccagaa

SEQ ID NO: 2555 - RNA, 20 nt, Artificial Sequence
  targeting sequence with ATCN PAM
gguuccccagucagagaggu

SEQ ID NO: 2556 - RNA, 20 nt, Artificial Sequence
  targeting sequence with ATCN PAM
aacacccaacuuccauuaga

SEQ ID NO: 2557 - RNA, 20 nt, Artificial Sequence
  targeting sequence with ATCN PAM
gauuuacgcuucuauauggu

SEQ ID NO: 2558 - RNA, 20 nt, Artificial Sequence
  targeting sequence with ATCN PAM
gaugcuauggaacaucaaac

SEQ ID NO: 2559 - RNA, 20 nt, Artificial Sequence
  targeting sequence with ATCN PAM
gcauguuugggcaaaacaca

SEQ ID NO: 2560 - RNA, 20 nt, Artificial Sequence
  targeting sequence with ATCN PAM
accuauccaucugucugugu

SEQ ID NO: 2561 - RNA, 20 nt, Artificial Sequence
  targeting sequence with ATCN PAM
aucugucugugucugcccuu

SEQ ID NO: 2562 - RNA, 20 nt, Artificial Sequence
  targeting sequence with ATCN PAM
gucugugucugcccuuccaa

SEQ ID NO: 2563 - RNA, 20 nt, Artificial Sequence
  targeting sequence with ATCN PAM
aucaccauaguaacuuggua

SEQ ID NO: 2564 - RNA, 20 nt, Artificial Sequence
  targeting sequence with ATCN PAM
ccauaguaacuugguacuca

SEQ ID NO: 2565 - RNA, 20 nt, Artificial Sequence
  targeting sequence with ATCN PAM
acaaccucuugucugaguac

SEQ ID NO: 2566 - RNA, 20 nt, Artificial Sequence
  targeting sequence with ATCN PAM
uccgccuucagagaaggaga

SEQ ID NO: 2567 - RNA, 20 nt, Artificial Sequence
  targeting sequence with ATCN PAM
uaauccuccgccuucagaga

SEQ ID NO: 2568 - RNA, 20 nt, Artificial Sequence
  targeting sequence with ATCN PAM
uuugagugcucucauauggc

SEQ ID NO: 2569 - RNA, 20 nt, Artificial Sequence
  targeting sequence with ATCN PAM
caaggggcuggccacguagu

SEQ ID NO: 2570 - RNA, 20 nt, Artificial Sequence
  targeting sequence with ATCN PAM
guuaaacaguauaggaacga

SEQ ID NO: 2571 - RNA, 20 nt, Artificial Sequence
  targeting sequence with ATCN PAM
uuccuauacuguuuaacaga

SEQ ID NO: 2572 - RNA, 20 nt, Artificial Sequence
  targeting sequence with ATCN PAM
caaccauuugugaaaacaag

SEQ ID NO: 2573 - RNA, 20 nt, Artificial Sequence
  targeting sequence with ATCN PAM
gccucaguuaucacaaccau

SEQ ID NO: 2574 - RNA, 20 nt, Artificial Sequence
  targeting sequence with ATCN PAM
uucaaaguggucauugaaaa

SEQ ID NO: 2575 - RNA, 20 nt, Artificial Sequence
  targeting sequence with ATCN PAM
cccuuuuuaugagcaaugaa

SEQ ID NO: 2576 - RNA, 20 nt, Artificial Sequence
  targeting sequence with ATCN PAM
ucaccacagacuuaugaaga

SEQ ID NO: 2577 - RNA, 20 nt, Artificial Sequence
  targeting sequence with ATCN PAM
agugaggugauuagcaacaa

SEQ ID NO: 2578 - RNA, 20 nt, Artificial Sequence
  targeting sequence with ATCN PAM
ccucacuggauccucaccac

SEQ ID NO: 2579 - RNA, 20 nt, Artificial Sequence
  targeting sequence with ATCN PAM
ccuuaggagucacaaaacuu

SEQ ID NO: 2580 - RNA, 20 nt, Artificial Sequence
  targeting sequence with ATCN PAM
ucagugagguucugcccccu

SEQ ID NO: 2581 - RNA, 20 nt, Artificial Sequence
  targeting sequence with ATCN PAM
cacuguacuuuuuccaggau

SEQ ID NO: 2582 - RNA, 20 nt, Artificial Sequence
  targeting sequence with ATCN PAM
uggaaaaaguacagugagau

SEQ ID NO: 2583 - RNA, 20 nt, Artificial Sequence
  targeting sequence with ATCN PAM
cagcaacgaagcacugcaga

SEQ ID NO: 2584 - RNA, 20 nt, Artificial Sequence
  targeting sequence with ATCN PAM
gcagugcuucguugcuggga

SEQ ID NO: 2585 - RNA, 20 nt, Artificial Sequence
  targeting sequence with ATCN PAM
uuaaaccugcucuccgccac

SEQ ID NO: 2586 - RNA, 20 nt, Artificial Sequence
  targeting sequence with ATCN PAM
aguaauaauaggcagcauca

SEQ ID NO: 2587 - RNA, 20 nt, Artificial Sequence
  targeting sequence with ATCN PAM
aggcacugcauggacagcau

SEQ ID NO: 2588 - RNA, 20 nt, Artificial Sequence
  targeting sequence with ATCN PAM
gccagaccacuguuuuccca

SEQ ID NO: 2589 - RNA, 20 nt, Artificial Sequence
  targeting sequence with ATCN PAM
uggugucagaguggggcuug

SEQ ID NO: 2590 - RNA, 20 nt, Artificial Sequence
  targeting sequence with ATCN PAM
gaagagcugggacauuuuaa

SEQ ID NO: 2591 - RNA, 20 nt, Artificial Sequence
  targeting sequence with ATCN PAM
gguguaucaucuuuuuccag

SEQ ID NO: 2592 - RNA, 20 nt, Artificial Sequence
  targeting sequence with ATCN PAM
ucuuuuuccaguuugcccau

SEQ ID NO: 2593 - RNA, 20 nt, Artificial Sequence
  targeting sequence with ATCN PAM
uuuuccaguuugcccaucag

SEQ ID NO: 2594 - RNA, 20 nt, Artificial Sequence
  targeting sequence with ATCN PAM
gaaugguaugaggaccgucc

SEQ ID NO: 2595 - RNA, 20 nt, Artificial Sequence
  targeting sequence with ATCN PAM
cuccccugcuaccugggagc

SEQ ID NO: 2596 - RNA, 20 nt, Artificial Sequence
  targeting sequence with ATCN PAM
ucucauuuaauuaaaaaaau

SEQ ID NO: 2597 - RNA, 20 nt, Artificial Sequence
  targeting sequence with ATCN PAM
cucguucaucuucucauuua

SEQ ID NO: 2598 - RNA, 20 nt, Artificial Sequence
  targeting sequence with ATCN PAM
ggaguguguuacuguaaagc

SEQ ID NO: 2599 - RNA, 20 nt, Artificial Sequence
  targeting sequence with ATCN PAM
cagccaggaaaacaguuuca

SEQ ID NO: 2600 - RNA, 20 nt, Artificial Sequence
  targeting sequence with ATCN PAM
ugggaagucuugugaaagaa

SEQ ID NO: 2601 - RNA, 20 nt, Artificial Sequence
  targeting sequence with ATCN PAM
ccuugucucuuccacuucca

SEQ ID NO: 2602 - RNA, 20 nt, Artificial Sequence
  targeting sequence with ATCN PAM
uuccugagcucugcaugccc

SEQ ID NO: 2603 - RNA, 20 nt, Artificial Sequence
  targeting sequence with ATCN PAM
guccugugggagucccuugu

SEQ ID NO: 2604 - RNA, 20 nt, Artificial Sequence
  targeting sequence with ATCN PAM
gaagcauaaggcacuggccc

SEQ ID NO: 2605 - RNA, 20 nt, Artificial Sequence
  targeting sequence with ATCN PAM
uaugccucuucccucugcug

SEQ ID NO: 2606 - RNA, 20 nt, Artificial Sequence
  targeting sequence with ATCN PAM
ugggucuugcugcagcuguc

SEQ ID NO: 2607 - RNA, 20 nt, Artificial Sequence
  targeting sequence with ATCN PAM
gggagggugcagugagagau

SEQ ID NO: 2608 - RNA, 20 nt, Artificial Sequence
  targeting sequence with ATCN PAM
cucacugcacccucccagau

SEQ ID NO: 2609 - RNA, 20 nt, Artificial Sequence
  targeting sequence with ATCN PAM
ggaaaaaauauccucaaacu

SEQ ID NO: 2610 - RNA, 20 nt, Artificial Sequence
  targeting sequence with ATCN PAM
ucaaacucccuggccuuaug

SEQ ID NO: 2611 - RNA, 20 nt, Artificial Sequence
  targeting sequence with ATCN PAM
uggaguggcccuacuccuaa

SEQ ID NO: 2612 - RNA, 20 nt, Artificial Sequence
  targeting sequence with ATCN PAM
guucucccaccacacagugu

SEQ ID NO: 2613 - RNA, 20 nt, Artificial Sequence
  targeting sequence with ATCN PAM
gcugugugcagcggguggga

SEQ ID NO: 2614 - RNA, 20 nt, Artificial Sequence
  targeting sequence with ATCN PAM
ugcccagaaggacacaaugc

SEQ ID NO: 2615 - RNA, 20 nt, Artificial Sequence
  targeting sequence with ATCN PAM
aucgccacacgguaaggugg

SEQ ID NO: 2616 - RNA, 20 nt, Artificial Sequence
  targeting sequence with ATCN PAM
ccacacgguaagguggcugg

SEQ ID NO: 2617 - RNA, 20 nt, Artificial Sequence
  targeting sequence with ATCN PAM
ccugagcuaggggucccggg

SEQ ID NO: 2618 - RNA, 20 nt, Artificial Sequence
  targeting sequence with ATCN PAM
aaagagcagcagacuggaug

SEQ ID NO: 2619 - RNA, 20 nt, Artificial Sequence
  targeting sequence with ATCN PAM
agucugcugcucuuuagaua

SEQ ID NO: 2620 - RNA, 20 nt, Artificial Sequence
  targeting sequence with ATCN PAM
uggucuccucugggaagaaa

SEQ ID NO: 2621 - RNA, 20 nt, Artificial Sequence
  targeting sequence with ATCN PAM
aagaaacucaaacuuuuucu

SEQ ID NO: 2622 - RNA, 20 nt, Artificial Sequence
  targeting sequence with ATCN PAM
agcagugggcuccugaauug

SEQ ID NO: 2623 - RNA, 20 nt, Artificial Sequence
  targeting sequence with ATCN PAM
caauucaggagcccacugcu

SEQ ID NO: 2624 - RNA, 20 nt, Artificial Sequence
  targeting sequence with ATCN PAM
agagcuggaaugggccuugc

SEQ ID NO: 2625 - RNA, 20 nt, Artificial Sequence
  targeting sequence with ATCN PAM
aagccugcacugaggaacua

SEQ ID NO: 2626 - RNA, 20 nt, Artificial Sequence
  targeting sequence with ATCN PAM
gggccuucgcccuacugaag

SEQ ID NO: 2627 - RNA, 20 nt, Artificial Sequence
  targeting sequence with ATCN PAM
cgagccuuugguuaaucugg

SEQ ID NO: 2628 - RNA, 20 nt, Artificial Sequence
  targeting sequence with ATCN PAM
cucccuggcccugucaguga

SEQ ID NO: 2629 - RNA, 20 nt, Artificial Sequence
  targeting sequence with ATCN PAM
cugacagggccagggaggga

SEQ ID NO: 2630 - RNA, 20 nt, Artificial Sequence
  targeting sequence with ATCN PAM
acacauuuuugccaaugaga

SEQ ID NO: 2631 - RNA, 20 nt, Artificial Sequence
  targeting sequence with ATCN PAM
auacuuugggauuugacgaa

SEQ ID NO: 2632 - RNA, 20 nt, Artificial Sequence
  targeting sequence with ATCN PAM
caaaguauggauuuuuaugc

SEQ ID NO: 2633 - RNA, 20 nt, Artificial Sequence
  targeting sequence with ATCN PAM
ugcugguuguggaagcauuu

SEQ ID NO: 2634 - RNA, 20 nt, Artificial Sequence
  targeting sequence with ATCN PAM
caacaacuuuuugcagggaa

SEQ ID NO: 2635 - RNA, 20 nt, Artificial Sequence
  targeting sequence with ATCN PAM
caauauucaccugaccucuu

SEQ ID NO: 2636 - RNA, 20 nt, Artificial Sequence
  targeting sequence with ATCN PAM
cacaaccaauacuucaaaau

SEQ ID NO: 2637 - RNA, 20 nt, Artificial Sequence
  targeting sequence with ATCN PAM
ccucgauuugcugagcauac

SEQ ID NO: 2638 - RNA, 20 nt, Artificial Sequence
  targeting sequence with ATCN PAM
aggagaugcaccgaaaacug

SEQ ID NO: 2639 - RNA, 20 nt, Artificial Sequence
  targeting sequence with ATCN PAM
uuucaccaggaucagacaac

SEQ ID NO: 2640 - RNA, 20 nt, Artificial Sequence
  targeting sequence with ATCN PAM
uggugaaaugauuacauuug

SEQ ID NO: 2641 - RNA, 20 nt, Artificial Sequence
  targeting sequence with ATCN PAM
gacaacuguaguggaucaga

SEQ ID NO: 2642 - RNA, 20 nt, Artificial Sequence
  targeting sequence with ATCN PAM
acuacaguugucugauccug

SEQ ID NO: 2643 - RNA, 20 nt, Artificial Sequence
  targeting sequence with ATCN PAM
gaccagcagcagaccaccaa

SEQ ID NO: 2644 - RNA, 20 nt, Artificial Sequence
  targeting sequence with ATCN PAM
cuguuugguggucugcugcu

SEQ ID NO: 2645 - RNA, 20 nt, Artificial Sequence
  targeting sequence with ATCN PAM
ugaccuuuuuuuggugcaag

SEQ ID NO: 2646 - RNA, 20 nt, Artificial Sequence
  targeting sequence with ATCN PAM
cgguugucauguaaagucca

SEQ ID NO: 2647 - RNA, 20 nt, Artificial Sequence
  targeting sequence with ATCN PAM
gauugagaaauguuuuguug

SEQ ID NO: 2648 - RNA, 20 nt, Artificial Sequence
  targeting sequence with ATCN PAM
gaugugaggugugacaaaaa

SEQ ID NO: 2649 - RNA, 20 nt, Artificial Sequence
  targeting sequence with ATCN PAM
gcucaugaggcacccacuua

SEQ ID NO: 2650 - RNA, 20 nt, Artificial Sequence
  targeting sequence with ATCN PAM
agcuuuuucaccuucccaau

SEQ ID NO: 2651 - RNA, 20 nt, Artificial Sequence
  targeting sequence with ATCN PAM
ucucacaacuacaggagaag

SEQ ID NO: 2652 - RNA, 20 nt, Artificial Sequence
  targeting sequence with ATCN PAM
gcuucgaugauugcucucgg

SEQ ID NO: 2653 - RNA, 20 nt, Artificial Sequence
  targeting sequence with ATCN PAM
aagcugauccucucacaacu

SEQ ID NO: 2654 - RNA, 20 nt, Artificial Sequence
  targeting sequence with ATCN PAM
ucgaagcugauccucucaca

SEQ ID NO: 2655 - RNA, 20 nt, Artificial Sequence
  targeting sequence with ATCN PAM
ucaagccucucaucuccuuu

SEQ ID NO: 2656 - RNA, 20 nt, Artificial Sequence
  targeting sequence with ATCN PAM
ccuuugcaaaacuucuugaa

SEQ ID NO: 2657 - RNA, 20 nt, Artificial Sequence
  targeting sequence with ATCN PAM
acaacgcauuuggcccagga

SEQ ID NO: 2658 - RNA, 20 nt, Artificial Sequence
  targeting sequence with ATCN PAM
uuugcauagucuaaaauaaa

SEQ ID NO: 2659 - RNA, 20 nt, Artificial Sequence
  targeting sequence with ATCN PAM
uuucaacgggcauuucucgc

SEQ ID NO: 2660 - RNA, 20 nt, Artificial Sequence
  targeting sequence with ATCN PAM
aacagcaaauuccagagcca

SEQ ID NO: 2661 - RNA, 20 nt, Artificial Sequence
  targeting sequence with ATCN PAM
ucucuggccuucagcuucuu

SEQ ID NO: 2662 - RNA, 20 nt, Artificial Sequence
  targeting sequence with ATCN PAM
cuauuuuauagagaaagaag

SEQ ID NO: 2663 - RNA, 20 nt, Artificial Sequence
  targeting sequence with ATCN PAM
aguacauagugcuguuaucc

SEQ ID NO: 2664 - RNA, 20 nt, Artificial Sequence
  targeting sequence with ATCN PAM
caucaaguacauagugcugu

SEQ ID NO: 2665 - RNA, 20 nt, Artificial Sequence
  targeting sequence with ATCN PAM
ucaaaacaaucccaucaagu

SEQ ID NO: 2666 - RNA, 20 nt, Artificial Sequence
  targeting sequence with ATCN PAM
uuacugcugcuccaggcaag

SEQ ID NO: 2667 - RNA, 20 nt, Artificial Sequence
  targeting sequence with ATCN PAM
agcauuucucuuuuuucaga

SEQ ID NO: 2668 - RNA, 20 nt, Artificial Sequence
  targeting sequence with ATCN PAM
cugaaaaaagagaaaugcua

SEQ ID NO: 2669 - RNA, 20 nt, Artificial Sequence
  targeting sequence with ATCN PAM
ugacacugcacuccaccuug

SEQ ID NO: 2670 - RNA, 20 nt, Artificial Sequence
  targeting sequence with ATCN PAM
uagcucauggcagccucaaa

SEQ ID NO: 2671 - RNA, 20 nt, Artificial Sequence
  targeting sequence with ATCN PAM
cuugaguccagcaguuugag

SEQ ID NO: 2672 - RNA, 20 nt, Artificial Sequence
  targeting sequence with ATCN PAM
uccugccugagccucccaga

SEQ ID NO: 2673 - RNA, 20 nt, Artificial Sequence
  targeting sequence with ATCN PAM
cagugcucugggaggcucag

SEQ ID NO: 2674 - RNA, 20 nt, Artificial Sequence
  targeting sequence with ATCN PAM
gugcugacuucucagcacau

SEQ ID NO: 2675 - RNA, 20 nt, Artificial Sequence
  targeting sequence with ATCN PAM
cuucccacagcagggucagu

SEQ ID NO: 2676 - RNA, 20 nt, Artificial Sequence
  targeting sequence with ATCN PAM
ucccuuacagucuuuggcuu

SEQ ID NO: 2677 - RNA, 20 nt, Artificial Sequence
  targeting sequence with ATCN PAM
uuaucaggugcucaccugga

SEQ ID NO: 2678 - RNA, 20 nt, Artificial Sequence
  targeting sequence with ATCN PAM
ggugcucaccuggagagaaa

SEQ ID NO: 2679 - RNA, 20 nt, Artificial Sequence
  targeting sequence with ATCN PAM
cagcugaaucuuauuaauug

SEQ ID NO: 2680 - RNA, 20 nt, Artificial Sequence
  targeting sequence with ATCN PAM
uauuaauugggccauuccuu

SEQ ID NO: 2681 - RNA, 20 nt, Artificial Sequence
  targeting sequence with ATCN PAM
cagggucugucacguaguag

SEQ ID NO: 2682 - RNA, 20 nt, Artificial Sequence
  targeting sequence with ATCN PAM
cucaggggaaacguuuagag

SEQ ID NO: 2683 - RNA, 20 nt, Artificial Sequence
  targeting sequence with ATCN PAM
uccuccacuucacuugcccc

SEQ ID NO: 2684 - RNA, 20 nt, Artificial Sequence
  targeting sequence with ATCN PAM
agggcccagcagagcagcac

SEQ ID NO: 2685 - RNA, 20 nt, Artificial Sequence
  targeting sequence with ATCN PAM
gugcugcucugcugggcccu

SEQ ID NO: 2686 - RNA, 20 nt, Artificial Sequence
  targeting sequence with ATCN PAM
aggaaggaccugaacuuccc

SEQ ID NO: 2687 - RNA, 20 nt, Artificial Sequence
  targeting sequence with ATCN PAM
uucccagaggaaaggacucc

SEQ ID NO: 2688 - RNA, 20 nt, Artificial Sequence
  targeting sequence with ATCN PAM
uguucuuacccuggaaagga

SEQ ID NO: 2689 - RNA, 20 nt, Artificial Sequence
  targeting sequence with ATCN PAM
uuuccaggguaagaacaaga

SEQ ID NO: 2690 - RNA, 20 nt, Artificial Sequence
  targeting sequence with ATCN PAM
cugagccaccaaagcuuaac

SEQ ID NO: 2691 - RNA, 20 nt, Artificial Sequence
  targeting sequence with ATCN PAM
ucaccaucuaaagcuuuauu

SEQ ID NO: 2692 - RNA, 20 nt, Artificial Sequence
  targeting sequence with ATCN PAM
aaagcuuuauuagaaauggg

SEQ ID NO: 2693 - RNA, 20 nt, Artificial Sequence
  targeting sequence with ATCN PAM
caguuuauauacagugugcc

SEQ ID NO: 2694 - RNA, 20 nt, Artificial Sequence
  targeting sequence with ATCN PAM
ggcacacuguauauaaacug

SEQ ID NO: 2695 - RNA, 20 nt, Artificial Sequence
  targeting sequence with ATCN PAM
cuaaucugugcuaacugccu

SEQ ID NO: 2696 - RNA, 20 nt, Artificial Sequence
  targeting sequence with ATCN PAM
gugcuaacugccuccuguua

SEQ ID NO: 2697 - RNA, 20 nt, Artificial Sequence
  targeting sequence with ATCN PAM
gucaagcugcuguuggaaag

SEQ ID NO: 2698 - RNA, 20 nt, Artificial Sequence
  targeting sequence with ATCN PAM
gugguuauguccuaagcugc

SEQ ID NO: 2699 - RNA, 20 nt, Artificial Sequence
  targeting sequence with ATCN PAM
gaccuggguuugaacagcag

SEQ ID NO: 2700 - RNA, 20 nt, Artificial Sequence
  targeting sequence with ATCN PAM
ucuaucuaggugucgguuuc

SEQ ID NO: 2701 - RNA, 20 nt, Artificial Sequence
  targeting sequence with ATCN PAM
aucuaggugucgguuuccuc

SEQ ID NO: 2702 - RNA, 20 nt, Artificial Sequence
  targeting sequence with ATCN PAM
aggugucgguuuccucauca

SEQ ID NO: 2703 - RNA, 20 nt, Artificial Sequence
  targeting sequence with ATCN PAM
guacugugaggauaaaaaug

SEQ ID NO: 2704 - RNA, 20 nt, Artificial Sequence
  targeting sequence with ATCN PAM
ucacaguacugaugaggaaa

SEQ ID NO: 2705 - RNA, 20 nt, Artificial Sequence
  targeting sequence with ATCN PAM
ggucuuuaacauaauaaccu

SEQ ID NO: 2706 - RNA, 20 nt, Artificial Sequence
  targeting sequence with ATCN PAM
gagccgcucuuguugauguc

SEQ ID NO: 2707 - RNA, 20 nt, Artificial Sequence
  targeting sequence with ATCN PAM
acaagagcggcucugauuau

SEQ ID NO: 2708 - RNA, 20 nt, Artificial Sequence
  targeting sequence with ATCN PAM
cuguuugcuuuucucucacu

SEQ ID NO: 2709 - RNA, 20 nt, Artificial Sequence
  targeting sequence with ATCN PAM
uccugcagugagagaaaagc

SEQ ID NO: 2710 - RNA, 20 nt, Artificial Sequence
  targeting sequence with ATCN PAM
guucaguguccaucguccug

SEQ ID NO: 2711 - RNA, 20 nt, Artificial Sequence
  targeting sequence with ATCN PAM
uccugaaacucuuuucaaca

SEQ ID NO: 2712 - RNA, 20 nt, Artificial Sequence
  targeting sequence with ATCN PAM
ccagguuccugcugcacagc

SEQ ID NO: 2713 - RNA, 20 nt, Artificial Sequence
  targeting sequence with ATCN PAM
cuaaaguguauccuuucucu

SEQ ID NO: 2714 - RNA, 20 nt, Artificial Sequence
  targeting sequence with ATCN PAM
uuucucuuaucccuccuccg

SEQ ID NO: 2715 - RNA, 20 nt, Artificial Sequence
  targeting sequence with ATCN PAM
cuccuccgucccaccaccgu

SEQ ID NO: 2716 - RNA, 20 nt, Artificial Sequence
  targeting sequence with ATCN PAM
ucucuuggccugggccccug

SEQ ID NO: 2717 - RNA, 20 nt, Artificial Sequence
  targeting sequence with ATCN PAM
cuccuagaacccacagauga

SEQ ID NO: 2718 - RNA, 20 nt, Artificial Sequence
  targeting sequence with ATCN PAM
guggguucuaggagggauug

SEQ ID NO: 2719 - RNA, 20 nt, Artificial Sequence
  targeting sequence with ATCN PAM
aagagggaggucacaaguua

SEQ ID NO: 2720 - RNA, 20 nt, Artificial Sequence
  targeting sequence with ATCN PAM
accaaaccagacccuaacuu

SEQ ID NO: 2721 - RNA, 20 nt, Artificial Sequence
  targeting sequence with ATCN PAM
ccuccuccagguaaacuucc

SEQ ID NO: 2722 - RNA, 20 nt, Artificial Sequence
  targeting sequence with ATCN PAM
ugcaagcugaggcagccagg

SEQ ID NO: 2723 - RNA, 20 nt, Artificial Sequence
  targeting sequence with ATCN PAM
ucccuggcugccucagcuug

SEQ ID NO: 2724 - RNA, 20 nt, Artificial Sequence
  targeting sequence with ATCN PAM
acuuggccaucuucccuggc

SEQ ID NO: 2725 - RNA, 20 nt, Artificial Sequence
  targeting sequence with ATCN PAM
agggccacagugguaccaua

SEQ ID NO: 2726 - RNA, 20 nt, Artificial Sequence
  targeting sequence with ATCN PAM
ggcugcacaggcccuucagg

SEQ ID NO: 2727 - RNA, 20 nt, Artificial Sequence
  targeting sequence with ATCN PAM
aguaucuggcugcacaggcc

SEQ ID NO: 2728 - RNA, 20 nt, Artificial Sequence
  targeting sequence with ATCN PAM
uuaccaggcaaugauccaga

SEQ ID NO: 2729 - RNA, 20 nt, Artificial Sequence
  targeting sequence with ATCN PAM
uugccugguaaugauccagu

SEQ ID NO: 2730 - RNA, 20 nt, Artificial Sequence
  targeting sequence with ATCN PAM
agauuuuuaaggucuuggau

SEQ ID NO: 2731 - RNA, 20 nt, Artificial Sequence
  targeting sequence with ATCN PAM
ggaucauugccugguaauga

SEQ ID NO: 2732 - RNA, 20 nt, Artificial Sequence
  targeting sequence with ATCN PAM
aagaccuuaaaaaucuggau

SEQ ID NO: 2733 - RNA, 20 nt, Artificial Sequence
  targeting sequence with ATCN PAM
cacuguacucucagcuccuu

SEQ ID NO: 2734 - RNA, 20 nt, Artificial Sequence
  targeting sequence with ATCN PAM
ucuagcgaggccaauucuua

SEQ ID NO: 2735 - RNA, 20 nt, Artificial Sequence
  targeting sequence with ATCN PAM
aggggugccuuccuggaguc

SEQ ID NO: 2736 - RNA, 20 nt, Artificial Sequence
  targeting sequence with ATCN PAM
uuuccagcaaguucuguuug

SEQ ID NO: 2737 - RNA, 20 nt, Artificial Sequence
  targeting sequence with ATCN PAM
agcuguugacucaaacagaa

SEQ ID NO: 2738 - RNA, 20 nt, Artificial Sequence
  targeting sequence with ATCN PAM
ccuggggaccuggaaauggc

SEQ ID NO: 2739 - RNA, 20 nt, Artificial Sequence
  targeting sequence with ATCN PAM
cucccaguguuccugcuccc

SEQ ID NO: 2740 - RNA, 20 nt, Artificial Sequence
  targeting sequence with ATCN PAM
gaggugaccugagaggagag

SEQ ID NO: 2741 - RNA, 20 nt, Artificial Sequence
  targeting sequence with ATCN PAM
uaggagggccuggcuggcag

SEQ ID NO: 2742 - RNA, 20 nt, Artificial Sequence
  targeting sequence with ATCN PAM
uauacccugacuaggccaaa

SEQ ID NO: 2743 - RNA, 20 nt, Artificial Sequence
  targeting sequence with ATCN PAM
gcaggcccagagaugcuaag

SEQ ID NO: 2744 - RNA, 20 nt, Artificial Sequence
  targeting sequence with ATCN PAM
cugggccugcugauggcuca

SEQ ID NO: 2745 - RNA, 20 nt, Artificial Sequence
  targeting sequence with ATCN PAM
uuggaaaaauuccugggccu

SEQ ID NO: 2746 - RNA, 20 nt, Artificial Sequence
  targeting sequence with ATCN PAM
gagaaguacacucaccucuc

SEQ ID NO: 2747 - RNA, 20 nt, Artificial Sequence
  targeting sequence with ATCN PAM
cugccagauuccaaaagucc

SEQ ID NO: 2748 - RNA, 20 nt, Artificial Sequence
  targeting sequence with ATCN PAM
ggcagggauguacaggccac

SEQ ID NO: 2749 - RNA, 20 nt, Artificial Sequence
  targeting sequence with ATCN PAM
gcgccaagcccuuccacgac

SEQ ID NO: 2750 - RNA, 20 nt, Artificial Sequence
  targeting sequence with ATCN PAM
ucaccucacugucguggaag

SEQ ID NO: 2751 - RNA, 20 nt, Artificial Sequence
  targeting sequence with ATCN PAM
caugccuucuugccuggccu

SEQ ID NO: 2752 - RNA, 20 nt, Artificial Sequence
  targeting sequence with ATCN PAM
accccacacucccaacccac

SEQ ID NO: 2753 - RNA, 20 nt, Artificial Sequence
  targeting sequence with ATCN PAM
ucccucaagcucagagcaag

SEQ ID NO: 2754 - RNA, 20 nt, Artificial Sequence
  targeting sequence with ATCN PAM
cggcuccacccucuccuagc

SEQ ID NO: 2755 - RNA, 20 nt, Artificial Sequence
  targeting sequence with ATCN PAM
uucugcaccuuggguucccc

SEQ ID NO: 2756 - RNA, 20 nt, Artificial Sequence
  targeting sequence with ATCN PAM
ugcuuccccauggcauggag

SEQ ID NO: 2757 - RNA, 20 nt, Artificial Sequence
  targeting sequence with ATCN PAM
acugccgccagcccuucauc

SEQ ID NO: 2758 - RNA, 20 nt, Artificial Sequence
  targeting sequence with ATCN PAM
ucuccgccucuuccuacggu

SEQ ID NO: 2759 - RNA, 20 nt, Artificial Sequence
  targeting sequence with ATCN PAM
ugagcaugugggugggacag

SEQ ID NO: 2760 - RNA, 20 nt, Artificial Sequence
  targeting sequence with ATCN PAM
cugggaacaccgacagugac

SEQ ID NO: 2761 - RNA, 20 nt, Artificial Sequence
  targeting sequence with ATCN PAM
gacucucuuucuggggcauu

SEQ ID NO: 2762 - RNA, 20 nt, Artificial Sequence
  targeting sequence with ATCN PAM
cagccuccuggucugaaugc

SEQ ID NO: 2763 - RNA, 20 nt, Artificial Sequence
  targeting sequence with ATCN PAM
aggcccagcuccuuugaugu

SEQ ID NO: 2764 - RNA, 20 nt, Artificial Sequence
  targeting sequence with ATCN PAM
aaggagcugggccuugauaa

SEQ ID NO: 2765 - RNA, 20 nt, Artificial Sequence
  targeting sequence with ATCN PAM
ucugucaacaucaaaggagc

SEQ ID NO: 2766 - RNA, 20 nt, Artificial Sequence
  targeting sequence with ATCN PAM
gaagccccuucccaggagcu

SEQ ID NO: 2767 - RNA, 20 nt, Artificial Sequence
  targeting sequence with ATCN PAM
guguguguguaggggcaguc

SEQ ID NO: 2768 - RNA, 20 nt, Artificial Sequence
  targeting sequence with ATCN PAM
gugugugugcaggggcaguc

SEQ ID NO: 2769 - RNA, 20 nt, Artificial Sequence
  targeting sequence with ATCN PAM
gugugugugcaggggcaguu

SEQ ID NO: 2770 - RNA, 20 nt, Artificial Sequence
  targeting sequence with ATCN PAM
gugugugugcaggggcaguu

SEQ ID NO: 2771 - RNA, 20 nt, Artificial Sequence
  targeting sequence with ATCN PAM
cuuccuccagguagaacuca

SEQ ID NO: 2772 - RNA, 20 nt, Artificial Sequence
  targeting sequence with ATCN PAM
cugaugaagaagccaucucc

SEQ ID NO: 2773 - RNA, 20 nt, Artificial Sequence
  targeting sequence with ATCN PAM
gugaucccuuccuccaggua

SEQ ID NO: 2774 - RNA, 20 nt, Artificial Sequence
  targeting sequence with ATCN PAM
cccucaucgaccuggaggug

SEQ ID NO: 2775 - RNA, 20 nt, Artificial Sequence
  targeting sequence with ATCN PAM
accuggaggugcugagaccc

SEQ ID NO: 2776 - RNA, 20 nt, Artificial Sequence
  targeting sequence with ATCN PAM
cgcuugggucucagcaccuc

SEQ ID NO: 2777 - RNA, 20 nt, Artificial Sequence
  targeting sequence with ATCN PAM
cuagcugucugucaucccgc

SEQ ID NO: 2778 - RNA, 20 nt, Artificial Sequence
  targeting sequence with ATCN PAM
augcccuuggccagagccug

SEQ ID NO: 2779 - RNA, 20 nt, Artificial Sequence
  targeting sequence with ATCN PAM
ccugggacugggcccuccua

SEQ ID NO: 2780 - RNA, 20 nt, Artificial Sequence
  targeting sequence with ATCN PAM
cgggccaugcugagccuggc

SEQ ID NO: 2781 - RNA, 20 nt, Artificial Sequence
  targeting sequence with ATCN PAM
cucugggaacacagggccag

SEQ ID NO: 2782 - RNA, 20 nt, Artificial Sequence
  targeting sequence with ATCN PAM
cugucccugucccauguggg

SEQ ID NO: 2783 - RNA, 20 nt, Artificial Sequence
  targeting sequence with ATCN PAM
gagaugggcagacagcuggc

SEQ ID NO: 2784 - RNA, 20 nt, Artificial Sequence
  targeting sequence with ATCN PAM
cugaucccugucccuguccc

SEQ ID NO: 2785 - RNA, 20 nt, Artificial Sequence
  targeting sequence with ATCN PAM
ugucccauguuggcuaugca

SEQ ID NO: 2786 - RNA, 20 nt, Artificial Sequence
  targeting sequence with ATCN PAM
ugacaucaugucccauguug

SEQ ID NO: 2787 - RNA, 20 nt, Artificial Sequence
  targeting sequence with ATCN PAM
cuguguuaugggggcaccac

SEQ ID NO: 2788 - RNA, 20 nt, Artificial Sequence
  targeting sequence with ATCN PAM
ccucagccuuauagccccca

SEQ ID NO: 2789 - RNA, 20 nt, Artificial Sequence
  targeting sequence with ATCN PAM
uccuggccaaggggcaggcu

SEQ ID NO: 2790 - RNA, 20 nt, Artificial Sequence
  targeting sequence with ATCN PAM
cugccacccaggcucccuca

SEQ ID NO: 2791 - RNA, 20 nt, Artificial Sequence
  targeting sequence with ATCN PAM
guggcaccugagggagccug

SEQ ID NO: 2792 - RNA, 20 nt, Artificial Sequence
  targeting sequence with ATCN PAM
ucuguggcaccugagggagc

SEQ ID NO: 2793 - RNA, 20 nt, Artificial Sequence
  targeting sequence with ATCN PAM
caagugcccgcagaccccca

SEQ ID NO: 2794 - RNA, 20 nt, Artificial Sequence
  targeting sequence with ATCN PAM
uggagaaacauucaguggcu

SEQ ID NO: 2795 - RNA, 20 nt, Artificial Sequence
  targeting sequence with ATCN PAM
cugggcccauccccuccgug

SEQ ID NO: 2796 - RNA, 20 nt, Artificial Sequence
  targeting sequence with ATCN PAM
ccuccgugccuacccgcagu

SEQ ID NO: 2797 - RNA, 20 nt, Artificial Sequence
  targeting sequence with ATCN PAM
gaaggaagggacucugcugg

SEQ ID NO: 2798 - RNA, 20 nt, Artificial Sequence
  targeting sequence with ATCN PAM
cugcuucugauuccauccuu

SEQ ID NO: 2799 - RNA, 20 nt, Artificial Sequence
  targeting sequence with ATCN PAM
gaagcagagauggagacaga

SEQ ID NO: 2800 - RNA, 20 nt, Artificial Sequence
  targeting sequence with ATCN PAM
uugaccagaucccuccaggc

SEQ ID NO: 2801 - RNA, 20 nt, Artificial Sequence
  targeting sequence with ATCN PAM
ggucaaggauggaaucagaa

SEQ ID NO: 2802 - RNA, 20 nt, Artificial Sequence
  targeting sequence with ATCN PAM
cuccaggcucccagauucug

SEQ ID NO: 2803 - RNA, 20 nt, Artificial Sequence
  targeting sequence with ATCN PAM
gggagccuggagggaucugg

SEQ ID NO: 2804 - RNA, 20 nt, Artificial Sequence
  targeting sequence with ATCN PAM
gagaugaggacccguucaca

SEQ ID NO: 2805 - RNA, 20 nt, Artificial Sequence
  targeting sequence with ATCN PAM
ccgauggaguccuuggucuc

SEQ ID NO: 2806 - RNA, 20 nt, Artificial Sequence
  targeting sequence with ATCN PAM
cuucuccugugcacaugggg

SEQ ID NO: 2807 - RNA, 20 nt, Artificial Sequence
  targeting sequence with ATCN PAM
uccuccaccacugcgcuagc

SEQ ID NO: 2808 - RNA, 20 nt, Artificial Sequence
  targeting sequence with ATCN PAM
ggaaguucuggccaauccuc

SEQ ID NO: 2809 - RNA, 20 nt, Artificial Sequence
  targeting sequence with ATCN PAM
uuggcaguggugagagagga

SEQ ID NO: 2810 - RNA, 20 nt, Artificial Sequence
  targeting sequence with ATCN PAM
uggaaucuuuggcaguggug

SEQ ID NO: 2811 - RNA, 20 nt, Artificial Sequence
  targeting sequence with ATCN PAM
uaauccacacagaugucuca

SEQ ID NO: 2812 - RNA, 20 nt, Artificial Sequence
  targeting sequence with ATCN PAM
acacagaugucucacugugg

SEQ ID NO: 2813 - RNA, 20 nt, Artificial Sequence
  targeting sequence with ATCN PAM
guguggauuaugauccugga

SEQ ID NO: 2814 - RNA, 20 nt, Artificial Sequence
  targeting sequence with ATCN PAM
cggcggcucauggagcgcag

SEQ ID NO: 2815 - RNA, 20 nt, Artificial Sequence
  targeting sequence with ATCN PAM
agcgauggcccccaccccug

SEQ ID NO: 2816 - RNA, 20 nt, Artificial Sequence
  targeting sequence with ATCN PAM
cuugaugaggacaucccggc

SEQ ID NO: 2817 - RNA, 20 nt, Artificial Sequence
  targeting sequence with ATCN PAM
auggcuccaaguugggacag

SEQ ID NO: 2818 - RNA, 20 nt, Artificial Sequence
  targeting sequence with ATCN PAM
aaaguggacuucacuggccc

SEQ ID NO: 2819 - RNA, 20 nt, Artificial Sequence
  targeting sequence with ATCN PAM
uccccaaauccugggggccc

SEQ ID NO: 2820 - RNA, 20 nt, Artificial Sequence
  targeting sequence with ATCN PAM
ugggggcccagcaagcguga

SEQ ID NO: 2821 - RNA, 20 nt, Artificial Sequence
  targeting sequence with ATCN PAM
cgcuugcugggcccccagga

SEQ ID NO: 2822 - RNA, 20 nt, Artificial Sequence
  targeting sequence with ATCN PAM
ccccuuccagcccucaaaca

SEQ ID NO: 2823 - RNA, 20 nt, Artificial Sequence
  targeting sequence with ATCN PAM
gcccuacgccuggggccagg

SEQ ID NO: 2824 - RNA, 20 nt, Artificial Sequence
  targeting sequence with ATCN PAM
aagggaagacagcuguaaga

SEQ ID NO: 2825 - RNA, 20 nt, Artificial Sequence
  targeting sequence with ATCN PAM
uugcaccugcggcaguaggg

SEQ ID NO: 2826 - RNA, 20 nt, Artificial Sequence
  targeting sequence with ATCN PAM
uggggacggccugcacccuc

SEQ ID NO: 2827 - RNA, 20 nt, Artificial Sequence
  targeting sequence with ATCN PAM
gggcaagaaacacauucuga

SEQ ID NO: 2828 - RNA, 20 nt, Artificial Sequence
  targeting sequence with ATCN PAM
ccuggugcuauuuacaaggc

SEQ ID NO: 2829 - RNA, 20 nt, Artificial Sequence
  targeting sequence with ATCN PAM
guuacuuucagaacggcucc

SEQ ID NO: 2830 - RNA, 20 nt, Artificial Sequence
  targeting sequence with ATCN PAM
gcggacuccagcaggcugcc

SEQ ID NO: 2831 - RNA, 20 nt, Artificial Sequence
  targeting sequence with ATCN PAM
gucagaccguuagcauguac

SEQ ID NO: 2832 - RNA, 20 nt, Artificial Sequence
  targeting sequence with ATCN PAM
guuggcaaaauguacaugcu

SEQ ID NO: 2833 - RNA, 20 nt, Artificial Sequence
  targeting sequence with ATCN PAM
gcaucuacauuuuagcaaau

SEQ ID NO: 2834 - RNA, 20 nt, Artificial Sequence
  targeting sequence with ATCN PAM
acauuuuagcaaaucaucuu

SEQ ID NO: 2835 - RNA, 20 nt, Artificial Sequence
  targeting sequence with ATCN PAM
ucuuauugucugcaacuuaa

SEQ ID NO: 2836 - RNA, 20 nt, Artificial Sequence
  targeting sequence with ATCN PAM
uauugucugcaacuuaauuu

SEQ ID NO: 2837 - RNA, 20 nt, Artificial Sequence
  targeting sequence with ATCN PAM
aaauggcaauauagaaaggg

SEQ ID NO: 2838 - RNA, 20 nt, Artificial Sequence
  targeting sequence with ATCN PAM
aaauaaauaaacaaaaaaac

SEQ ID NO: 2839 - RNA, 20 nt, Artificial Sequence
  targeting sequence with ATCN PAM
ccauuaaaucaaaauaaaua

SEQ ID NO: 2840 - RNA, 20 nt, Artificial Sequence
  targeting sequence with ATCN PAM
aucuugacaagagaaaauac

SEQ ID NO: 2841 - RNA, 20 nt, Artificial Sequence
  targeting sequence with ATCN PAM
ugacaagagaaaauacgugg

SEQ ID NO: 2842 - RNA, 20 nt, Artificial Sequence
  targeting sequence with ATCN PAM
ucuuuggacccacguauuuu

SEQ ID NO: 2843 - RNA, 20 nt, Artificial Sequence
  targeting sequence with ATCN PAM
accuuccccagccccacaga

SEQ ID NO: 2844 - RNA, 20 nt, Artificial Sequence
  targeting sequence with ATCN PAM
caaacggaaacccccugcuu

SEQ ID NO: 2845 - RNA, 20 nt, Artificial Sequence
  targeting sequence with ATCN PAM
cugguguccaguccaacagc

SEQ ID NO: 2846 - RNA, 20 nt, Artificial Sequence
  targeting sequence with ATCN PAM
uaacucuuccuucacagggc

SEQ ID NO: 2847 - RNA, 20 nt, Artificial Sequence
  targeting sequence with ATCN PAM
ugggccgccccucccagggc

SEQ ID NO: 2848 - RNA, 20 nt, Artificial Sequence
  targeting sequence with ATCN PAM
auacugcagcacgaggggag

SEQ ID NO: 2849 - RNA, 20 nt, Artificial Sequence
  targeting sequence with ATCN PAM
cagagcccuugccccacccc

SEQ ID NO: 2850 - RNA, 20 nt, Artificial Sequence
  targeting sequence with ATCN PAM
cucuggagaugauggaggaa

SEQ ID NO: 2851 - RNA, 20 nt, Artificial Sequence
  targeting sequence with ATCN PAM
ccagagagaugcggagggag

SEQ ID NO: 2852 - RNA, 20 nt, Artificial Sequence
  targeting sequence with ATCN PAM
ucuccagagagaugcggagg

SEQ ID NO: 2853 - RNA, 20 nt, Artificial Sequence
  targeting sequence with ATCN PAM
ugcaugcgcucucucacuaa

SEQ ID NO: 2854 - RNA, 20 nt, Artificial Sequence
  targeting sequence with ATCN PAM
uaacacauuaauaaauguuu

SEQ ID NO: 2855 - RNA, 20 nt, Artificial Sequence
  targeting sequence with ATCN PAM
uuugcauauggcugggaaaa

SEQ ID NO: 2856 - RNA, 20 nt, Artificial Sequence
  targeting sequence with ATCN PAM
cagugacagaucagaugguc

SEQ ID NO: 2857 - RNA, 20 nt, Artificial Sequence
  targeting sequence with ATCN PAM
gucacugugauugacugcug

SEQ ID NO: 2858 - RNA, 20 nt, Artificial Sequence
  targeting sequence with ATCN PAM
gauggucccuggcuggaggc

SEQ ID NO: 2859 - RNA, 20 nt, Artificial Sequence
  targeting sequence with ATCN PAM
gaucugucacugugauugac

SEQ ID NO: 2860 - RNA, 20 nt, Artificial Sequence
  targeting sequence with ATCN PAM
ccucagccgaagaacacaaa

SEQ ID NO: 2861 - RNA, 20 nt, Artificial Sequence
  targeting sequence with ATCN PAM
gaaugaauagggguccuacu

SEQ ID NO: 2862 - RNA, 20 nt, Artificial Sequence
  targeting sequence with ATCN PAM
uccaaggcugccuauuacac

SEQ ID NO: 2863 - RNA, 20 nt, Artificial Sequence
  targeting sequence with ATCN PAM
aaggcugccuauuacacagg

SEQ ID NO: 2864 - RNA, 20 nt, Artificial Sequence
  targeting sequence with ATCN PAM
ccuguguaauaggcagccuu

SEQ ID NO: 2865 - RNA, 20 nt, Artificial Sequence
  targeting sequence with ATCN PAM
ggcugagagagaaaagcagc

SEQ ID NO: 2866 - RNA, 20 nt, Artificial Sequence
  targeting sequence with ATCN PAM
gggucugaaccaaguccagu

SEQ ID NO: 2867 - RNA, 20 nt, Artificial Sequence
  targeting sequence with ATCN PAM
gcacaaaagggcccccucca

SEQ ID NO: 2868 - RNA, 20 nt, Artificial Sequence
  targeting sequence with ATCN PAM
agcgcuguucacagacgcag

SEQ ID NO: 2869 - RNA, 20 nt, Artificial Sequence
  targeting sequence with ATCN PAM
uccagcgcuguucacagacg

SEQ ID NO: 2870 - RNA, 20 nt, Artificial Sequence
  targeting sequence with ATCN PAM
ucauccagcgcuguucacag

SEQ ID NO: 2871 - RNA, 20 nt, Artificial Sequence
  targeting sequence with ATCN PAM
uguugaccccucaagugccu

SEQ ID NO: 2872 - RNA, 20 nt, Artificial Sequence
  targeting sequence with ATCN PAM
ccaggucccuguggugccuu

SEQ ID NO: 2873 - RNA, 20 nt, Artificial Sequence
  targeting sequence with ATCN PAM
cugccccaccgugcagccuu

SEQ ID NO: 2874 - RNA, 20 nt, Artificial Sequence
  targeting sequence with ATCN PAM
uuccaccucagccuccugag

SEQ ID NO: 2875 - RNA, 20 nt, Artificial Sequence
  targeting sequence with ATCN PAM
auugagccaaggacaggaau

SEQ ID NO: 2876 - RNA, 20 nt, Artificial Sequence
  targeting sequence with ATCN PAM
uagcuuacugcagccuugaa

SEQ ID NO: 2877 - RNA, 20 nt, Artificial Sequence
  targeting sequence with ATCN PAM
cuaaacaacauuuaaaaauu

SEQ ID NO: 2878 - RNA, 20 nt, Artificial Sequence
  targeting sequence with ATCN PAM
cauuugucuucuuaaaacaa

SEQ ID NO: 2879 - RNA, 20 nt, Artificial Sequence
  targeting sequence with ATCN PAM
acaguuaucucauuugucuu

SEQ ID NO: 2880 - RNA, 20 nt, Artificial Sequence
  targeting sequence with ATCN PAM
uaauggcuguguaaaaacug

SEQ ID NO: 2881 - RNA, 20 nt, Artificial Sequence
  targeting sequence with ATCN PAM
cagcacuuugggaggccaag

SEQ ID NO: 2882 - RNA, 20 nt, Artificial Sequence
  targeting sequence with ATCN PAM
uccugccuuggccucccaaa

SEQ ID NO: 2883 - RNA, 20 nt, Artificial Sequence
  targeting sequence with ATCN PAM
cuugagccgggaguuagaga

SEQ ID NO: 2884 - RNA, 20 nt, Artificial Sequence
  targeting sequence with ATCN PAM
gacugggacugguccugauc

SEQ ID NO: 2885 - RNA, 20 nt, Artificial Sequence
  targeting sequence with ATCN PAM
ggaccagucccagucagaug

SEQ ID NO: 2886 - RNA, 20 nt, Artificial Sequence
  targeting sequence with ATCN PAM
cucaucuccaagugcucaac

SEQ ID NO: 2887 - RNA, 20 nt, Artificial Sequence
  targeting sequence with ATCN PAM
ccaagugcucaacauugugc

SEQ ID NO: 2888 - RNA, 20 nt, Artificial Sequence
  targeting sequence with ATCN PAM
guccccagcaaggcugugaa

SEQ ID NO: 2889 - RNA, 20 nt, Artificial Sequence
  targeting sequence with ATCN PAM
gggaggcucgggguaagcac

SEQ ID NO: 2890 - RNA, 20 nt, Artificial Sequence
  targeting sequence with ATCN PAM
gcagggggagaaucagggag

SEQ ID NO: 2891 - RNA, 20 nt, Artificial Sequence
  targeting sequence with ATCN PAM
agaacacuggccugguaugg

SEQ ID NO: 2892 - RNA, 20 nt, Artificial Sequence
  targeting sequence with ATCN PAM
ccagcacgccacccuggggg

SEQ ID NO: 2893 - RNA, 20 nt, Artificial Sequence
  targeting sequence with ATCN PAM
cucauguuuaguuuccgauc

SEQ ID NO: 2894 - RNA, 20 nt, Artificial Sequence
  targeting sequence with ATCN PAM
gaaacuaaacaugagagaug

SEQ ID NO: 2895 - RNA, 20 nt, Artificial Sequence
  targeting sequence with ATCN PAM
guacccccugagacugggag

SEQ ID NO: 2896 - RNA, 20 nt, Artificial Sequence
  targeting sequence with ATCN PAM
cacaugguuccugcuuucaa

SEQ ID NO: 2897 - RNA, 20 nt, Artificial Sequence
  targeting sequence with ATCN PAM
accucagcguccccagggcc

SEQ ID NO: 2898 - RNA, 20 nt, Artificial Sequence
  targeting sequence with ATCN PAM
agggggaauaagggagggag

SEQ ID NO: 2899 - RNA, 20 nt, Artificial Sequence
  targeting sequence with ATCN PAM
uucuccuccuucuccuccuc

SEQ ID NO: 2900 - RNA, 20 nt, Artificial Sequence
  targeting sequence with ATCN PAM
cucuucagccucugcaagag

SEQ ID NO: 2901 - RNA, 20 nt, Artificial Sequence
  targeting sequence with ATCN PAM
accgaggcaaaggcaaagcc

SEQ ID NO: 2902 - RNA, 20 nt, Artificial Sequence
  targeting sequence with ATCN PAM
uggggcacccgagucccagc

SEQ ID NO: 2903 - RNA, 20 nt, Artificial Sequence
  targeting sequence with ATCN PAM
agccaucuuggcuuagaaag

SEQ ID NO: 2904 - RNA, 20 nt, Artificial Sequence
  targeting sequence with ATCN PAM
uggcuuagaaagccccccac

SEQ ID NO: 2905 - RNA, 20 nt, Artificial Sequence
  targeting sequence with ATCN PAM
cagcucugcagaggaacuuu

SEQ ID NO: 2906 - RNA, 20 nt, Artificial Sequence
  targeting sequence with ATCN PAM
gggguaugcagggucaaagu

SEQ ID NO: 2907 - RNA, 20 nt, Artificial Sequence
  targeting sequence with ATCN PAM
cugccucugagcucacaacc

SEQ ID NO: 2908 - RNA, 20 nt, Artificial Sequence
  targeting sequence with ATCN PAM
auuucuagaaugcaggacca

SEQ ID NO: 2909 - RNA, 20 nt, Artificial Sequence
  targeting sequence with ATCN PAM
cgaguaacugggucuacagg

SEQ ID NO: 2910 - RNA, 20 nt, Artificial Sequence
  targeting sequence with ATCN PAM
uccuaccucagcaucccgag

SEQ ID NO: 2911 - RNA, 20 nt, Artificial Sequence
  targeting sequence with ATCN PAM
cuugagccuaggacaggaau

SEQ ID NO: 2912 - RNA, 20 nt, Artificial Sequence
  targeting sequence with ATCN PAM
uagcuuacugcagccuugaa

SEQ ID NO: 2913 - RNA, 20 nt, Artificial Sequence
  targeting sequence with ATCN PAM
cuaaaaaacauuuaaaaauu

SEQ ID NO: 2914 - RNA, 20 nt, Artificial Sequence
  targeting sequence with ATCN PAM
cauuugucuucuuaaaacaa

SEQ ID NO: 2915 - RNA, 20 nt, Artificial Sequence
  targeting sequence with ATCN PAM
gcgacuaucucauuugucuu

SEQ ID NO: 2916 - RNA, 20 nt, Artificial Sequence
  targeting sequence with ATCN PAM
cagcacuuugggaggcugag

SEQ ID NO: 2917 - RNA, 20 nt, Artificial Sequence
  targeting sequence with ATCN PAM
cagccucccaaagugcugag

SEQ ID NO: 2918 - RNA, 20 nt, Artificial Sequence
  targeting sequence with ATCN PAM
uccugccuugggagccacuu

SEQ ID NO: 2919 - RNA, 20 nt, Artificial Sequence
  targeting sequence with ATCN PAM
cuugagccugggaguuagag

SEQ ID NO: 2920 - RNA, 20 nt, Artificial Sequence
  targeting sequence with ATCN PAM
uggcucacugcagccucaac

SEQ ID NO: 2921 - RNA, 20 nt, Artificial Sequence
  targeting sequence with ATCN PAM
ugccgcugcacuccaaccug

SEQ ID NO: 2922 - RNA, 20 nt, Artificial Sequence
  targeting sequence with ATCN PAM
cucugugacucagguuggag

SEQ ID NO: 2923 - RNA, 20 nt, Artificial Sequence
  targeting sequence with ATCN PAM
gccucggccucccaaagugc

SEQ ID NO: 2924 - RNA, 20 nt, Artificial Sequence
  targeting sequence with ATCN PAM
auccgccucggccucccaaa

SEQ ID NO: 2925 - RNA, 20 nt, Artificial Sequence
  targeting sequence with ATCN PAM
cuugagaucaggaguuagag

SEQ ID NO: 2926 - RNA, 20 nt, Artificial Sequence
  targeting sequence with ATCN PAM
caagugauccauccgccucg

SEQ ID NO: 2927 - RNA, 20 nt, Artificial Sequence
  targeting sequence with ATCN PAM
ggaguuagagaccagccugg

SEQ ID NO: 2928 - RNA, 20 nt, Artificial Sequence
  targeting sequence with ATCN PAM
ugucuguacuaaaaauauaa

SEQ ID NO: 2929 - RNA, 20 nt, Artificial Sequence
  targeting sequence with ATCN PAM
cuugaacccaggaagaggag

SEQ ID NO: 2930 - RNA, 20 nt, Artificial Sequence
  targeting sequence with ATCN PAM
uggcucacugcaaccuccuc

SEQ ID NO: 2931 - RNA, 20 nt, Artificial Sequence
  targeting sequence with ATCN PAM
caccacugcacuccagcuug

SEQ ID NO: 2932 - RNA, 20 nt, Artificial Sequence
  targeting sequence with ATCN PAM
uacacaccaggcacccccac

SEQ ID NO: 2933 - RNA, 20 nt, Artificial Sequence
  targeting sequence with ATCN PAM
cuuccugagucuccuucagg

SEQ ID NO: 2934 - RNA, 20 nt, Artificial Sequence
  targeting sequence with ATCN PAM
auauauuuguugcugacagu

SEQ ID NO: 2935 - RNA, 20 nt, Artificial Sequence
  targeting sequence with ATCN PAM
cuuacaagcacucccaauaa

SEQ ID NO: 2936 - RNA, 20 nt, Artificial Sequence
  targeting sequence with ATCN PAM
uauuagguaggcacuauuau

SEQ ID NO: 2937 - RNA, 20 nt, Artificial Sequence
  targeting sequence with ATCN PAM
uucccauuuuacagagugga

SEQ ID NO: 2938 - RNA, 20 nt, Artificial Sequence
  targeting sequence with ATCN PAM
ggacugaggcuacacagccu

SEQ ID NO: 2939 - RNA, 20 nt, Artificial Sequence
  targeting sequence with ATCN PAM
uuagacccuauggccuuggu

SEQ ID NO: 2940 - RNA, 20 nt, Artificial Sequence
  targeting sequence with ATCN PAM
auacaguaaaccucaccugc

SEQ ID NO: 2941 - RNA, 20 nt, Artificial Sequence
  targeting sequence with ATCN PAM
agccuccucuccucgaggcu

SEQ ID NO: 2942 - RNA, 20 nt, Artificial Sequence
  targeting sequence with ATCN PAM
uugaugaggggagggaggca

SEQ ID NO: 2943 - RNA, 20 nt, Artificial Sequence
  targeting sequence with ATCN PAM
aagauagcucucaggaaaga

SEQ ID NO: 2944 - RNA, 20 nt, Artificial Sequence
  targeting sequence with ATCN PAM
gcuucccaaaccuggcuaug

SEQ ID NO: 2945 - RNA, 20 nt, Artificial Sequence
  targeting sequence with ATCN PAM
gugacagccugggcuauaac

SEQ ID NO: 2946 - RNA, 20 nt, Artificial Sequence
  targeting sequence with ATCN PAM
gcaaaauggauauagcagag

SEQ ID NO: 2947 - RNA, 20 nt, Artificial Sequence
  targeting sequence with ATCN PAM
auuuugcagaugaaaagacu

SEQ ID NO: 2948 - RNA, 20 nt, Artificial Sequence
  targeting sequence with ATCN PAM
cugcuauauccauuuugcag

SEQ ID NO: 2949 - RNA, 20 nt, Artificial Sequence
  targeting sequence with ATCN PAM
uggcacuuugggaggccgag

SEQ ID NO: 2950 - RNA, 20 nt, Artificial Sequence
  targeting sequence with ATCN PAM
acccuccucggccucccaaa

SEQ ID NO: 2951 - RNA, 20 nt, Artificial Sequence
  targeting sequence with ATCN PAM
cuugagccaggaguucagga

SEQ ID NO: 2952 - RNA, 20 nt, Artificial Sequence
  targeting sequence with ATCN PAM
ucucaccucagccuccugag

SEQ ID NO: 2953 - RNA, 20 nt, Artificial Sequence
  targeting sequence with ATCN PAM
cuugagcccaggaggcagag

SEQ ID NO: 2954 - RNA, 20 nt, Artificial Sequence
  targeting sequence with ATCN PAM
uagcucacuguagccucugc

SEQ ID NO: 2955 - RNA, 20 nt, Artificial Sequence
  targeting sequence with ATCN PAM
cugaggugacagugcucuuu

SEQ ID NO: 2956 - RNA, 20 nt, Artificial Sequence
  targeting sequence with ATCN PAM
ccagggcuccaugagguugc

SEQ ID NO: 2957 - RNA, 20 nt, Artificial Sequence
  targeting sequence with ATCN PAM
caguacuuccccucucuguc

SEQ ID NO: 2958 - RNA, 20 nt, Artificial Sequence
  targeting sequence with ATCN PAM
ucuagguccauucccccacu

SEQ ID NO: 2959 - RNA, 20 nt, Artificial Sequence
  targeting sequence with ATCN PAM
agguccauucccccacucac

SEQ ID NO: 2960 - RNA, 20 nt, Artificial Sequence
  targeting sequence with ATCN PAM
gugaacaaaacagacaucau

SEQ ID NO: 2961 - RNA, 20 nt, Artificial Sequence
  targeting sequence with ATCN PAM
ucccaccucuuuccacuaca

SEQ ID NO: 2962 - RNA, 20 nt, Artificial Sequence
  targeting sequence with ATCN PAM
caccucuuuccacuacaggc

SEQ ID NO: 2963 - RNA, 20 nt, Artificial Sequence
  targeting sequence with ATCN PAM
ugcuuuuugcauagugcuuc

SEQ ID NO: 2964 - RNA, 20 nt, Artificial Sequence
  targeting sequence with ATCN PAM
cacacagcuuagcaguaccu

SEQ ID NO: 2965 - RNA, 20 nt, Artificial Sequence
  targeting sequence with ATCN PAM
aggacacccuccuucuggcc

SEQ ID NO: 2966 - RNA, 20 nt, Artificial Sequence
  targeting sequence with ATCN PAM
aacccucaccuuaaccucau

SEQ ID NO: 2967 - RNA, 20 nt, Artificial Sequence
  targeting sequence with ATCN PAM
ccaggccaagcgccuuaaac

SEQ ID NO: 2968 - RNA, 20 nt, Artificial Sequence
  targeting sequence with ATCN PAM
cacccgcccugccuuagccc

SEQ ID NO: 2969 - RNA, 20 nt, Artificial Sequence
  targeting sequence with ATCN PAM
gucugcucagaagagugccc

SEQ ID NO: 2970 - RNA, 20 nt, Artificial Sequence
  targeting sequence with ATCN PAM
gggaauccugggugggaaga

SEQ ID NO: 2971 - RNA, 20 nt, Artificial Sequence
  targeting sequence with ATCN PAM
ugggugggaagagagacagu

SEQ ID NO: 2972 - RNA, 20 nt, Artificial Sequence
  targeting sequence with ATCN PAM
cucucucacugucucucuuc

SEQ ID NO: 2973 - RNA, 20 nt, Artificial Sequence
  targeting sequence with ATCN PAM
cuuaaucucucucucacugu

SEQ ID NO: 2974 - RNA, 20 nt, Artificial Sequence
  targeting sequence with ATCN PAM
gggcuuugcacucucagggg

SEQ ID NO: 2975 - RNA, 20 nt, Artificial Sequence
  targeting sequence with ATCN PAM
aggcggaaggaccccugaga

SEQ ID NO: 2976 - RNA, 20 nt, Artificial Sequence
  targeting sequence with ATCN PAM
uguugcuuggacgacgggga

SEQ ID NO: 2977 - RNA, 20 nt, Artificial Sequence
  targeting sequence with ATCN PAM
gcccccaaggcucugacuac

SEQ ID NO: 2978 - RNA, 20 nt, Artificial Sequence
  targeting sequence with ATCN PAM
ugcuauucuggaaucggccc

SEQ ID NO: 2979 - RNA, 20 nt, Artificial Sequence
  targeting sequence with ATCN PAM
gcccucguggggccaccugg

SEQ ID NO: 2980 - RNA, 20 nt, Artificial Sequence
  targeting sequence with ATCN PAM
gccacgagggccucaaaugc

SEQ ID NO: 2981 - RNA, 20 nt, Artificial Sequence
  targeting sequence with ATCN PAM
ucccucccuccacuccaucu

SEQ ID NO: 2982 - RNA, 20 nt, Artificial Sequence
  targeting sequence with ATCN PAM
uugggggcauuugagucacc

SEQ ID NO: 2983 - RNA, 20 nt, Artificial Sequence
  targeting sequence with ATCN PAM
cugguguagaaaggugacuc

SEQ ID NO: 2984 - RNA, 20 nt, Artificial Sequence
  targeting sequence with ATCN PAM
gcccaagccacugcucacuu

SEQ ID NO: 2985 - RNA, 20 nt, Artificial Sequence
  targeting sequence with ATCN PAM
agaggaaagugagcaguggc

SEQ ID NO: 2986 - RNA, 20 nt, Artificial Sequence
  targeting sequence with ATCN PAM
gggcugggggcaguuguaau

SEQ ID NO: 2987 - RNA, 20 nt, Artificial Sequence
  targeting sequence with ATCN PAM
uccccaccuagccaccuggc

SEQ ID NO: 2988 - RNA, 20 nt, Artificial Sequence
  targeting sequence with ATCN PAM
gcuucuucccacauuugagu

SEQ ID NO: 2989 - RNA, 20 nt, Artificial Sequence
  targeting sequence with ATCN PAM
uuguauucccaggggccugc

SEQ ID NO: 2990 - RNA, 20 nt, Artificial Sequence
  targeting sequence with ATCN PAM
uuguugcauggaauuggaau

SEQ ID NO: 2991 - RNA, 20 nt, Artificial Sequence
  targeting sequence with ATCN PAM
aguccccacacuccucugac

SEQ ID NO: 2992 - RNA, 20 nt, Artificial Sequence
  targeting sequence with ATCN PAM
cgucacacagccccuuaccu

SEQ ID NO: 2993 - RNA, 20 nt, Artificial Sequence
  targeting sequence with ATCN PAM
aggaaaagggaggagaaggu

SEQ ID NO: 2994 - RNA, 20 nt, Artificial Sequence
  targeting sequence with ATCN PAM
ugaguaccucuccucccuga

SEQ ID NO: 2995 - RNA, 20 nt, Artificial Sequence
  targeting sequence with ATCN PAM
ccgcugcagaaacugagggc

SEQ ID NO: 2996 - RNA, 20 nt, Artificial Sequence
  targeting sequence with ATCN PAM
uauuaauccccgcugcagaa

SEQ ID NO: 2997 - RNA, 20 nt, Artificial Sequence
  targeting sequence with ATCN PAM
cccagaugcugauucagcca

SEQ ID NO: 2998 - RNA, 20 nt, Artificial Sequence
  targeting sequence with ATCN PAM
gggagauuggggguguucau

SEQ ID NO: 2999 - RNA, 20 nt, Artificial Sequence
  targeting sequence with ATCN PAM
gcaucugggagauugggggu

SEQ ID NO: 3000 - RNA, 20 nt, Artificial Sequence
  targeting sequence with ATCN PAM
agcuggagcccugaguggcu

SEQ ID NO: 3001 - RNA, 20 nt, Artificial Sequence
  targeting sequence with ATCN PAM
gcagaaacauguaggcggcc

SEQ ID NO: 3002 - RNA, 20 nt, Artificial Sequence
  targeting sequence with ATCN PAM
ugcugggcuuccccaucaac

SEQ ID NO: 3003 - RNA, 20 nt, Artificial Sequence
  targeting sequence with ATCN PAM
acuuccucacgcucuacguc

SEQ ID NO: 3004 - RNA, 20 nt, Artificial Sequence
  targeting sequence with ATCN PAM
ugcucaaccuagccguggcu

SEQ ID NO: 3005 - RNA, 20 nt, Artificial Sequence
  targeting sequence with ATCN PAM
augcagagagguguagaggg

SEQ ID NO: 3006 - RNA, 20 nt, Artificial Sequence
  targeting sequence with ATCN PAM
ugugggcccgaagacgaagu

SEQ ID NO: 3007 - RNA, 20 nt, Artificial Sequence
  targeting sequence with ATCN PAM
aaagcccucauauauucagu

SEQ ID NO: 3008 - RNA, 20 nt, Artificial Sequence
  targeting sequence with ATCN PAM
ccaugaaugguguuuguuga

SEQ ID NO: 3009 - RNA, 20 nt, Artificial Sequence
  targeting sequence with ATCN PAM
aggcaguguucagugccagc

SEQ ID NO: 3010 - RNA, 20 nt, Artificial Sequence
  targeting sequence with ATCN PAM
uauuuggagcaauaugcgcu

SEQ ID NO: 3011 - RNA, 20 nt, Artificial Sequence
  targeting sequence with ATCN PAM
aucucgggccauguuugcag

SEQ ID NO: 3012 - RNA, 20 nt, Artificial Sequence
  targeting sequence with ATCN PAM
cgggccauguuugcagcacc

SEQ ID NO: 3013 - RNA, 20 nt, Artificial Sequence
  targeting sequence with ATCN PAM
acuucccacccugagcuugg

SEQ ID NO: 3014 - RNA, 20 nt, Artificial Sequence
  targeting sequence with ATCN PAM
ucugccuccccucucagccc

SEQ ID NO: 3015 - RNA, 20 nt, Artificial Sequence
  targeting sequence with ATCN PAM
guuuuccuguuaaaugcaag

SEQ ID NO: 3016 - RNA, 20 nt, Artificial Sequence
  targeting sequence with ATCN PAM
cugcagcaccccaucuguuu

SEQ ID NO: 3017 - RNA, 20 nt, Artificial Sequence
  targeting sequence with ATCN PAM
guuaucccugcagcacccca

SEQ ID NO: 3018 - RNA, 20 nt, Artificial Sequence
  targeting sequence with ATCN PAM
cacuuaacagagaggaaaac

SEQ ID NO: 3019 - RNA, 20 nt, Artificial Sequence
  targeting sequence with ATCN PAM
cuaaaugagucucuuccccu

SEQ ID NO: 3020 - RNA, 20 nt, Artificial Sequence
  targeting sequence with ATCN PAM
cagccaggagaccuaggcuc

SEQ ID NO: 3021 - RNA, 20 nt, Artificial Sequence
  targeting sequence with ATCN PAM
aggaauaucucugcugagau

SEQ ID NO: 3022 - RNA, 20 nt, Artificial Sequence
  targeting sequence with ATCN PAM
cugcugagaugcaggaggag

SEQ ID NO: 3023 - RNA, 20 nt, Artificial Sequence
  targeting sequence with ATCN PAM
cagcagagauauuccuggau

SEQ ID NO: 3024 - RNA, 20 nt, Artificial Sequence
  targeting sequence with ATCN PAM
cuggccauuguuggguguuu

SEQ ID NO: 3025 - RNA, 20 nt, Artificial Sequence
  targeting sequence with ATCN PAM
cagaucacucaguucuggcc

SEQ ID NO: 3026 - RNA, 20 nt, Artificial Sequence
  targeting sequence with ATCN PAM
gugauuauugaaugcaacaa

SEQ ID NO: 3027 - RNA, 20 nt, Artificial Sequence
  targeting sequence with ATCN PAM
cucaguucuggccagaaggu

SEQ ID NO: 3028 - RNA, 20 nt, Artificial Sequence
  targeting sequence with ATCN PAM
accaaacugggacauuccua

SEQ ID NO: 3029 - RNA, 20 nt, Artificial Sequence
  targeting sequence with ATCN PAM
guccugcucaccaccccaug

SEQ ID NO: 3030 - RNA, 20 nt, Artificial Sequence
  targeting sequence with ATCN PAM
uuuccuucuucuuccucugg

SEQ ID NO: 3031 - RNA, 20 nt, Artificial Sequence
  targeting sequence with ATCN PAM
uaauguggggcagaguuccu

SEQ ID NO: 3032 - RNA, 20 nt, Artificial Sequence
  targeting sequence with ATCN PAM
ugacccccugaucugauucg

SEQ ID NO: 3033 - RNA, 20 nt, Artificial Sequence
  targeting sequence with ATCN PAM
gggggucaggauugaacugg

SEQ ID NO: 3034 - RNA, 20 nt, Artificial Sequence
  targeting sequence with ATCN PAM
gauucgugucccuuaugggc

SEQ ID NO: 3035 - RNA, 20 nt, Artificial Sequence
  targeting sequence with ATCN PAM
gaucagggggucaggauuga

SEQ ID NO: 3036 - RNA, 20 nt, Artificial Sequence
  targeting sequence with ATCN PAM
cucucccacuccugguugcc

SEQ ID NO: 3037 - RNA, 20 nt, Artificial Sequence
  targeting sequence with ATCN PAM
agcgguacgugguggugugu

SEQ ID NO: 3038 - RNA, 20 nt, Artificial Sequence
  targeting sequence with ATCN PAM
ugggcguugccuucaccugg

SEQ ID NO: 3039 - RNA, 20 nt, Artificial Sequence
  targeting sequence with ATCN PAM
ccugagccccaugucaaaca

SEQ ID NO: 3040 - RNA, 20 nt, Artificial Sequence
  targeting sequence with ATCN PAM
aagacaucccaacccuucac

SEQ ID NO: 3041 - RNA, 20 nt, Artificial Sequence
  targeting sequence with ATCN PAM
caacccuucaccuuggcugu

SEQ ID NO: 3042 - RNA, 20 nt, Artificial Sequence
  targeting sequence with ATCN PAM
ucaacuaagcuaggcgcaaa

SEQ ID NO: 3043 - RNA, 20 nt, Artificial Sequence
  targeting sequence with ATCN PAM
ucuuuggucuaguaccccgg

SEQ ID NO: 3044 - RNA, 20 nt, Artificial Sequence
  targeting sequence with ATCN PAM
ccuagaggcugagugggacc

SEQ ID NO: 3045 - RNA, 20 nt, Artificial Sequence
  targeting sequence with ATCN PAM
cagccccauuaggagacaau

SEQ ID NO: 3046 - RNA, 20 nt, Artificial Sequence
  targeting sequence with ATCN PAM
ucuccaaucuggccuaguuc

SEQ ID NO: 3047 - RNA, 20 nt, Artificial Sequence
  targeting sequence with ATCN PAM
ggccuaguucuauccucugg

SEQ ID NO: 3048 - RNA, 20 nt, Artificial Sequence
  targeting sequence with ATCN PAM
ucuggaagcagagccgcugg

SEQ ID NO: 3049 - RNA, 20 nt, Artificial Sequence
  targeting sequence with ATCN PAM
ggaaccauugccacguccua

SEQ ID NO: 3050 - RNA, 20 nt, Artificial Sequence
  targeting sequence with ATCN PAM
uugugcagcuucuggaaacu

SEQ ID NO: 3051 - RNA, 20 nt, Artificial Sequence
  targeting sequence with ATCN PAM
cuuagauacucugugugucc

SEQ ID NO: 3052 - RNA, 20 nt, Artificial Sequence
  targeting sequence with ATCN PAM
aagggaucuuugugcagcuu

SEQ ID NO: 3053 - RNA, 20 nt, Artificial Sequence
  targeting sequence with ATCN PAM
uuggccuggaaaauacucuc

SEQ ID NO: 3054 - RNA, 20 nt, Artificial Sequence
  targeting sequence with ATCN PAM
acugcccgcugaggcuaggg

SEQ ID NO: 3055 - RNA, 20 nt, Artificial Sequence
  targeting sequence with ATCN PAM
gguaacgcagccaccaaaca

SEQ ID NO: 3056 - RNA, 20 nt, Artificial Sequence
  targeting sequence with ATCN PAM
gugucgcuucauuguuuggu

SEQ ID NO: 3057 - RNA, 20 nt, Artificial Sequence
  targeting sequence with ATCN PAM
gcauccccaucugauccauu

SEQ ID NO: 3058 - RNA, 20 nt, Artificial Sequence
  targeting sequence with ATCN PAM
ccaucugauccauuccaucc

SEQ ID NO: 3059 - RNA, 20 nt, Artificial Sequence
  targeting sequence with ATCN PAM
gauccauuccauccugucac

SEQ ID NO: 3060 - RNA, 20 nt, Artificial Sequence
  targeting sequence with ATCN PAM
gauggggaugcagaugcacc

SEQ ID NO: 3061 - RNA, 20 nt, Artificial Sequence
  targeting sequence with ATCN PAM
auuccauccugucacccagc

SEQ ID NO: 3062 - RNA, 20 nt, Artificial Sequence
  targeting sequence with ATCN PAM
ugucacccagccaugcagac

SEQ ID NO: 3063 - RNA, 20 nt, Artificial Sequence
  targeting sequence with ATCN PAM
uaaacgucugcauggcuggg

SEQ ID NO: 3064 - RNA, 20 nt, Artificial Sequence
  targeting sequence with ATCN PAM
ccuuuuccagggagggaaug

SEQ ID NO: 3065 - RNA, 20 nt, Artificial Sequence
  targeting sequence with ATCN PAM
ccgagggccugcagugcucg

SEQ ID NO: 3066 - RNA, 20 nt, Artificial Sequence
  targeting sequence with ATCN PAM
acuacuacacgcucaagccg

SEQ ID NO: 3067 - RNA, 20 nt, Artificial Sequence
  targeting sequence with ATCN PAM
acauguucgugguccacuuc

SEQ ID NO: 3068 - RNA, 20 nt, Artificial Sequence
  targeting sequence with ATCN PAM
ccaugauuaucaucuuuuuc

SEQ ID NO: 3069 - RNA, 20 nt, Artificial Sequence
  targeting sequence with ATCN PAM
uggggauggugaaguggacc

SEQ ID NO: 3070 - RNA, 20 nt, Artificial Sequence
  targeting sequence with ATCN PAM
ucuuuuucugcuaugggcag

SEQ ID NO: 3071 - RNA, 20 nt, Artificial Sequence
  targeting sequence with ATCN PAM
uuuucugcuaugggcagcuc

SEQ ID NO: 3072 - RNA, 20 nt, Artificial Sequence
  targeting sequence with ATCN PAM
gcggcuccugcucccuggag

SEQ ID NO: 3073 - RNA, 20 nt, Artificial Sequence
  targeting sequence with ATCN PAM
ucauggucaucgcuuuccug

SEQ ID NO: 3074 - RNA, 20 nt, Artificial Sequence
  targeting sequence with ATCN PAM
uggucaucgcuuuccugauc

SEQ ID NO: 3075 - RNA, 20 nt, Artificial Sequence
  targeting sequence with ATCN PAM
cuuuccugaucugcugggug

SEQ ID NO: 3076 - RNA, 20 nt, Artificial Sequence
  targeting sequence with ATCN PAM
ggaaagcgaugaccaugaug

SEQ ID NO: 3077 - RNA, 20 nt, Artificial Sequence
  targeting sequence with ATCN PAM
gcugggugcccuacgccagc

SEQ ID NO: 3078 - RNA, 20 nt, Artificial Sequence
  targeting sequence with ATCN PAM
ucacccaccagggcuccaac

SEQ ID NO: 3079 - RNA, 20 nt, Artificial Sequence
  targeting sequence with ATCN PAM
ucaugaccaucccagcguuc

SEQ ID NO: 3080 - RNA, 20 nt, Artificial Sequence
  targeting sequence with ATCN PAM
cagcguucuuugccaagagc

SEQ ID NO: 3081 - RNA, 20 nt, Artificial Sequence
  targeting sequence with ATCN PAM
acaacccugucaucuauauc

SEQ ID NO: 3082 - RNA, 20 nt, Artificial Sequence
  targeting sequence with ATCN PAM
auaucaugaugaacaagcag

SEQ ID NO: 3083 - RNA, 20 nt, Artificial Sequence
  targeting sequence with ATCN PAM
ugaugaacaagcaggugccu

SEQ ID NO: 3084 - RNA, 20 nt, Artificial Sequence
  targeting sequence with ATCN PAM
ugauauagaugacaggguug

SEQ ID NO: 3085 - RNA, 20 nt, Artificial Sequence
  targeting sequence with ATCN PAM
ggguuacuggcagcagucuu

SEQ ID NO: 3086 - RNA, 20 nt, Artificial Sequence
  targeting sequence with ATCN PAM
gcauuucucacacacucccc

SEQ ID NO: 3087 - RNA, 20 nt, Artificial Sequence
  targeting sequence with ATCN PAM
cagggugggcccaggaaccu

SEQ ID NO: 3088 - RNA, 20 nt, Artificial Sequence
  targeting sequence with ATCN PAM
gagccaccuguggagggcuu

SEQ ID NO: 3089 - RNA, 20 nt, Artificial Sequence
  targeting sequence with ATCN PAM
cauucccgacuuggguccuu

SEQ ID NO: 3090 - RNA, 20 nt, Artificial Sequence
  targeting sequence with ATCN PAM
auagaaagguagaaagggca

SEQ ID NO: 3091 - RNA, 20 nt, Artificial Sequence
  targeting sequence with ATCN PAM
aagaguuugguguuuugccc

SEQ ID NO: 3092 - RNA, 20 nt, Artificial Sequence
  targeting sequence with ATCN PAM
cuuguaauccaagaguuugg

SEQ ID NO: 3093 - RNA, 20 nt, Artificial Sequence
  targeting sequence with ATCN PAM
cuaggggugaggagcgucug

SEQ ID NO: 3094 - RNA, 20 nt, Artificial Sequence
  targeting sequence with ATCN PAM
agcuuccuggagggaaccug

SEQ ID NO: 3095 - RNA, 20 nt, Artificial Sequence
  targeting sequence with ATCN PAM
acucaaauccagcuuccugg

SEQ ID NO: 3096 - RNA, 20 nt, Artificial Sequence
  targeting sequence with ATCN PAM
ugaggggcagaagcaggcaa

SEQ ID NO: 3097 - RNA, 20 nt, Artificial Sequence
  targeting sequence with ATCN PAM
gcugcggcaagaacccacug

SEQ ID NO: 3098 - RNA, 20 nt, Artificial Sequence
  targeting sequence with ATCN PAM
ucacccaguggguucuugcc

SEQ ID NO: 3099 - RNA, 20 nt, Artificial Sequence
  targeting sequence with ATCN PAM
ccuacaccuucccccagcca

SEQ ID NO: 3100 - RNA, 20 nt, Artificial Sequence
  targeting sequence with ATCN PAM
caccaggagcagcgccugug

SEQ ID NO: 3101 - RNA, 20 nt, Artificial Sequence
  targeting sequence with ATCN PAM
accaagaccuacugaucugg

SEQ ID NO: 3102 - RNA, 20 nt, Artificial Sequence
  targeting sequence with ATCN PAM
guaggucuugguggaugucc

SEQ ID NO: 3103 - RNA, 20 nt, Artificial Sequence
  targeting sequence with ATCN PAM
ggagucccacguuccccaag

SEQ ID NO: 3104 - RNA, 20 nt, Artificial Sequence
  targeting sequence with ATCN PAM
cgcuggccuuggggaacgug

SEQ ID NO: 3105 - RNA, 20 nt, Artificial Sequence
  targeting sequence with ATCN PAM
uucaggaacacgaggauucu

SEQ ID NO: 3106 - RNA, 20 nt, Artificial Sequence
  targeting sequence with ATCN PAM
ucguguuccugaaagaugag

SEQ ID NO: 3107 - RNA, 20 nt, Artificial Sequence
  targeting sequence with ATCN PAM
cuaagcugggacacuuuucc

SEQ ID NO: 3108 - RNA, 20 nt, Artificial Sequence
  targeting sequence with ATCN PAM
agcauuuauuaagcaccuac

SEQ ID NO: 3109 - RNA, 20 nt, Artificial Sequence
  targeting sequence with ATCN PAM
auccagcauuuauuaagcac

SEQ ID NO: 3110 - RNA, 20 nt, Artificial Sequence
  targeting sequence with ATCN PAM
auccucucagacccucgcag

SEQ ID NO: 3111 - RNA, 20 nt, Artificial Sequence
  targeting sequence with ATCN PAM
ucucagacccucgcagcagc

SEQ ID NO: 3112 - RNA, 20 nt, Artificial Sequence
  targeting sequence with ATCN PAM
uuagccaaguaugaguugcu

SEQ ID NO: 3113 - RNA, 20 nt, Artificial Sequence
  targeting sequence with ATCN PAM
cagaucccugguccugccga

SEQ ID NO: 3114 - RNA, 20 nt, Artificial Sequence
  targeting sequence with ATCN PAM
gggauuuccauuuuauagga

SEQ ID NO: 3115 - RNA, 20 nt, Artificial Sequence
  targeting sequence with ATCN PAM
cugguccugccgacacgcag

SEQ ID NO: 3116 - RNA, 20 nt, Artificial Sequence
  targeting sequence with ATCN PAM
guacagcuucuugcuauuua

SEQ ID NO: 3117 - RNA, 20 nt, Artificial Sequence
  targeting sequence with ATCN PAM
auuaauguaacuaguuaauu

SEQ ID NO: 3118 - RNA, 20 nt, Artificial Sequence
  targeting sequence with ATCN PAM
uaguaauuaacuaguuacau

SEQ ID NO: 3119 - RNA, 20 nt, Artificial Sequence
  targeting sequence with ATCN PAM
ccuccugauagugaacauuu

SEQ ID NO: 3120 - RNA, 20 nt, Artificial Sequence
  targeting sequence with ATCN PAM
ggaggugauaaucauaguaa

SEQ ID NO: 3121 - RNA, 20 nt, Artificial Sequence
  targeting sequence with ATCN PAM
caaaauguucacuaucagga

SEQ ID NO: 3122 - RNA, 20 nt, Artificial Sequence
  targeting sequence with ATCN PAM
gaaugcccaaucucaaaaug

SEQ ID NO: 3123 - RNA, 20 nt, Artificial Sequence
  targeting sequence with ATCN PAM
ucugaaugcccaaucucaaa

SEQ ID NO: 3124 - RNA, 20 nt, Artificial Sequence
  targeting sequence with ATCN PAM
aggccagaccagggcugggg

SEQ ID NO: 3125 - RNA, 20 nt, Artificial Sequence
  targeting sequence with ATCN PAM
gaccugaaaaaacaacacug

SEQ ID NO: 3126 - RNA, 20 nt, Artificial Sequence
  targeting sequence with ATCN PAM
cacccucauugggaacuugg

SEQ ID NO: 3127 - RNA, 20 nt, Artificial Sequence
  targeting sequence with ATCN PAM
agagcauggagccucuagaa

SEQ ID NO: 3128 - RNA, 20 nt, Artificial Sequence
  targeting sequence with ATCN PAM
gggacucagcuguuaauuaa

SEQ ID NO: 3129 - RNA, 20 nt, Artificial Sequence
  targeting sequence with ATCN PAM
uuaucucgaagagcuuagaa

SEQ ID NO: 3130 - RNA, 20 nt, Artificial Sequence
  targeting sequence with ATCN PAM
cgaagagcuuagaaacaaag

SEQ ID NO: 3131 - RNA, 20 nt, Artificial Sequence
  targeting sequence with ATCN PAM
ccaaggaagguaggcccagu

SEQ ID NO: 3132 - RNA, 20 nt, Artificial Sequence
  targeting sequence with ATCN PAM
ucagcaguugcuaguccauu

SEQ ID NO: 3133 - RNA, 20 nt, Artificial Sequence
  targeting sequence with ATCN PAM
gcuccaaaaagcuggccaca

SEQ ID NO: 3134 - RNA, 20 nt, Artificial Sequence
  targeting sequence with ATCN PAM
cugaggugucagaauuaagc

SEQ ID NO: 3135 - RNA, 20 nt, Artificial Sequence
  targeting sequence with ATCN PAM
acaggauagauugaaacugc

SEQ ID NO: 3136 - RNA, 20 nt, Artificial Sequence
  targeting sequence with ATCN PAM
uguggauagagugugaaagc

SEQ ID NO: 3137 - RNA, 20 nt, Artificial Sequence
  targeting sequence with ATCN PAM
auccuguggauagaguguga

SEQ ID NO: 3138 - RNA, 20 nt, Artificial Sequence
  targeting sequence with ATCN PAM
gguggaagcuggcaguuuca

SEQ ID NO: 3139 - RNA, 20 nt, Artificial Sequence
  targeting sequence with ATCN PAM
cugacccugggauggcugga

SEQ ID NO: 3140 - RNA, 20 nt, Artificial Sequence
  targeting sequence with ATCN PAM
cagggucagggaucaggugg

SEQ ID NO: 3141 - RNA, 20 nt, Artificial Sequence
  targeting sequence with ATCN PAM
agccaucccagggucaggga

SEQ ID NO: 3142 - RNA, 20 nt, Artificial Sequence
  targeting sequence with ATCN PAM
gcaaaaaagaaucuuaaaac

SEQ ID NO: 3143 - RNA, 20 nt, Artificial Sequence
  targeting sequence with ATCN PAM
uaaaacugaccuuggcuggg

SEQ ID NO: 3144 - RNA, 20 nt, Artificial Sequence
  targeting sequence with ATCN PAM
cagcacuuugggaggccaag

SEQ ID NO: 3145 - RNA, 20 nt, Artificial Sequence
  targeting sequence with ATCN PAM
gcccaccuuggccucccaaa

SEQ ID NO: 3146 - RNA, 20 nt, Artificial Sequence
  targeting sequence with ATCN PAM
cgaggucaggaguuugagac

SEQ ID NO: 3147 - RNA, 20 nt, Artificial Sequence
  targeting sequence with ATCN PAM
gcugggcaugguggcgcgug

SEQ ID NO: 3148 - RNA, 20 nt, Artificial Sequence
  targeting sequence with ATCN PAM
cagcuauucagugggcugag

SEQ ID NO: 3149 - RNA, 20 nt, Artificial Sequence
  targeting sequence with ATCN PAM
cuugaaccugggagguggag

SEQ ID NO: 3150 - RNA, 20 nt, Artificial Sequence
  targeting sequence with ATCN PAM
cggcucacugcaaccuccac

SEQ ID NO: 3151 - RNA, 20 nt, Artificial Sequence
  targeting sequence with ATCN PAM
agugguuuuuuuguuguugu

SEQ ID NO: 3152 - RNA, 20 nt, Artificial Sequence
  targeting sequence with ATCN PAM
uaaggggauuagaugcgacu

SEQ ID NO: 3153 - RNA, 20 nt, Artificial Sequence
  targeting sequence with ATCN PAM
ccuuaggaucaagugguuuu

SEQ ID NO: 3154 - RNA, 20 nt, Artificial Sequence
  targeting sequence with ATCN PAM
aauccccuuaggaucaagug

SEQ ID NO: 3155 - RNA, 20 nt, Artificial Sequence
  targeting sequence with ATCN PAM
gcugcaugccaggcaguagg

SEQ ID NO: 3156 - RNA, 20 nt, Artificial Sequence
  targeting sequence with ATCN PAM
uuuuccccuuugggacaggg

SEQ ID NO: 3157 - RNA, 20 nt, Artificial Sequence
  targeting sequence with ATCN PAM
caugcuccugcccuccuuuc

SEQ ID NO: 3158 - RNA, 20 nt, Artificial Sequence
  targeting sequence with ATCN PAM
gcuaucucaugcuccugccc

SEQ ID NO: 3159 - RNA, 20 nt, Artificial Sequence
  targeting sequence with ATCN PAM
ucggugccuuggugaggcug

SEQ ID NO: 3160 - RNA, 20 nt, Artificial Sequence
  targeting sequence with ATCN PAM
ugcugggaucucuaucauug

SEQ ID NO: 3161 - RNA, 20 nt, Artificial Sequence
  targeting sequence with ATCN PAM
cagcaugauuugccccagcc

SEQ ID NO: 3162 - RNA, 20 nt, Artificial Sequence
  targeting sequence with ATCN PAM
cuaucauugucccucuuuac

SEQ ID NO: 3163 - RNA, 20 nt, Artificial Sequence
  targeting sequence with ATCN PAM
uugucccucuuuacugugac

SEQ ID NO: 3164 - RNA, 20 nt, Artificial Sequence
  targeting sequence with ATCN PAM
agugagucacaguaaagagg

SEQ ID NO: 3165 - RNA, 20 nt, Artificial Sequence
  targeting sequence with ATCN PAM
gucaggauacuuuuggucac

SEQ ID NO: 3166 - RNA, 20 nt, Artificial Sequence
  targeting sequence with ATCN PAM
ugacugauauuaucuaguga

SEQ ID NO: 3167 - RNA, 20 nt, Artificial Sequence
  targeting sequence with ATCN PAM
cuugugaccaaaaguauccu

SEQ ID NO: 3168 - RNA, 20 nt, Artificial Sequence
  targeting sequence with ATCN PAM
aacucauuugggcugaagca

SEQ ID NO: 3169 - RNA, 20 nt, Artificial Sequence
  targeting sequence with ATCN PAM
ccaugacugagauggggauu

SEQ ID NO: 3170 - RNA, 20 nt, Artificial Sequence
  targeting sequence with ATCN PAM
cagucauggugauacccugu

SEQ ID NO: 3171 - RNA, 20 nt, Artificial Sequence
  targeting sequence with ATCN PAM
ccaucucagucauggugaua

SEQ ID NO: 3172 - RNA, 20 nt, Artificial Sequence
  targeting sequence with ATCN PAM
cagaauuaauccccaucuca

SEQ ID NO: 3173 - RNA, 20 nt, Artificial Sequence
  targeting sequence with ATCN PAM
ggugaccuagacuuggccaa

SEQ ID NO: 3174 - RNA, 20 nt, Artificial Sequence
  targeting sequence with ATCN PAM
uacguaacucauuuaugccu

SEQ ID NO: 3175 - RNA, 20 nt, Artificial Sequence
  targeting sequence with ATCN PAM
aaaaaauugcaaccucaggc

SEQ ID NO: 3176 - RNA, 20 nt, Artificial Sequence
  targeting sequence with ATCN PAM
gaccuuggcgaugaccuuga

SEQ ID NO: 3177 - RNA, 20 nt, Artificial Sequence
  targeting sequence with ATCN PAM
ccaaggucugauugcaaaaa

SEQ ID NO: 3178 - RNA, 20 nt, Artificial Sequence
  targeting sequence with ATCN PAM
uacugcucaaggucaucgcc

SEQ ID NO: 3179 - RNA, 20 nt, Artificial Sequence
  targeting sequence with ATCN PAM
ccauggcuggaauggggauu

SEQ ID NO: 3180 - RNA, 20 nt, Artificial Sequence
  targeting sequence with ATCN PAM
ccauuccagccauggugaug

SEQ ID NO: 3181 - RNA, 20 nt, Artificial Sequence
  targeting sequence with ATCN PAM
ucugauuggucagaccuagg

SEQ ID NO: 3182 - RNA, 20 nt, Artificial Sequence
  targeting sequence with ATCN PAM
gaggaugaauccccauucca

SEQ ID NO: 3183 - RNA, 20 nt, Artificial Sequence
  targeting sequence with ATCN PAM
acccagagggaauggaaucu

SEQ ID NO: 3184 - RNA, 20 nt, Artificial Sequence
  targeting sequence with ATCN PAM
aaguugguguuuucugggca

SEQ ID NO: 3185 - RNA, 20 nt, Artificial Sequence
  targeting sequence with ATCN PAM
ucucagggacaugagggaga

SEQ ID NO: 3186 - RNA, 20 nt, Artificial Sequence
  targeting sequence with ATCN PAM
cagggacaugagggagaaga

SEQ ID NO: 3187 - RNA, 20 nt, Artificial Sequence
  targeting sequence with ATCN PAM
ucucccucaugucccugaga

SEQ ID NO: 3188 - RNA, 20 nt, Artificial Sequence
  targeting sequence with ATCN PAM
aaaacaaagggugagaccuu

SEQ ID NO: 3189 - RNA, 20 nt, Artificial Sequence
  targeting sequence with ATCN PAM
uagcugcccugacuugcagg

SEQ ID NO: 3190 - RNA, 20 nt, Artificial Sequence
  targeting sequence with ATCN PAM
ggacaaaccagagaauguuc

SEQ ID NO: 3191 - RNA, 20 nt, Artificial Sequence
  targeting sequence with ATCN PAM
ccaggcagccagcagaugua

SEQ ID NO: 3192 - RNA, 20 nt, Artificial Sequence
  targeting sequence with ATCN PAM
gcuggcugccuggagaugag

SEQ ID NO: 3193 - RNA, 20 nt, Artificial Sequence
  targeting sequence with ATCN PAM
ccgaguccccagugcauucu

SEQ ID NO: 3194 - RNA, 20 nt, Artificial Sequence
  targeting sequence with ATCN PAM
cucccuuggcgugacagagc

SEQ ID NO: 3195 - RNA, 20 nt, Artificial Sequence
  targeting sequence with ATCN PAM
caaaaaaaaaaaagaaaaga

SEQ ID NO: 3196 - RNA, 20 nt, Artificial Sequence
  targeting sequence with ATCN PAM
uucugucucagccucucaag

SEQ ID NO: 3197 - RNA, 20 nt, Artificial Sequence
  targeting sequence with ATCN PAM
ccacaaaaaauaaaaaauaa

SEQ ID NO: 3198 - RNA, 20 nt, Artificial Sequence
  targeting sequence with ATCN PAM
uuugaggcuggaaguucaaa

SEQ ID NO: 3199 - RNA, 20 nt, Artificial Sequence
  targeting sequence with ATCN PAM
uccugccuuggccucucaaa

SEQ ID NO: 3200 - RNA, 20 nt, Artificial Sequence
  targeting sequence with ATCN PAM
cacuugguagaauugucuau

SEQ ID NO: 3201 - RNA, 20 nt, Artificial Sequence
  targeting sequence with ATCN PAM
uauuagucccuauagacaau

SEQ ID NO: 3202 - RNA, 20 nt, Artificial Sequence
  targeting sequence with ATCN PAM
ccuuacaagucaauuuccca

SEQ ID NO: 3203 - RNA, 20 nt, Artificial Sequence
  targeting sequence with ATCN PAM
uccuagguucuagcugggca

SEQ ID NO: 3204 - RNA, 20 nt, Artificial Sequence
  targeting sequence with ATCN PAM
uagguucuagcugggcaccu

SEQ ID NO: 3205 - RNA, 20 nt, Artificial Sequence
  targeting sequence with ATCN PAM
uucggcuucuuuugcaccug

SEQ ID NO: 3206 - RNA, 20 nt, Artificial Sequence
  targeting sequence with ATCN PAM
ugccaccacaggugcaaaag

SEQ ID NO: 3207 - RNA, 20 nt, Artificial Sequence
  targeting sequence with ATCN PAM
uuucugaguacccuacaaug

SEQ ID NO: 3208 - RNA, 20 nt, Artificial Sequence
  targeting sequence with ATCN PAM
uuucuuccugcuggcuggaa

SEQ ID NO: 3209 - RNA, 20 nt, Artificial Sequence
  targeting sequence with ATCN PAM
ugacugcuuuccagccagca

SEQ ID NO: 3210 - RNA, 20 nt, Artificial Sequence
  targeting sequence with ATCN PAM
aauaugggugcggaagcucc

SEQ ID NO: 3211 - RNA, 20 nt, Artificial Sequence
  targeting sequence with ATCN PAM
ugagauagaaucugaggaca

SEQ ID NO: 3212 - RNA, 20 nt, Artificial Sequence
  targeting sequence with ATCN PAM
caugaucuaauaugggugcg

SEQ ID NO: 3213 - RNA, 20 nt, Artificial Sequence
  targeting sequence with ATCN PAM
gaggacagagaauggcaaag

SEQ ID NO: 3214 - RNA, 20 nt, Artificial Sequence
  targeting sequence with ATCN PAM
caagugacuuaaacaagaaa

SEQ ID NO: 3215 - RNA, 20 nt, Artificial Sequence
  targeting sequence with ATCN PAM
uggcucacuacaaccucuac

SEQ ID NO: 3216 - RNA, 20 nt, Artificial Sequence
  targeting sequence with ATCN PAM
cagcuacucgggaggcugag

SEQ ID NO: 3217 - RNA, 20 nt, Artificial Sequence
  targeting sequence with ATCN PAM
gccugggcaacauggcaaaa

SEQ ID NO: 3218 - RNA, 20 nt, Artificial Sequence
  targeting sequence with ATCN PAM
ugaacuccugagcucaagua

SEQ ID NO: 3219 - RNA, 20 nt, Artificial Sequence
  targeting sequence with ATCN PAM
gccugccucagccucccaaa

SEQ ID NO: 3220 - RNA, 20 nt, Artificial Sequence
  targeting sequence with ATCN PAM
cagcacuuugggaggcugag

SEQ ID NO: 3221 - RNA, 20 nt, Artificial Sequence
  targeting sequence with ATCN PAM
uccugaguuccugggcugca

SEQ ID NO: 3222 - RNA, 20 nt, Artificial Sequence
  targeting sequence with ATCN PAM
aagugcagguccucucugaa

SEQ ID NO: 3223 - RNA, 20 nt, Artificial Sequence
  targeting sequence with ATCN PAM
auguaaauauuuuauauuca

SEQ ID NO: 3224 - RNA, 20 nt, Artificial Sequence
  targeting sequence with ATCN PAM
ggacauuugugacuuuucuu

SEQ ID NO: 3225 - RNA, 20 nt, Artificial Sequence
  targeting sequence with ATCN PAM
caguucugaacuuuuggaag

SEQ ID NO: 3226 - RNA, 20 nt, Artificial Sequence
  targeting sequence with ATCN PAM
ucagaacuguagggcaguuc

SEQ ID NO: 3227 - RNA, 20 nt, Artificial Sequence
  targeting sequence with ATCN PAM
cagaagcucaccaagcggcc

SEQ ID NO: 3228 - RNA, 20 nt, Artificial Sequence
  targeting sequence with ATCN PAM
gacugcagggacaacgggcc

SEQ ID NO: 3229 - RNA, 20 nt, Artificial Sequence
  targeting sequence with ATCN PAM
ucuagaggaauuuuuagauc

SEQ ID NO: 3230 - RNA, 20 nt, Artificial Sequence
  targeting sequence with ATCN PAM
aaaaauuccucuagaggauu

SEQ ID NO: 3231 - RNA, 20 nt, Artificial Sequence
  targeting sequence with ATCN PAM
ugcagcacauuuuagagcuu

SEQ ID NO: 3232 - RNA, 20 nt, Artificial Sequence
  targeting sequence with ATCN PAM
aguuucgcauuugaagggaa

SEQ ID NO: 3233 - RNA, 20 nt, Artificial Sequence
  targeting sequence with ATCN PAM
uggcacagccgggagcaugg

SEQ ID NO: 3234 - RNA, 20 nt, Artificial Sequence
  targeting sequence with ATCN PAM
cugaguguugcucuacuucu

SEQ ID NO: 3235 - RNA, 20 nt, Artificial Sequence
  targeting sequence with ATCN PAM
cauuuaugggacacuuccaa

SEQ ID NO: 3236 - RNA, 20 nt, Artificial Sequence
  targeting sequence with ATCN PAM
aaauugcugcccccacuugu

SEQ ID NO: 3237 - RNA, 20 nt, Artificial Sequence
  targeting sequence with ATCN PAM
caguaauggguacugagcac

SEQ ID NO: 3238 - RNA, 20 nt, Artificial Sequence
  targeting sequence with ATCN PAM
cuggugcccagcacagcacc

SEQ ID NO: 3239 - RNA, 20 nt, Artificial Sequence
  targeting sequence with ATCN PAM
gucuuguuccuggugguauc

SEQ ID NO: 3240 - RNA, 20 nt, Artificial Sequence
  targeting sequence with ATCN PAM
cagcucugcuuccgugucuc

SEQ ID NO: 3241 - RNA, 20 nt, Artificial Sequence
  targeting sequence with ATCN PAM
ucagaaaagccuucccuggc

SEQ ID NO: 3242 - RNA, 20 nt, Artificial Sequence
  targeting sequence with ATCN PAM
acucugaggccaaaagauga

SEQ ID NO: 3243 - RNA, 20 nt, Artificial Sequence
  targeting sequence with ATCN PAM
uuuggccucagaguagaugc

SEQ ID NO: 3244 - RNA, 20 nt, Artificial Sequence
  targeting sequence with ATCN PAM
auugacuuguacggcaagac

SEQ ID NO: 3245 - RNA, 20 nt, Artificial Sequence
  targeting sequence with ATCN PAM
uucaugacucuggaucagcc

SEQ ID NO: 3246 - RNA, 20 nt, Artificial Sequence
  targeting sequence with ATCN PAM
agagucaugaaugauaugca

SEQ ID NO: 3247 - RNA, 20 nt, Artificial Sequence
  targeting sequence with ATCN PAM
gccaggcagaucugcugauc

SEQ ID NO: 3248 - RNA, 20 nt, Artificial Sequence
  targeting sequence with ATCN PAM
gccuggcugauccagaguca

SEQ ID NO: 3249 - RNA, 20 nt, Artificial Sequence
  targeting sequence with ATCN PAM
gcugaucugaaccaagcuug

SEQ ID NO: 3250 - RNA, 20 nt, Artificial Sequence
  targeting sequence with ATCN PAM
gcagaucugccuggcugauc

SEQ ID NO: 3251 - RNA, 20 nt, Artificial Sequence
  targeting sequence with ATCN PAM
gaaccaagcuuggucaauuu

SEQ ID NO: 3252 - RNA, 20 nt, Artificial Sequence
  targeting sequence with ATCN PAM
guggucaacuggaggguugg

SEQ ID NO: 3253 - RNA, 20 nt, Artificial Sequence
  targeting sequence with ATCN PAM
gagggucaaccagccagucc

SEQ ID NO: 3254 - RNA, 20 nt, Artificial Sequence
  targeting sequence with ATCN PAM
ccccuguuacccagccaucu

SEQ ID NO: 3255 - RNA, 20 nt, Artificial Sequence
  targeting sequence with ATCN PAM
ggcaggcuagcuaggagcua

SEQ ID NO: 3256 - RNA, 20 nt, Artificial Sequence
  targeting sequence with ATCN PAM
uuucugcuauuggucaaagc

SEQ ID NO: 3257 - RNA, 20 nt, Artificial Sequence
  targeting sequence with ATCN PAM
uaugacuugcuuugaccaau

SEQ ID NO: 3258 - RNA, 20 nt, Artificial Sequence
  targeting sequence with ATCN PAM
acucagacuuaagaaaugug

SEQ ID NO: 3259 - RNA, 20 nt, Artificial Sequence
  targeting sequence with ATCN PAM
cuacacuuugggaggccagg

SEQ ID NO: 3260 - RNA, 20 nt, Artificial Sequence
  targeting sequence with ATCN PAM
ccuacuucagucuuccaagu

SEQ ID NO: 3261 - RNA, 20 nt, Artificial Sequence
  targeting sequence with ATCN PAM
cuugagcccagaaggucgag

SEQ ID NO: 3262 - RNA, 20 nt, Artificial Sequence
  targeting sequence with ATCN PAM
uagcucacugcagccucgac

SEQ ID NO: 3263 - RNA, 20 nt, Artificial Sequence
  targeting sequence with ATCN PAM
auucaacacacacagaggag

SEQ ID NO: 3264 - RNA, 20 nt, Artificial Sequence
  targeting sequence with ATCN PAM
ggccccuuuugucuccucug

SEQ ID NO: 3265 - RNA, 20 nt, Artificial Sequence
  targeting sequence with ATCN PAM
gcacauggcccauuccagga

SEQ ID NO: 3266 - RNA, 20 nt, Artificial Sequence
  targeting sequence with ATCN PAM
cacaauucacccacacugcg

SEQ ID NO: 3267 - RNA, 20 nt, Artificial Sequence
  targeting sequence with ATCN PAM
ugcauggcuccccacugccc

SEQ ID NO: 3268 - RNA, 20 nt, Artificial Sequence
  targeting sequence with ATCN PAM
gacuucacuuuagaacacuu

SEQ ID NO: 3269 - RNA, 20 nt, Artificial Sequence
  targeting sequence with ATCN PAM
aaguguucuaaagugaaguc

SEQ ID NO: 3270 - RNA, 20 nt, Artificial Sequence
  targeting sequence with ATCN PAM
ggacucggggaggcuguggu

SEQ ID NO: 3271 - RNA, 20 nt, Artificial Sequence
  targeting sequence with ATCN PAM
cuggugauggagagcccucu

SEQ ID NO: 3272 - RNA, 20 nt, Artificial Sequence
  targeting sequence with ATCN PAM
ccagagaucuggacucgggg

SEQ ID NO: 3273 - RNA, 20 nt, Artificial Sequence
  targeting sequence with ATCN PAM
cuuccucagagguaaccacu

SEQ ID NO: 3274 - RNA, 20 nt, Artificial Sequence
  targeting sequence with ATCN PAM
auucagaacuuuuuucuacu

SEQ ID NO: 3275 - RNA, 20 nt, Artificial Sequence
  targeting sequence with ATCN PAM
uaccagucacaagcaguaga

SEQ ID NO: 3276 - RNA, 20 nt, Artificial Sequence
  targeting sequence with ATCN PAM
gagaguacaccccaacuacu

SEQ ID NO: 3277 - RNA, 20 nt, Artificial Sequence
  targeting sequence with ATCN PAM
gguggagagugaacaaguaa

SEQ ID NO: 3278 - RNA, 20 nt, Artificial Sequence
  targeting sequence with ATCN PAM
uagcagaaauucaaaacaac

SEQ ID NO: 3279 - RNA, 20 nt, Artificial Sequence
  targeting sequence with ATCN PAM
uugcacguaaguguauaugu

SEQ ID NO: 3280 - RNA, 20 nt, Artificial Sequence
  targeting sequence with ATCN PAM
gagacaaacauauacacuua

SEQ ID NO: 3281 - RNA, 20 nt, Artificial Sequence
  targeting sequence with ATCN PAM
acgccuagaguggaauaggu

SEQ ID NO: 3282 - RNA, 20 nt, Artificial Sequence
  targeting sequence with ATCN PAM
cugaauugcuuucuaaggcg

SEQ ID NO: 3283 - RNA, 20 nt, Artificial Sequence
  targeting sequence with ATCN PAM
uagucacucacuauugauag

SEQ ID NO: 3284 - RNA, 20 nt, Artificial Sequence
  targeting sequence with ATCN PAM
auagugagugacuaggauuc

SEQ ID NO: 3285 - RNA, 20 nt, Artificial Sequence
  targeting sequence with ATCN PAM
uugucauuuugcugagugug

SEQ ID NO: 3286 - RNA, 20 nt, Artificial Sequence
  targeting sequence with ATCN PAM
caccccugcacuccagccug

SEQ ID NO: 3287 - RNA, 20 nt, Artificial Sequence
  targeting sequence with ATCN PAM
cagcucccugcagccuugac

SEQ ID NO: 3288 - RNA, 20 nt, Artificial Sequence
  targeting sequence with ATCN PAM
uccugccucggccucccagg

SEQ ID NO: 3289 - RNA, 20 nt, Artificial Sequence
  targeting sequence with ATCN PAM
ugucucuaccaaaaaauaca

SEQ ID NO: 3290 - RNA, 20 nt, Artificial Sequence
  targeting sequence with ATCN PAM
cuugagcccaggaguucaag

SEQ ID NO: 3291 - RNA, 20 nt, Artificial Sequence
  targeting sequence with ATCN PAM
uccugccucagccucccgaa

SEQ ID NO: 3292 - RNA, 20 nt, Artificial Sequence
  targeting sequence with ATCN PAM
cagaacuucgggaggcugag

SEQ ID NO: 3293 - RNA, 20 nt, Artificial Sequence
  targeting sequence with ATCN PAM
uuguuuuaauccaucuuguc

SEQ ID NO: 3294 - RNA, 20 nt, Artificial Sequence
  targeting sequence with ATCN PAM
aucuugucauuuuauauuau

SEQ ID NO: 3295 - RNA, 20 nt, Artificial Sequence
  targeting sequence with ATCN PAM
ugucauuuuauauuauauua

SEQ ID NO: 3296 - RNA, 20 nt, Artificial Sequence
  targeting sequence with ATCN PAM
agccauugcacuccagccug

SEQ ID NO: 3297 - RNA, 20 nt, Artificial Sequence
  targeting sequence with ATCN PAM
ugguucacugcagucuccag

SEQ ID NO: 3298 - RNA, 20 nt, Artificial Sequence
  targeting sequence with ATCN PAM
cuugaaccugggagcuggag

SEQ ID NO: 3299 - RNA, 20 nt, Artificial Sequence
  targeting sequence with ATCN PAM
cuacuaaaaauacaaaauua

SEQ ID NO: 3300 - RNA, 20 nt, Artificial Sequence
  targeting sequence with ATCN PAM
ccugaggucaggaguuugag

SEQ ID NO: 3301 - RNA, 20 nt, Artificial Sequence
  targeting sequence with ATCN PAM
gcccaccucagccucccaaa

SEQ ID NO: 3302 - RNA, 20 nt, Artificial Sequence
  targeting sequence with ATCN PAM
uagcacuuugggaggcugag

SEQ ID NO: 3303 - RNA, 20 nt, Artificial Sequence
  targeting sequence with ATCN PAM
aaaaugacaaggugggcugg

SEQ ID NO: 3304 - RNA, 20 nt, Artificial Sequence
  targeting sequence with ATCN PAM
cacccuuucugcagaauauu

SEQ ID NO: 3305 - RNA, 20 nt, Artificial Sequence
  targeting sequence with ATCN PAM
aauugacagacaaaaaaaaa

SEQ ID NO: 3306 - RNA, 20 nt, Artificial Sequence
  targeting sequence with ATCN PAM
acugggacaauggacaaaga

SEQ ID NO: 3307 - RNA, 20 nt, Artificial Sequence
  targeting sequence with ATCN PAM
augaagacuuuugugaagca

SEQ ID NO: 3308 - RNA, 20 nt, Artificial Sequence
  targeting sequence with ATCN PAM
uccguuauugauuuauuucu

SEQ ID NO: 3309 - RNA, 20 nt, Artificial Sequence
  targeting sequence with ATCN PAM
auaacggaggaugcuucaca

SEQ ID NO: 3310 - RNA, 20 nt, Artificial Sequence
  targeting sequence with ATCN PAM
gaguagccccuucugaggcc

SEQ ID NO: 3311 - RNA, 20 nt, Artificial Sequence
  targeting sequence with ATCN PAM
uaccaggugggcaaugggcu

SEQ ID NO: 3312 - RNA, 20 nt, Artificial Sequence
  targeting sequence with ATCN PAM
gcaucuccagccccuggugg

SEQ ID NO: 3313 - RNA, 20 nt, Artificial Sequence
  targeting sequence with ATCN PAM
ccagccccuggugggcagag

SEQ ID NO: 3314 - RNA, 20 nt, Artificial Sequence
  targeting sequence with ATCN PAM
cgccugugcccucugcccac

SEQ ID NO: 3315 - RNA, 20 nt, Artificial Sequence
  targeting sequence with ATCN PAM
agcaucucagcucccaacau

SEQ ID NO: 3316 - RNA, 20 nt, Artificial Sequence
  targeting sequence with ATCN PAM
cagcucccaacauugcacca

SEQ ID NO: 3317 - RNA, 20 nt, Artificial Sequence
  targeting sequence with ATCN PAM
ugccuucuguagggagcccc

SEQ ID NO: 3318 - RNA, 20 nt, Artificial Sequence
  targeting sequence with ATCN PAM
gggcugauuggagugguggg

SEQ ID NO: 3319 - RNA, 20 nt, Artificial Sequence
  targeting sequence with ATCN PAM
gcccugauugggcugggagu

SEQ ID NO: 3320 - RNA, 20 nt, Artificial Sequence
  targeting sequence with ATCN PAM
cacccuccucgacuuccaca

SEQ ID NO: 3321 - RNA, 20 nt, Artificial Sequence
  targeting sequence with ATCN PAM
ugcuguggaagucgaggagg

SEQ ID NO: 3322 - RNA, 20 nt, Artificial Sequence
  targeting sequence with ATCN PAM
uccaggucuccugaaucuga

SEQ ID NO: 3323 - RNA, 20 nt, Artificial Sequence
  targeting sequence with ATCN PAM
aggucuccugaaucugaaaa

SEQ ID NO: 3324 - RNA, 20 nt, Artificial Sequence
  targeting sequence with ATCN PAM
gaaaagccaggugagcaaga

SEQ ID NO: 3325 - RNA, 20 nt, Artificial Sequence
  targeting sequence with ATCN PAM
cugcgagcccacucccuggg

SEQ ID NO: 3326 - RNA, 20 nt, Artificial Sequence
  targeting sequence with ATCN PAM
aaggcaacccagggaguggg

SEQ ID NO: 3327 - RNA, 20 nt, Artificial Sequence
  targeting sequence with ATCN PAM
gcucuucagccaaaaggcag

SEQ ID NO: 3328 - RNA, 20 nt, Artificial Sequence
  targeting sequence with ATCN PAM
acagguagcaaggccaggua

SEQ ID NO: 3329 - RNA, 20 nt, Artificial Sequence
  targeting sequence with ATCN PAM
gaaugccuagcccugcauaa

SEQ ID NO: 3330 - RNA, 20 nt, Artificial Sequence
  targeting sequence with ATCN PAM
ggacaugagggugcaccgag

SEQ ID NO: 3331 - RNA, 20 nt, Artificial Sequence
  targeting sequence with ATCN PAM
gaccgggagguccucgaggg

SEQ ID NO: 3332 - RNA, 20 nt, Artificial Sequence
  targeting sequence with ATCN PAM
cauuagcaaacagcaacaag

SEQ ID NO: 3333 - RNA, 20 nt, Artificial Sequence
  targeting sequence with ATCN PAM
agagcuggaggagcccagag

SEQ ID NO: 3334 - RNA, 20 nt, Artificial Sequence
  targeting sequence with ATCN PAM
uucagggucaccucuucuag

SEQ ID NO: 3335 - RNA, 20 nt, Artificial Sequence
  targeting sequence with ATCN PAM
cccuaggugucuuggcaaau

SEQ ID NO: 3336 - RNA, 20 nt, Artificial Sequence
  targeting sequence with ATCN PAM
uucaaggcucaaaaugcacc

SEQ ID NO: 3337 - RNA, 20 nt, Artificial Sequence
  targeting sequence with ATCN PAM
uccuucugggaaggagggaa

SEQ ID NO: 3338 - RNA, 20 nt, Artificial Sequence
  targeting sequence with ATCN PAM
ugaacagggagccauggacg

SEQ ID NO: 3339 - RNA, 20 nt, Artificial Sequence
  targeting sequence with ATCN PAM
cacaccccucaccucccugc

SEQ ID NO: 3340 - RNA, 20 nt, Artificial Sequence
  targeting sequence with ATCN PAM
aagcaagaacugggggcauu

SEQ ID NO: 3341 - RNA, 20 nt, Artificial Sequence
  targeting sequence with ATCN PAM
gccccuccucucucuuccag

SEQ ID NO: 3342 - RNA, 20 nt, Artificial Sequence
  targeting sequence with ATCN PAM
ugguauacagcaggcaugga

SEQ ID NO: 3343 - RNA, 20 nt, Artificial Sequence
  targeting sequence with ATCN PAM
cagccccucauucggcagcu

SEQ ID NO: 3344 - RNA, 20 nt, Artificial Sequence
  targeting sequence with ATCN PAM
guacaguggggacgggggcc

SEQ ID NO: 3345 - RNA, 20 nt, Artificial Sequence
  targeting sequence with ATCN PAM
cuucgaccccuguugggucc

SEQ ID NO: 3346 - RNA, 20 nt, Artificial Sequence
  targeting sequence with ATCN PAM
agagcaaaauuauaaagaga

SEQ ID NO: 3347 - RNA, 20 nt, Artificial Sequence
  targeting sequence with ATCN PAM
agaguuucaugguuuuuuuu

SEQ ID NO: 3348 - RNA, 20 nt, Artificial Sequence
  targeting sequence with ATCN PAM
caccacugcacuccagccug

SEQ ID NO: 3349 - RNA, 20 nt, Artificial Sequence
  targeting sequence with ATCN PAM
cagcucacugcagucuccac

SEQ ID NO: 3350 - RNA, 20 nt, Artificial Sequence
  targeting sequence with ATCN PAM
ucccaccucagccucccaag

SEQ ID NO: 3351 - RNA, 20 nt, Artificial Sequence
  targeting sequence with ATCN PAM
uuaaaaaugagcagagugug

SEQ ID NO: 3352 - RNA, 20 nt, Artificial Sequence
  targeting sequence with ATCN PAM
ugagaccucgacucuacgaa

SEQ ID NO: 3353 - RNA, 20 nt, Artificial Sequence
  targeting sequence with ATCN PAM
gcagaauuuaaagacuuaaa

SEQ ID NO: 3354 - RNA, 20 nt, Artificial Sequence
  targeting sequence with ATCN PAM
aucugcagaauuuaaagacu

SEQ ID NO: 3355 - RNA, 20 nt, Artificial Sequence
  targeting sequence with ATCN PAM
gaaaucaacauuuccauuca

SEQ ID NO: 3356 - RNA, 20 nt, Artificial Sequence
  targeting sequence with ATCN PAM
acauuuccauucaccacauu

SEQ ID NO: 3357 - RNA, 20 nt, Artificial Sequence
  targeting sequence with ATCN PAM
gguuucauauuuaaaucccu

SEQ ID NO: 3358 - RNA, 20 nt, Artificial Sequence
  targeting sequence with ATCN PAM
cuuuuaugcauuucauggug

SEQ ID NO: 3359 - RNA, 20 nt, Artificial Sequence
  targeting sequence with ATCN PAM
agggugggggaagcaugaga

SEQ ID NO: 3360 - RNA, 20 nt, Artificial Sequence
  targeting sequence with ATCN PAM
cacuucauuugcaacuauuu

SEQ ID NO: 3361 - RNA, 20 nt, Artificial Sequence
  targeting sequence with ATCN PAM
aucucuauaaucaauuuuag

SEQ ID NO: 3362 - RNA, 20 nt, Artificial Sequence
  targeting sequence with ATCN PAM
cuauaaucaauuuuagaaua

SEQ ID NO: 3363 - RNA, 20 nt, Artificial Sequence
  targeting sequence with ATCN PAM
auuuuagaauauuuucauca

SEQ ID NO: 3364 - RNA, 20 nt, Artificial Sequence
  targeting sequence with ATCN PAM
cuucaagaaaaccaguaccc

SEQ ID NO: 3365 - RNA, 20 nt, Artificial Sequence
  targeting sequence with ATCN PAM
gcuuucugcaucuauggacu

SEQ ID NO: 3366 - RNA, 20 nt, Artificial Sequence
  targeting sequence with ATCN PAM
auggacuucuuauucuggac

SEQ ID NO: 3367 - RNA, 20 nt, Artificial Sequence
  targeting sequence with ATCN PAM
gacaguauguggcuuuuucu

SEQ ID NO: 3368 - RNA, 20 nt, Artificial Sequence
  targeting sequence with ATCN PAM
agccauacaaaggagugaag

SEQ ID NO: 3369 - RNA, 20 nt, Artificial Sequence
  targeting sequence with ATCN PAM
cguggaauauuauccagcca

SEQ ID NO: 3370 - RNA, 20 nt, Artificial Sequence
  targeting sequence with ATCN PAM
aucugucaaucauucaucau

SEQ ID NO: 3371 - RNA, 20 nt, Artificial Sequence
  targeting sequence with ATCN PAM
gucaaucauucaucauggau

SEQ ID NO: 3372 - RNA, 20 nt, Artificial Sequence
  targeting sequence with ATCN PAM
uucaucauggauguuugggc

SEQ ID NO: 3373 - RNA, 20 nt, Artificial Sequence
  targeting sequence with ATCN PAM
uggauguuugggcugguucc

SEQ ID NO: 3374 - RNA, 20 nt, Artificial Sequence
  targeting sequence with ATCN PAM
augaugaaugauugacagau

SEQ ID NO: 3375 - RNA, 20 nt, Artificial Sequence
  targeting sequence with ATCN PAM
uugggccgacaugaauagug

SEQ ID NO: 3376 - RNA, 20 nt, Artificial Sequence
  targeting sequence with ATCN PAM
uagcacuuugggagacugag

SEQ ID NO: 3377 - RNA, 20 nt, Artificial Sequence
  targeting sequence with ATCN PAM
ucccaccucagucucccaaa

SEQ ID NO: 3378 - RNA, 20 nt, Artificial Sequence
  targeting sequence with ATCN PAM
uuauuauuauuauuauuauu

SEQ ID NO: 3379 - RNA, 20 nt, Artificial Sequence
  targeting sequence with ATCN PAM
ucuugccucagucuccgaag

SEQ ID NO: 3380 - RNA, 20 nt, Artificial Sequence
  targeting sequence with ATCN PAM
cuugagcuggagaggucaag

SEQ ID NO: 3381 - RNA, 20 nt, Artificial Sequence
  targeting sequence with ATCN PAM
uggcucacugcagccuugac

SEQ ID NO: 3382 - RNA, 20 nt, Artificial Sequence
  targeting sequence with ATCN PAM
gucacccaagcuggagugca

SEQ ID NO: 3383 - RNA, 20 nt, Artificial Sequence
  targeting sequence with ATCN PAM
auuugaaaguuuuuuguuuu

SEQ ID NO: 3384 - RNA, 20 nt, Artificial Sequence
  targeting sequence with ATCN PAM
uguggacacucuuguuucau

SEQ ID NO: 3385 - RNA, 20 nt, Artificial Sequence
  targeting sequence with ATCN PAM
gcuggguuauuucaaagcaa

SEQ ID NO: 3386 - RNA, 20 nt, Artificial Sequence
  targeting sequence with ATCN PAM
agcauuugcuuugaaauaac

SEQ ID NO: 3387 - RNA, 20 nt, Artificial Sequence
  targeting sequence with ATCN PAM
uuucaucuguaaauaucuuu

SEQ ID NO: 3388 - RNA, 20 nt, Artificial Sequence
  targeting sequence with ATCN PAM
guaaauaucuuuuauaauau

SEQ ID NO: 3389 - RNA, 20 nt, Artificial Sequence
  targeting sequence with ATCN PAM
uuuauaauauuuaccuuuaa

SEQ ID NO: 3390 - RNA, 20 nt, Artificial Sequence
  targeting sequence with ATCN PAM
guuaaagguaaauauuauaa

SEQ ID NO: 3391 - RNA, 20 nt, Artificial Sequence
  targeting sequence with ATCN PAM
cuaauauccgauauuuccuu

SEQ ID NO: 3392 - RNA, 20 nt, Artificial Sequence
  targeting sequence with ATCN PAM
gauauuuccuuccagugcuc

SEQ ID NO: 3393 - RNA, 20 nt, Artificial Sequence
  targeting sequence with ATCN PAM
gauauuagggauaauauugu

SEQ ID NO: 3394 - RNA, 20 nt, Artificial Sequence
  targeting sequence with ATCN PAM
guugccuuucuuuuuccagu

SEQ ID NO: 3395 - RNA, 20 nt, Artificial Sequence
  targeting sequence with ATCN PAM
aacuggaaaaagaaaggcaa

SEQ ID NO: 3396 - RNA, 20 nt, Artificial Sequence
  targeting sequence with ATCN PAM
ugcucugggaaugagcauuu

SEQ ID NO: 3397 - RNA, 20 nt, Artificial Sequence
  targeting sequence with ATCN PAM
aaauugggugaauuucguaa

SEQ ID NO: 3398 - RNA, 20 nt, Artificial Sequence
  targeting sequence with ATCN PAM
cucuuuuuaaagaauggagu

SEQ ID NO: 3399 - RNA, 20 nt, Artificial Sequence
  targeting sequence with ATCN PAM
cagcacuuugggaggccgag

SEQ ID NO: 3400 - RNA, 20 nt, Artificial Sequence
  targeting sequence with ATCN PAM
gccagguaugguggcagcgc

SEQ ID NO: 3401 - RNA, 20 nt, Artificial Sequence
  targeting sequence with ATCN PAM
cagcuacuugggaggcugag

SEQ ID NO: 3402 - RNA, 20 nt, Artificial Sequence
  targeting sequence with ATCN PAM
cagcucacugcaaccuccac

SEQ ID NO: 3403 - RNA, 20 nt, Artificial Sequence
  targeting sequence with ATCN PAM
cgccauugcacuccagccug

SEQ ID NO: 3404 - RNA, 20 nt, Artificial Sequence
  targeting sequence with ATCN PAM
gggagcucccaugccagcgg

SEQ ID NO: 3405 - RNA, 20 nt, Artificial Sequence
  targeting sequence with ATCN PAM
gauccuugcuggacccucac

SEQ ID NO: 3406 - RNA, 20 nt, Artificial Sequence
  targeting sequence with ATCN PAM
gaugccccccucuccccaag

SEQ ID NO: 3407 - RNA, 20 nt, Artificial Sequence
  targeting sequence with ATCN PAM
uugcuggacccucacccacc

SEQ ID NO: 3408 - RNA, 20 nt, Artificial Sequence
  targeting sequence with ATCN PAM
gcuggcccgugggggguggg

SEQ ID NO: 3409 - RNA, 20 nt, Artificial Sequence
  targeting sequence with ATCN PAM
cccggggcccagucacaacu

SEQ ID NO: 3410 - RNA, 20 nt, Artificial Sequence
  targeting sequence with ATCN PAM
cuccucaggcccgagccacg

SEQ ID NO: 3411 - RNA, 20 nt, Artificial Sequence
  targeting sequence with ATCN PAM
agcucuacauccugcacaag

SEQ ID NO: 3412 - RNA, 20 nt, Artificial Sequence
  targeting sequence with ATCN PAM
ugcacaaguacccaacagug

SEQ ID NO: 3413 - RNA, 20 nt, Artificial Sequence
  targeting sequence with ATCN PAM
cggcugagaccacaggagga

SEQ ID NO: 3414 - RNA, 20 nt, Artificial Sequence
  targeting sequence with ATCN PAM
caaacaugcaacaguucacc

SEQ ID NO: 3415 - RNA, 20 nt, Artificial Sequence
  targeting sequence with ATCN PAM
cagggccugugucagcugug

SEQ ID NO: 3416 - RNA, 20 nt, Artificial Sequence
  targeting sequence with ATCN PAM
uuauaaggaggcuccaaaag

SEQ ID NO: 3417 - RNA, 20 nt, Artificial Sequence
  targeting sequence with ATCN PAM
ggacugucaucagccaccag

SEQ ID NO: 3418 - RNA, 20 nt, Artificial Sequence
  targeting sequence with ATCN PAM
gccaccaggaauaccucagg

SEQ ID NO: 3419 - RNA, 20 nt, Artificial Sequence
  targeting sequence with ATCN PAM
ugccuaacuuccugcaugua

SEQ ID NO: 3420 - RNA, 20 nt, Artificial Sequence
  targeting sequence with ATCN PAM
gucaccagguaaccacaggg

SEQ ID NO: 3421 - RNA, 20 nt, Artificial Sequence
  targeting sequence with ATCN PAM
cagaaagucccacccuggua

SEQ ID NO: 3422 - RNA, 20 nt, Artificial Sequence
  targeting sequence with ATCN PAM
gacaccugacgccccucugg

SEQ ID NO: 3423 - RNA, 20 nt, Artificial Sequence
  targeting sequence with ATCN PAM
ccaagacuagaaacuaccuu

SEQ ID NO: 3424 - RNA, 20 nt, Artificial Sequence
  targeting sequence with ATCN PAM
ccaaggcugugagcggcagg

SEQ ID NO: 3425 - RNA, 20 nt, Artificial Sequence
  targeting sequence with ATCN PAM
uuacagcaggacaaucacca

SEQ ID NO: 3426 - RNA, 20 nt, Artificial Sequence
  targeting sequence with ATCN PAM
gaccucagcccauguucugc

SEQ ID NO: 3427 - RNA, 20 nt, Artificial Sequence
  targeting sequence with ATCN PAM
gugggaaaguggcaggccua

SEQ ID NO: 3428 - RNA, 20 nt, Artificial Sequence
  targeting sequence with ATCN PAM
cucaaccaccugcccuaggc

SEQ ID NO: 3429 - RNA, 20 nt, Artificial Sequence
  targeting sequence with ATCN PAM
ugagauccuagaaucauagu

SEQ ID NO: 3430 - RNA, 20 nt, Artificial Sequence
  targeting sequence with ATCN PAM
caggaucucucaaccaccug

SEQ ID NO: 3431 - RNA, 20 nt, Artificial Sequence
  targeting sequence with ATCN PAM
uagaaucauaguagacagug

SEQ ID NO: 3432 - RNA, 20 nt, Artificial Sequence
  targeting sequence with ATCN PAM
uaguagacagugccuccaag

SEQ ID NO: 3433 - RNA, 20 nt, Artificial Sequence
  targeting sequence with ATCN PAM
agcccaggaagauggccccc

SEQ ID NO: 3434 - RNA, 20 nt, Artificial Sequence
  targeting sequence with ATCN PAM
uccugggcuggauuuucuuc

SEQ ID NO: 3435 - RNA, 20 nt, Artificial Sequence
  targeting sequence with ATCN PAM
ccacaccacccccuacaagu

SEQ ID NO: 3436 - RNA, 20 nt, Artificial Sequence
  targeting sequence with ATCN PAM
agugcauguguccugagugc

SEQ ID NO: 3437 - RNA, 20 nt, Artificial Sequence
  targeting sequence with ATCN PAM
gcccgccuuggccucccaaa

SEQ ID NO: 3438 - RNA, 20 nt, Artificial Sequence
  targeting sequence with ATCN PAM
cuugaggucaggaguuugag

SEQ ID NO: 3439 - RNA, 20 nt, Artificial Sequence
  targeting sequence with ATCN PAM
cagguacuuggguggcugag

SEQ ID NO: 3440 - RNA, 20 nt, Artificial Sequence
  targeting sequence with ATCN PAM
cuugaacccaggaggcagau

SEQ ID NO: 3441 - RNA, 20 nt, Artificial Sequence
  targeting sequence with ATCN PAM
gccuccuggguucaagugau

SEQ ID NO: 3442 - RNA, 20 nt, Artificial Sequence
  targeting sequence with ATCN PAM
cggcucacuguaacaucugc

SEQ ID NO: 3443 - RNA, 20 nt, Artificial Sequence
  targeting sequence with ATCN PAM
caccacuguacuccagcgug

SEQ ID NO: 3444 - RNA, 20 nt, Artificial Sequence
  targeting sequence with ATCN PAM
gggcuuuaucuggaggacaa

SEQ ID NO: 3445 - RNA, 20 nt, Artificial Sequence
  targeting sequence with ATCN PAM
ggaggacaaugcagagcugu

SEQ ID NO: 3446 - RNA, 20 nt, Artificial Sequence
  targeting sequence with ATCN PAM
uuccacagcucugcauuguc

SEQ ID NO: 3447 - RNA, 20 nt, Artificial Sequence
  targeting sequence with ATCN PAM
gggcaagauacuaggauccc

SEQ ID NO: 3448 - RNA, 20 nt, Artificial Sequence
  targeting sequence with ATCN PAM
ugcccagauuggucucuaau

SEQ ID NO: 3449 - RNA, 20 nt, Artificial Sequence
  targeting sequence with ATCN PAM
uaguaucuugcccagauugg

SEQ ID NO: 3450 - RNA, 20 nt, Artificial Sequence
  targeting sequence with ATCN PAM
caucucugcaaaaaauaaaa

SEQ ID NO: 3451 - RNA, 20 nt, Artificial Sequence
  targeting sequence with ATCN PAM
cugcaaaaaauaaaaauauu

SEQ ID NO: 3452 - RNA, 20 nt, Artificial Sequence
  targeting sequence with ATCN PAM
uccugccucagccucccaag

SEQ ID NO: 3453 - RNA, 20 nt, Artificial Sequence
  targeting sequence with ATCN PAM
cuugagccugggaggucaag

SEQ ID NO: 3454 - RNA, 20 nt, Artificial Sequence
  targeting sequence with ATCN PAM
caguuuacugcagccuugac

SEQ ID NO: 3455 - RNA, 20 nt, Artificial Sequence
  targeting sequence with ATCN PAM
ccccaccacacuccagcaca

SEQ ID NO: 3456 - RNA, 20 nt, Artificial Sequence
  targeting sequence with ATCN PAM
uggcugccagguggaagaca

SEQ ID NO: 3457 - RNA, 20 nt, Artificial Sequence
  targeting sequence with ATCN PAM
uuuagccacucugagccuca

SEQ ID NO: 3458 - RNA, 20 nt, Artificial Sequence
  targeting sequence with ATCN PAM
aauuccaggagaugcugagg

SEQ ID NO: 3459 - RNA, 20 nt, Artificial Sequence
  targeting sequence with ATCN PAM
ccuggaauuugauggaggag

SEQ ID NO: 3460 - RNA, 20 nt, Artificial Sequence
  targeting sequence with ATCN PAM
cacacucagcccccggaagg

SEQ ID NO: 3461 - RNA, 20 nt, Artificial Sequence
  targeting sequence with ATCN PAM
agggauggggcucaauuucu

SEQ ID NO: 3462 - RNA, 20 nt, Artificial Sequence
  targeting sequence with ATCN PAM
cuggaugacccuuccggggg

SEQ ID NO: 3463 - RNA, 20 nt, Artificial Sequence
  targeting sequence with ATCN PAM
ccaucuuacagauaagagac

SEQ ID NO: 3464 - RNA, 20 nt, Artificial Sequence
  targeting sequence with ATCN PAM
uacagauaagagacuaaggc

SEQ ID NO: 3465 - RNA, 20 nt, Artificial Sequence
  targeting sequence with ATCN PAM
guaagauggggauggcaaca

SEQ ID NO: 3466 - RNA, 20 nt, Artificial Sequence
  targeting sequence with ATCN PAM
cccuucuaagccuuagucuc

SEQ ID NO: 3467 - RNA, 20 nt, Artificial Sequence
  targeting sequence with ATCN PAM
cagcucuggguggcucuggg

SEQ ID NO: 3468 - RNA, 20 nt, Artificial Sequence
  targeting sequence with ATCN PAM
aggccucaucauccaaagug

SEQ ID NO: 3469 - RNA, 20 nt, Artificial Sequence
  targeting sequence with ATCN PAM
uccaaaguguccagccagag

SEQ ID NO: 3470 - RNA, 20 nt, Artificial Sequence
  targeting sequence with ATCN PAM
aaaguguccagccagagggc

SEQ ID NO: 3471 - RNA, 20 nt, Artificial Sequence
  targeting sequence with ATCN PAM
auaaagacuuuuguuucuuu

SEQ ID NO: 3472 - RNA, 20 nt, Artificial Sequence
  targeting sequence with ATCN PAM
uugaaccucagccucuaccc

SEQ ID NO: 3473 - RNA, 20 nt, Artificial Sequence
  targeting sequence with ATCN PAM
gcugagcaccugcuguuuac

SEQ ID NO: 3474 - RNA, 20 nt, Artificial Sequence
  targeting sequence with ATCN PAM
gagccccagcauuggccagg

SEQ ID NO: 3475 - RNA, 20 nt, Artificial Sequence
  targeting sequence with ATCN PAM
cugaggcaggaccuccuauc

SEQ ID NO: 3476 - RNA, 20 nt, Artificial Sequence
  targeting sequence with ATCN PAM
gugcugcagccccauauagc

SEQ ID NO: 3477 - RNA, 20 nt, Artificial Sequence
  targeting sequence with ATCN PAM
ggaugcaaaggggcugaugg

SEQ ID NO: 3478 - RNA, 20 nt, Artificial Sequence
  targeting sequence with ATCN PAM
cgauaucugugcugcagccc

SEQ ID NO: 3479 - RNA, 20 nt, Artificial Sequence
  targeting sequence with ATCN PAM
gccccuuugcaucccgauau

SEQ ID NO: 3480 - RNA, 20 nt, Artificial Sequence
  targeting sequence with ATCN PAM
cccuccaucagccccuuugc

SEQ ID NO: 3481 - RNA, 20 nt, Artificial Sequence
  targeting sequence with ATCN PAM
cagggccagguuaaucuccc

SEQ ID NO: 3482 - RNA, 20 nt, Artificial Sequence
  targeting sequence with ATCN PAM
ggcuuccaggaugagauggc

SEQ ID NO: 3483 - RNA, 20 nt, Artificial Sequence
  targeting sequence with ATCN PAM
uggaagccugaucgcagggc

SEQ ID NO: 3484 - RNA, 20 nt, Artificial Sequence
  targeting sequence with ATCN PAM
cauccuggaagccugaucgc

SEQ ID NO: 3485 - RNA, 20 nt, Artificial Sequence
  targeting sequence with ATCN PAM
aaagccaucucauccuggaa

SEQ ID NO: 3486 - RNA, 20 nt, Artificial Sequence
  targeting sequence with ATCN PAM
uaaaggauggguagcuguug

SEQ ID NO: 3487 - RNA, 20 nt, Artificial Sequence
  targeting sequence with ATCN PAM
uuuaggaucaaaagccaucu

SEQ ID NO: 3488 - RNA, 20 nt, Artificial Sequence
  targeting sequence with ATCN PAM
gccugacaacagcuacccau

SEQ ID NO: 3489 - RNA, 20 nt, Artificial Sequence
  targeting sequence with ATCN PAM
ucugccucaucugccugaca

SEQ ID NO: 3490 - RNA, 20 nt, Artificial Sequence
  targeting sequence with ATCN PAM
gaggggugggaugaaaggag

SEQ ID NO: 3491 - RNA, 20 nt, Artificial Sequence
  targeting sequence with ATCN PAM
caccccucagauggcauccu

SEQ ID NO: 3492 - RNA, 20 nt, Artificial Sequence
  targeting sequence with ATCN PAM
ccuccuuucaucccaccccu

SEQ ID NO: 3493 - RNA, 20 nt, Artificial Sequence
  targeting sequence with ATCN PAM
guuuagaaagaacccucugg

SEQ ID NO: 3494 - RNA, 20 nt, Artificial Sequence
  targeting sequence with ATCN PAM
uuccuuuccacugccagagg

SEQ ID NO: 3495 - RNA, 20 nt, Artificial Sequence
  targeting sequence with ATCN PAM
uugcucagacagcccgucca

SEQ ID NO: 3496 - RNA, 20 nt, Artificial Sequence
  targeting sequence with ATCN PAM
cugucuggaggggguaccau

SEQ ID NO: 3497 - RNA, 20 nt, Artificial Sequence
  targeting sequence with ATCN PAM
cugugcuccucuuuacuggg

SEQ ID NO: 3498 - RNA, 20 nt, Artificial Sequence
  targeting sequence with ATCN PAM
gcggcacuccucacacggag

SEQ ID NO: 3499 - RNA, 20 nt, Artificial Sequence
  targeting sequence with ATCN PAM
uggagcccagagucaagagg

SEQ ID NO: 3500 - RNA, 20 nt, Artificial Sequence
  targeting sequence with ATCN PAM
cagcgucauugucaccaaau

SEQ ID NO: 3501 - RNA, 20 nt, Artificial Sequence
  targeting sequence with ATCN PAM
caaaacaaaaaguguccuca

SEQ ID NO: 3502 - RNA, 20 nt, Artificial Sequence
  targeting sequence with ATCN PAM
gaaugcguguuggaacugca

SEQ ID NO: 3503 - RNA, 20 nt, Artificial Sequence
  targeting sequence with ATCN PAM
uccagcccuaauugagcugg

SEQ ID NO: 3504 - RNA, 20 nt, Artificial Sequence
  targeting sequence with ATCN PAM
gggcagggcuuggcaggaaa

SEQ ID NO: 3505 - RNA, 20 nt, Artificial Sequence
  targeting sequence with ATCN PAM
gcaaucagggcagggcuugg

SEQ ID NO: 3506 - RNA, 20 nt, Artificial Sequence
  targeting sequence with ATCN PAM
uucuaaacagauccccuucc

SEQ ID NO: 3507 - RNA, 20 nt, Artificial Sequence
  targeting sequence with ATCN PAM
guuuagaaagauauauugcu

SEQ ID NO: 3508 - RNA, 20 nt, Artificial Sequence
  targeting sequence with ATCN PAM
ccuuccuuucacuggaacaa

SEQ ID NO: 3509 - RNA, 20 nt, Artificial Sequence
  targeting sequence with ATCN PAM
acccugcagcccuuguucca

SEQ ID NO: 3510 - RNA, 20 nt, Artificial Sequence
  targeting sequence with ATCN PAM
agccgccaucuacccugcag

SEQ ID NO: 3511 - RNA, 20 nt, Artificial Sequence
  targeting sequence with ATCN PAM
cgcagggccuuguaagccaa

SEQ ID NO: 3512 - RNA, 20 nt, Artificial Sequence
  targeting sequence with ATCN PAM
cugcagagacucuguugcuu

SEQ ID NO: 3513 - RNA, 20 nt, Artificial Sequence
  targeting sequence with ATCN PAM
ggguuguggcaggagccucc

SEQ ID NO: 3514 - RNA, 20 nt, Artificial Sequence
  targeting sequence with ATCN PAM
agaagcuaccacuucuaacc

SEQ ID NO: 3515 - RNA, 20 nt, Artificial Sequence
  targeting sequence with ATCN PAM
cuguugaagauggugugaac

SEQ ID NO: 3516 - RNA, 20 nt, Artificial Sequence
  targeting sequence with ATCN PAM
ucaacagcgauccagaagcu

SEQ ID NO: 3517 - RNA, 20 nt, Artificial Sequence
  targeting sequence with ATCN PAM
gcagagcccguucacaccau

SEQ ID NO: 3518 - RNA, 20 nt, Artificial Sequence
  targeting sequence with ATCN PAM
aucagcagagcccguucaca

SEQ ID NO: 3519 - RNA, 20 nt, Artificial Sequence
  targeting sequence with ATCN PAM
aauccaucagcagagcccgu

SEQ ID NO: 3520 - RNA, 20 nt, Artificial Sequence
  targeting sequence with ATCN PAM
gugacccuuccuacauccaa

SEQ ID NO: 3521 - RNA, 20 nt, Artificial Sequence
  targeting sequence with ATCN PAM
agaccccaaauuguggacug

SEQ ID NO: 3522 - RNA, 20 nt, Artificial Sequence
  targeting sequence with ATCN PAM
cggcagccuccuggcacgug

SEQ ID NO: 3523 - RNA, 20 nt, Artificial Sequence
  targeting sequence with ATCN PAM
ggaccauaucucggcagccu

SEQ ID NO: 3524 - RNA, 20 nt, Artificial Sequence
  targeting sequence with ATCN PAM
gcugcucccuuccugccccu

SEQ ID NO: 3525 - RNA, 20 nt, Artificial Sequence
  targeting sequence with ATCN PAM
cggcuuugccuagaugugcu

SEQ ID NO: 3526 - RNA, 20 nt, Artificial Sequence
  targeting sequence with ATCN PAM
aggcaaagccgggauuccag

SEQ ID NO: 3527 - RNA, 20 nt, Artificial Sequence
  targeting sequence with ATCN PAM
gcucugggugcccuucuggg

SEQ ID NO: 3528 - RNA, 20 nt, Artificial Sequence
  targeting sequence with ATCN PAM
caccaucugcucugggugcc

SEQ ID NO: 3529 - RNA, 20 nt, Artificial Sequence
  targeting sequence with ATCN PAM
gugggcaucucacguccaug

SEQ ID NO: 3530 - RNA, 20 nt, Artificial Sequence
  targeting sequence with ATCN PAM
cacguccaugagcuggggac

SEQ ID NO: 3531 - RNA, 20 nt, Artificial Sequence
  targeting sequence with ATCN PAM
augaaaccuugggcaaguua

SEQ ID NO: 3532 - RNA, 20 nt, Artificial Sequence
  targeting sequence with ATCN PAM
uuaaacuaaacuccuuugaa

SEQ ID NO: 3533 - RNA, 20 nt, Artificial Sequence
  targeting sequence with ATCN PAM
ggggucccuagccuccuaug

SEQ ID NO: 3534 - RNA, 20 nt, Artificial Sequence
  targeting sequence with ATCN PAM
ggggcucugaggaccuggca

SEQ ID NO: 3535 - RNA, 20 nt, Artificial Sequence
  targeting sequence with ATCN PAM
uuaucuggggcucugaggac

SEQ ID NO: 3536 - RNA, 20 nt, Artificial Sequence
  targeting sequence with ATCN PAM
cuaguuuccagagucguuuc

SEQ ID NO: 3537 - RNA, 20 nt, Artificial Sequence
  targeting sequence with ATCN PAM
gacauuaagacaggcugugg

SEQ ID NO: 3538 - RNA, 20 nt, Artificial Sequence
  targeting sequence with ATCN PAM
uucuaugucauuaaauauuc

SEQ ID NO: 3539 - RNA, 20 nt, Artificial Sequence
  targeting sequence with ATCN PAM
gguugcaaaauggugugcac

SEQ ID NO: 3540 - RNA, 20 nt, Artificial Sequence
  targeting sequence with ATCN PAM
gggugugcacaccauuuugc

SEQ ID NO: 3541 - RNA, 20 nt, Artificial Sequence
  targeting sequence with ATCN PAM
ugaguucacuccucggcccc

SEQ ID NO: 3542 - RNA, 20 nt, Artificial Sequence
  targeting sequence with ATCN PAM
aagcgccccgugcggcuggc

SEQ ID NO: 3543 - RNA, 20 nt, Artificial Sequence
  targeting sequence with ATCN PAM
cacccaccccccucacccuc

SEQ ID NO: 3544 - RNA, 20 nt, Artificial Sequence
  targeting sequence with ATCN PAM
aaugugcugauaacuuaaau

SEQ ID NO: 3545 - RNA, 20 nt, Artificial Sequence
  targeting sequence with ATCN PAM
gcacauuugauagcauuuug

SEQ ID NO: 3546 - RNA, 20 nt, Artificial Sequence
  targeting sequence with ATCN PAM
gcugcuuaauaagaaggaau

SEQ ID NO: 3547 - RNA, 20 nt, Artificial Sequence
  targeting sequence with ATCN PAM
augcucagaauagaaaaugu

SEQ ID NO: 3548 - RNA, 20 nt, Artificial Sequence
  targeting sequence with ATCN PAM
uucacauuuucuauucugag

SEQ ID NO: 3549 - RNA, 20 nt, Artificial Sequence
  targeting sequence with ATCN PAM
cuccacacagaagccacugu

SEQ ID NO: 3550 - RNA, 20 nt, Artificial Sequence
  targeting sequence with ATCN PAM
cacaaauaccaguucuaaaa

SEQ ID NO: 3551 - RNA, 20 nt, Artificial Sequence
  targeting sequence with ATCN PAM
uuuguccuaguucuuacucu

SEQ ID NO: 3552 - RNA, 20 nt, Artificial Sequence
  targeting sequence with ATCN PAM
agaguaagaacuaggacaaa

SEQ ID NO: 3553 - RNA, 20 nt, Artificial Sequence
  targeting sequence with ATCN PAM
cgagagccagcuccaaaggu

SEQ ID NO: 3554 - RNA, 20 nt, Artificial Sequence
  targeting sequence with ATCN PAM
uucccugggguuggagagga

SEQ ID NO: 3555 - RNA, 20 nt, Artificial Sequence
  targeting sequence with ATCN PAM
gguucauuguucuugugggc

SEQ ID NO: 3556 - RNA, 20 nt, Artificial Sequence
  targeting sequence with ATCN PAM
agcuuaaaaaauacguagca

SEQ ID NO: 3557 - RNA, 20 nt, Artificial Sequence
  targeting sequence with ATCN PAM
cuguaugacagacgcagcaa

SEQ ID NO: 3558 - RNA, 20 nt, Artificial Sequence
  targeting sequence with ATCN PAM
cuaacaagcccgucaggaau

SEQ ID NO: 3559 - RNA, 20 nt, Artificial Sequence
  targeting sequence with ATCN PAM
uccuggaggucccggggugu

SEQ ID NO: 3560 - RNA, 20 nt, Artificial Sequence
  targeting sequence with ATCN PAM
ccuggccucugacugccuuc

SEQ ID NO: 3561 - RNA, 20 nt, Artificial Sequence
  targeting sequence with ATCN PAM
caggacaaaggcuggagccc

SEQ ID NO: 3562 - RNA, 20 nt, Artificial Sequence
  targeting sequence with ATCN PAM
ucuuuauaauaaaagccuua

SEQ ID NO: 3563 - RNA, 20 nt, Artificial Sequence
  targeting sequence with ATCN PAM
gccacagagggucguuucug

SEQ ID NO: 3564 - RNA, 20 nt, Artificial Sequence
  targeting sequence with ATCN PAM
ugcaccaacugugaauagcu

SEQ ID NO: 3565 - RNA, 20 nt, Artificial Sequence
  targeting sequence with ATCN PAM
uuagaaacacuuucagcaag

SEQ ID NO: 3566 - RNA, 20 nt, Artificial Sequence
  targeting sequence with ATCN PAM
ugcugaaaguguuucuaaag

SEQ ID NO: 3567 - RNA, 20 nt, Artificial Sequence
  targeting sequence with ATCN PAM
aguagcccagcuacagccuc

SEQ ID NO: 3568 - RNA, 20 nt, Artificial Sequence
  targeting sequence with ATCN PAM
uaaccccucuccuuuuccug

SEQ ID NO: 3569 - RNA, 20 nt, Artificial Sequence
  targeting sequence with ATCN PAM
aaggucaguucaaggagggc

SEQ ID NO: 3570 - RNA, 20 nt, Artificial Sequence
  targeting sequence with ATCN PAM
acacuggugcagggagcccu

SEQ ID NO: 3571 - RNA, 20 nt, Artificial Sequence
  targeting sequence with ATCN PAM
acgagugcuacagugaggcc

SEQ ID NO: 3572 - RNA, 20 nt, Artificial Sequence
  targeting sequence with ATCN PAM
aagccaccaccugcucaaac

SEQ ID NO: 3573 - RNA, 20 nt, Artificial Sequence
  targeting sequence with ATCN PAM
uggccgcgcuggaggccaac

SEQ ID NO: 3574 - RNA, 20 nt, Artificial Sequence
  targeting sequence with ATCN PAM
gaggggagcagcggagucag

SEQ ID NO: 3575 - RNA, 20 nt, Artificial Sequence
  targeting sequence with ATCN PAM
guccauuaggggcaagcacc

SEQ ID NO: 3576 - RNA, 20 nt, Artificial Sequence
  targeting sequence with ATCN PAM
cagggugcuugccccuaaug

SEQ ID NO: 3577 - RNA, 20 nt, Artificial Sequence
  targeting sequence with ATCN PAM
gccgcaggugagugccccag

SEQ ID NO: 3578 - RNA, 20 nt, Artificial Sequence
  targeting sequence with ATCN PAM
cugccauggccacauuggug

SEQ ID NO: 3579 - RNA, 20 nt, Artificial Sequence
  targeting sequence with ATCN PAM
ugccuccuuauagaaauacc

SEQ ID NO: 3580 - RNA, 20 nt, Artificial Sequence
  targeting sequence with ATCN PAM
ccaacuccccacggccccca

SEQ ID NO: 3581 - RNA, 20 nt, Artificial Sequence
  targeting sequence with ATCN PAM
cugaacuguucugugggggc

SEQ ID NO: 3582 - RNA, 20 nt, Artificial Sequence
  targeting sequence with ATCN PAM
ccucuccauccagagggugc

SEQ ID NO: 3583 - RNA, 20 nt, Artificial Sequence
  targeting sequence with ATCN PAM
agagggugcucuccugcccc

SEQ ID NO: 3584 - RNA, 20 nt, Artificial Sequence
  targeting sequence with ATCN PAM
ggggucgggggcugggccuc

SEQ ID NO: 3585 - RNA, 20 nt, Artificial Sequence
  targeting sequence with ATCN PAM
cucagcucuucaggccccca

SEQ ID NO: 3586 - RNA, 20 nt, Artificial Sequence
  targeting sequence with ATCN PAM
cccgccgccgagccaccgca

SEQ ID NO: 3587 - RNA, 20 nt, Artificial Sequence
  targeting sequence with ATCN PAM
ggccgaggagucgagggugc

SEQ ID NO: 3588 - RNA, 20 nt, Artificial Sequence
  targeting sequence with ATCN PAM
cuugcucgcugagcggcguc

SEQ ID NO: 3589 - RNA, 20 nt, Artificial Sequence
  targeting sequence with ATCN PAM
aggacaugacgccgcucagc

SEQ ID NO: 3590 - RNA, 20 nt, Artificial Sequence
  targeting sequence with ATCN PAM
gcuuguaguagcgcugcacg

SEQ ID NO: 3591 - RNA, 20 nt, Artificial Sequence
  targeting sequence with ATCN PAM
ugcagcgcuacuacaagcag

SEQ ID NO: 3592 - RNA, 20 nt, Artificial Sequence
  targeting sequence with ATCN PAM
uccgguacucaggaaucucc

SEQ ID NO: 3593 - RNA, 20 nt, Artificial Sequence
  targeting sequence with ATCN PAM
ccuuggcguagaggagcuug

SEQ ID NO: 3594 - RNA, 20 nt, Artificial Sequence
  targeting sequence with ATCN PAM
ugggcagagaagagcgaggg

SEQ ID NO: 3595 - RNA, 20 nt, Artificial Sequence
  targeting sequence with ATCN PAM
aacacccucgcucuucucug

SEQ ID NO: 3596 - RNA, 20 nt, Artificial Sequence
  targeting sequence with ATCN PAM
guccuuucuccagcagccau

SEQ ID NO: 3597 - RNA, 20 nt, Artificial Sequence
  targeting sequence with ATCN PAM
ggucguuuucuggaugagcc

SEQ ID NO: 3598 - RNA, 20 nt, Artificial Sequence
  targeting sequence with ATCN PAM
agaaaacgaccagauccguc

SEQ ID NO: 3599 - RNA, 20 nt, Artificial Sequence
  targeting sequence with ATCN PAM
cuccugccacauaagugacc

SEQ ID NO: 3600 - RNA, 20 nt, Artificial Sequence
  targeting sequence with ATCN PAM
uuguccuaacaguccugggg

SEQ ID NO: 3601 - RNA, 20 nt, Artificial Sequence
  targeting sequence with ATCN PAM
uuguuacguggaaugggcug

SEQ ID NO: 3602 - RNA, 20 nt, Artificial Sequence
  targeting sequence with ATCN PAM
cccugagaaggacacauccu

SEQ ID NO: 3603 - RNA, 20 nt, Artificial Sequence
  targeting sequence with ATCN PAM
uagccaccaagaccuaucac

SEQ ID NO: 3604 - RNA, 20 nt, Artificial Sequence
  targeting sequence with ATCN PAM
cuccacuacuacucacguac

SEQ ID NO: 3605 - RNA, 20 nt, Artificial Sequence
  targeting sequence with ATCN PAM
ugcagugccagcuuuaauga

SEQ ID NO: 3606 - RNA, 20 nt, Artificial Sequence
  targeting sequence with ATCN PAM
uuaaagcuggcacugcagga

SEQ ID NO: 3607 - RNA, 20 nt, Artificial Sequence
  targeting sequence with ATCN PAM
caucccugcucacagcaacc

SEQ ID NO: 3608 - RNA, 20 nt, Artificial Sequence
  targeting sequence with ATCN PAM
cugcucacagcaaccggcug

SEQ ID NO: 3609 - RNA, 20 nt, Artificial Sequence
  targeting sequence with ATCN PAM
ucuuucaucuucaaccucua

SEQ ID NO: 3610 - RNA, 20 nt, Artificial Sequence
  targeting sequence with ATCN PAM
ucaaccucuaaagccagaca

SEQ ID NO: 3611 - RNA, 20 nt, Artificial Sequence
  targeting sequence with ATCN PAM
cagagcuccuagccacccau

SEQ ID NO: 3612 - RNA, 20 nt, Artificial Sequence
  targeting sequence with ATCN PAM
ccccucugcccaccccuuca

SEQ ID NO: 3613 - RNA, 20 nt, Artificial Sequence
  targeting sequence with ATCN PAM
gaaaaccgggccaggcucug

SEQ ID NO: 3614 - RNA, 20 nt, Artificial Sequence
  targeting sequence with ATCN PAM
ucugaaaaccgggccaggcu

SEQ ID NO: 3615 - RNA, 20 nt, Artificial Sequence
  targeting sequence with ATCN PAM
cugcagaccaacugcacaug

SEQ ID NO: 3616 - RNA, 20 nt, Artificial Sequence
  targeting sequence with ATCN PAM
gaaacucuguaucgcugcag

SEQ ID NO: 3617 - RNA, 20 nt, Artificial Sequence
  targeting sequence with ATCN PAM
cacauccccuagaccugaga

SEQ ID NO: 3618 - RNA, 20 nt, Artificial Sequence
  targeting sequence with ATCN PAM
ccuagaccugagaucuuuug

SEQ ID NO: 3619 - RNA, 20 nt, Artificial Sequence
  targeting sequence with ATCN PAM
caggucuaggggauguggga

SEQ ID NO: 3620 - RNA, 20 nt, Artificial Sequence
  targeting sequence with ATCN PAM
uuugguuccccucccaggaa

SEQ ID NO: 3621 - RNA, 20 nt, Artificial Sequence
  targeting sequence with ATCN PAM
uccugggaggggaaccaaaa

SEQ ID NO: 3622 - RNA, 20 nt, Artificial Sequence
  targeting sequence with ATCN PAM
cugagcucagccucagagag

SEQ ID NO: 3623 - RNA, 20 nt, Artificial Sequence
  targeting sequence with ATCN PAM
cugaccugcagcugggcaag

SEQ ID NO: 3624 - RNA, 20 nt, Artificial Sequence
  targeting sequence with ATCN PAM
acgccugcuccaucucugac

SEQ ID NO: 3625 - RNA, 20 nt, Artificial Sequence
  targeting sequence with ATCN PAM
cgcaggccuucaucgacgcc

SEQ ID NO: 3626 - RNA, 20 nt, Artificial Sequence
  targeting sequence with ATCN PAM
acgccugccuuucagucauc

SEQ ID NO: 3627 - RNA, 20 nt, Artificial Sequence
  targeting sequence with ATCN PAM
acaagacagaccacaucgac

SEQ ID NO: 3628 - RNA, 20 nt, Artificial Sequence
  targeting sequence with ATCN PAM
ugaagaacccccaguuuguc

SEQ ID NO: 3629 - RNA, 20 nt, Artificial Sequence
  targeting sequence with ATCN PAM
ugugacaaggcuccaaccuc

SEQ ID NO: 3630 - RNA, 20 nt, Artificial Sequence
  targeting sequence with ATCN PAM
cuggccagcuggggugcagu

SEQ ID NO: 3631 - RNA, 20 nt, Artificial Sequence
  targeting sequence with ATCN PAM
cuuacccaguugguagcccu

SEQ ID NO: 3632 - RNA, 20 nt, Artificial Sequence
  targeting sequence with ATCN PAM
gaaucucuuacccaguuggu

SEQ ID NO: 3633 - RNA, 20 nt, Artificial Sequence
  targeting sequence with ATCN PAM
gugaaguggagcugauggug

SEQ ID NO: 3634 - RNA, 20 nt, Artificial Sequence
  targeting sequence with ATCN PAM
gcuccacuucacagauaagc

SEQ ID NO: 3635 - RNA, 20 nt, Artificial Sequence
  targeting sequence with ATCN PAM
uucucccgcaccccucucag

SEQ ID NO: 3636 - RNA, 20 nt, Artificial Sequence
  targeting sequence with ATCN PAM
gagaacacacagcugggaaa

SEQ ID NO: 3637 - RNA, 20 nt, Artificial Sequence
  targeting sequence with ATCN PAM
ggaagaccaacagguggcgg

SEQ ID NO: 3638 - RNA, 20 nt, Artificial Sequence
  targeting sequence with ATCN PAM
ccgaccccgacacccuacac

SEQ ID NO: 3639 - RNA, 20 nt, Artificial Sequence
  targeting sequence with ATCN PAM
gugaagacaagcccccacug

SEQ ID NO: 3640 - RNA, 20 nt, Artificial Sequence
  targeting sequence with ATCN PAM
agaaacuucugcaacgugcc

SEQ ID NO: 3641 - RNA, 20 nt, Artificial Sequence
  targeting sequence with ATCN PAM
ggcuggucaccgagccucuc

SEQ ID NO: 3642 - RNA, 20 nt, Artificial Sequence
  targeting sequence with ATCN PAM
aggcacuggcacauggaguc

SEQ ID NO: 3643 - RNA, 20 nt, Artificial Sequence
  targeting sequence with ATCN PAM
cugaucccucugggccucug

SEQ ID NO: 3644 - RNA, 20 nt, Artificial Sequence
  targeting sequence with ATCN PAM
gugauguccccaaggccacg

SEQ ID NO: 3645 - RNA, 20 nt, Artificial Sequence
  targeting sequence with ATCN PAM
cucugggccucugcuguacc

SEQ ID NO: 3646 - RNA, 20 nt, Artificial Sequence
  targeting sequence with ATCN PAM
accugacccgccugcucucc

SEQ ID NO: 3647 - RNA, 20 nt, Artificial Sequence
  targeting sequence with ATCN PAM
caagaaggugcucccggaaa

SEQ ID NO: 3648 - RNA, 20 nt, Artificial Sequence
  targeting sequence with ATCN PAM
ucggccgccugugggagguc

SEQ ID NO: 3649 - RNA, 20 nt, Artificial Sequence
  targeting sequence with ATCN PAM
ggagggaaccacagcccuug

SEQ ID NO: 3650 - RNA, 20 nt, Artificial Sequence
  targeting sequence with ATCN PAM
cuacucccccaccccccagc

SEQ ID NO: 3651 - RNA, 20 nt, Artificial Sequence
  targeting sequence with ATCN PAM
agccccucaguggguguggc

SEQ ID NO: 3652 - RNA, 20 nt, Artificial Sequence
  targeting sequence with ATCN PAM
cccggggccgagguugggca

SEQ ID NO: 3653 - RNA, 20 nt, Artificial Sequence
  targeting sequence with ATCN PAM
uucugucuucauuucuguuu

SEQ ID NO: 3654 - RNA, 20 nt, Artificial Sequence
  targeting sequence with ATCN PAM
uucugucuuguuucuguuuc

SEQ ID NO: 3655 - RNA, 20 nt, Artificial Sequence
  targeting sequence with ATCN PAM
uucugucucugcuucuguuu

SEQ ID NO: 3656 - RNA, 20 nt, Artificial Sequence
  targeting sequence with ATCN PAM
cugucuccguuucuguuucu

SEQ ID NO: 3657 - RNA, 20 nt, Artificial Sequence
  targeting sequence with ATCN PAM
aaagagacagucagagagaa

SEQ ID NO: 3658 - RNA, 20 nt, Artificial Sequence
  targeting sequence with ATCN PAM
cugucucauucucucugacu

SEQ ID NO: 3659 - RNA, 20 nt, Artificial Sequence
  targeting sequence with ATCN PAM
cucucuccgucucucccaga

SEQ ID NO: 3660 - RNA, 20 nt, Artificial Sequence
  targeting sequence with ATCN PAM
cacuuaucucucucuccguc

SEQ ID NO: 3661 - RNA, 20 nt, Artificial Sequence
  targeting sequence with ATCN PAM
agagacacacagcgagcgag

SEQ ID NO: 3662 - RNA, 20 nt, Artificial Sequence
  targeting sequence with ATCN PAM
cgggucacuguguguguguc

SEQ ID NO: 3663 - RNA, 20 nt, Artificial Sequence
  targeting sequence with ATCN PAM
uccuguuucucuccaccgcu

SEQ ID NO: 3664 - RNA, 20 nt, Artificial Sequence
  targeting sequence with ATCN PAM
gggcuggcaggagcucuggg

SEQ ID NO: 3665 - RNA, 20 nt, Artificial Sequence
  targeting sequence with ATCN PAM
ucugggucucgggguccccu

SEQ ID NO: 3666 - RNA, 20 nt, Artificial Sequence
  targeting sequence with ATCN PAM
cgggcucgcaggccuggcag

SEQ ID NO: 3667 - RNA, 20 nt, Artificial Sequence
  targeting sequence with ATCN PAM
cgcccucccggggccucucu

SEQ ID NO: 3668 - RNA, 20 nt, Artificial Sequence
  targeting sequence with ATCN PAM
gcuugaggaggccuggugug

SEQ ID NO: 3669 - RNA, 20 nt, Artificial Sequence
  targeting sequence with ATCN PAM
caugccccaguggggaagcu

SEQ ID NO: 3670 - RNA, 20 nt, Artificial Sequence
  targeting sequence with ATCN PAM
cugaaggugccucccuggcc

SEQ ID NO: 3671 - RNA, 20 nt, Artificial Sequence
  targeting sequence with ATCN PAM
gaugggaggggagaggccga

SEQ ID NO: 3672 - RNA, 20 nt, Artificial Sequence
  targeting sequence with ATCN PAM
gaucccugaaggugccuccc

SEQ ID NO: 3673 - RNA, 20 nt, Artificial Sequence
  targeting sequence with ATCN PAM
uucgggaccuggacgacacc

SEQ ID NO: 3674 - RNA, 20 nt, Artificial Sequence
  targeting sequence with ATCN PAM
ggguccgggcagggagcugg

SEQ ID NO: 3675 - RNA, 20 nt, Artificial Sequence
  targeting sequence with ATCN PAM
guaaaauggggagggcagga

SEQ ID NO: 3676 - RNA, 20 nt, Artificial Sequence
  targeting sequence with ATCN PAM
gcaauuguaacaugaacagc

SEQ ID NO: 3677 - RNA, 20 nt, Artificial Sequence
  targeting sequence with ATCN PAM
cagcacuuugggaggaugag

SEQ ID NO: 3678 - RNA, 20 nt, Artificial Sequence
  targeting sequence with ATCN PAM
ucccaaagugcugggauuac

SEQ ID NO: 3679 - RNA, 20 nt, Artificial Sequence
  targeting sequence with ATCN PAM
uccugccucauccucccaaa

SEQ ID NO: 3680 - RNA, 20 nt, Artificial Sequence
  targeting sequence with ATCN PAM
cuugagcccaggaguucaag

SEQ ID NO: 3681 - RNA, 20 nt, Artificial Sequence
  targeting sequence with ATCN PAM
uuacaaaaaguaaaauuagc

SEQ ID NO: 3682 - RNA, 20 nt, Artificial Sequence
  targeting sequence with ATCN PAM
agcuaauuuuacuuuuugua

SEQ ID NO: 3683 - RNA, 20 nt, Artificial Sequence
  targeting sequence with ATCN PAM
ccucauuucagccuccugag

SEQ ID NO: 3684 - RNA, 20 nt, Artificial Sequence
  targeting sequence with ATCN PAM
cuugagcccaggaggucgag

SEQ ID NO: 3685 - RNA, 20 nt, Artificial Sequence
  targeting sequence with ATCN PAM
cagcucacugcagccucgac

SEQ ID NO: 3686 - RNA, 20 nt, Artificial Sequence
  targeting sequence with ATCN PAM
cauucugucacccaggcugg

SEQ ID NO: 3687 - RNA, 20 nt, Artificial Sequence
  targeting sequence with ATCN PAM
cgucucaaaaacaaacaaac

SEQ ID NO: 3688 - RNA, 20 nt, Artificial Sequence
  targeting sequence with ATCN PAM
cuccuuuaggaauuaggaag

SEQ ID NO: 3689 - RNA, 20 nt, Artificial Sequence
  targeting sequence with ATCN PAM
aaugaggcccccucagcaag

SEQ ID NO: 3690 - RNA, 20 nt, Artificial Sequence
  targeting sequence with ATCN PAM
ucucaguguccccacauuca

SEQ ID NO: 3691 - RNA, 20 nt, Artificial Sequence
  targeting sequence with ATCN PAM
uggaggccuucugcaagaau

SEQ ID NO: 3692 - RNA, 20 nt, Artificial Sequence
  targeting sequence with ATCN PAM
ucuccuugaccugugucagc

SEQ ID NO: 3693 - RNA, 20 nt, Artificial Sequence
  targeting sequence with ATCN PAM
cuaugucagugcccaggcag

SEQ ID NO: 3694 - RNA, 20 nt, Artificial Sequence
  targeting sequence with ATCN PAM
aggccaagccccggguaagu

SEQ ID NO: 3695 - RNA, 20 nt, Artificial Sequence
  targeting sequence with ATCN PAM
caggcaaggcccgcuacaca

SEQ ID NO: 3696 - RNA, 20 nt, Artificial Sequence
  targeting sequence with ATCN PAM
acgccaucacaggcaaggcc

SEQ ID NO: 3697 - RNA, 20 nt, Artificial Sequence
  targeting sequence with ATCN PAM
acaagggcuccaucgacgcc

SEQ ID NO: 3698 - RNA, 20 nt, Artificial Sequence
  targeting sequence with ATCN PAM
agcagcaaaucaacaagggc

SEQ ID NO: 3699 - RNA, 20 nt, Artificial Sequence
  targeting sequence with ATCN PAM
gggccaaggcccccucugua

SEQ ID NO: 3700 - RNA, 20 nt, Artificial Sequence
  targeting sequence with ATCN PAM
uucuuacugugcagccaaca

SEQ ID NO: 3701 - RNA, 20 nt, Artificial Sequence
  targeting sequence with ATCN PAM
ugggcaggucacuugcccuc

SEQ ID NO: 3702 - RNA, 20 nt, Artificial Sequence
  targeting sequence with ATCN PAM
cccagcugggaagcggcagg

SEQ ID NO: 3703 - RNA, 20 nt, Artificial Sequence
  targeting sequence with ATCN PAM
guguuucggguccaccuaaa

SEQ ID NO: 3704 - RNA, 20 nt, Artificial Sequence
  targeting sequence with ATCN PAM
gccugcaaguggggucgagg

SEQ ID NO: 3705 - RNA, 20 nt, Artificial Sequence
  targeting sequence with ATCN PAM
ccaaggguggcccuccaggc

SEQ ID NO: 3706 - RNA, 20 nt, Artificial Sequence
  targeting sequence with ATCN PAM
gcucauggcuguggguccag

SEQ ID NO: 3707 - RNA, 20 nt, Artificial Sequence
  targeting sequence with ATCN PAM
caguggaacaccuggguccc

SEQ ID NO: 3708 - RNA, 20 nt, Artificial Sequence
  targeting sequence with ATCN PAM
acaaaaauugauuuaaagaa

SEQ ID NO: 3709 - RNA, 20 nt, Artificial Sequence
  targeting sequence with ATCN PAM
auuuuuguggauaguuaagu

SEQ ID NO: 3710 - RNA, 20 nt, Artificial Sequence
  targeting sequence with ATCN PAM
gccuaauacuauuauguacu

SEQ ID NO: 3711 - RNA, 20 nt, Artificial Sequence
  targeting sequence with ATCN PAM
uugccaaaucugccuaauac

SEQ ID NO: 3712 - RNA, 20 nt, Artificial Sequence
  targeting sequence with ATCN PAM
gugccucccacgccccagac

SEQ ID NO: 3713 - RNA, 20 nt, Artificial Sequence
  targeting sequence with ATCN PAM
ggaaccacaagggccacugu

SEQ ID NO: 3714 - RNA, 20 nt, Artificial Sequence
  targeting sequence with ATCN PAM
uuggcacagcccagcugugu

SEQ ID NO: 3715 - RNA, 20 nt, Artificial Sequence
  targeting sequence with ATCN PAM
uggcugggugcaguggcuca

SEQ ID NO: 3716 - RNA, 20 nt, Artificial Sequence
  targeting sequence with ATCN PAM
cagcacuuugggaggccaaa

SEQ ID NO: 3717 - RNA, 20 nt, Artificial Sequence
  targeting sequence with ATCN PAM
ucccgcuuuggccucccaaa

SEQ ID NO: 3718 - RNA, 20 nt, Artificial Sequence
  targeting sequence with ATCN PAM
cuucaaaaauuaauaacaaa

SEQ ID NO: 3719 - RNA, 20 nt, Artificial Sequence
  targeting sequence with ATCN PAM
gaggccccgguucugggcuc

SEQ ID NO: 3720 - RNA, 20 nt, Artificial Sequence
  targeting sequence with ATCN PAM
uccaggcagcccucuagccu

SEQ ID NO: 3721 - RNA, 20 nt, Artificial Sequence
  targeting sequence with ATCN PAM
agaagauucuuuggccuucc

SEQ ID NO: 3722 - RNA, 20 nt, Artificial Sequence
  targeting sequence with ATCN PAM
ucuggaugagagcggaggcu

SEQ ID NO: 3723 - RNA, 20 nt, Artificial Sequence
  targeting sequence with ATCN PAM
ccuccucccggccucugccc

SEQ ID NO: 3724 - RNA, 20 nt, Artificial Sequence
  targeting sequence with ATCN PAM
gguacagcacaagggcagag

SEQ ID NO: 3725 - RNA, 20 nt, Artificial Sequence
  targeting sequence with ATCN PAM
gccccuggcuggcccuugag

SEQ ID NO: 3726 - RNA, 20 nt, Artificial Sequence
  targeting sequence with ATCN PAM
ccugaauccagagcagggaa

SEQ ID NO: 3727 - RNA, 20 nt, Artificial Sequence
  targeting sequence with ATCN PAM
agagcagggaaggguggaug

SEQ ID NO: 3728 - RNA, 20 nt, Artificial Sequence
  targeting sequence with ATCN PAM
acccuucccugcucuggauu

SEQ ID NO: 3729 - RNA, 20 nt, Artificial Sequence
  targeting sequence with ATCN PAM
gugguuuucucagucaucca

SEQ ID NO: 3730 - RNA, 20 nt, Artificial Sequence
  targeting sequence with ATCN PAM
guugagcccuugcagcaagc

SEQ ID NO: 3731 - RNA, 20 nt, Artificial Sequence
  targeting sequence with ATCN PAM
gcauguacagcugucugcgg

SEQ ID NO: 3732 - RNA, 20 nt, Artificial Sequence
  targeting sequence with ATCN PAM
aguuggugagcaucuucucc

SEQ ID NO: 3733 - RNA, 20 nt, Artificial Sequence
  targeting sequence with ATCN PAM
ucuccaccacagacucugug

SEQ ID NO: 3734 - RNA, 20 nt, Artificial Sequence
  targeting sequence with ATCN PAM
ugaaggagcugcugguggac

SEQ ID NO: 3735 - RNA, 20 nt, Artificial Sequence
  targeting sequence with ATCN PAM
cgcugcacggcaagcuggag

SEQ ID NO: 3736 - RNA, 20 nt, Artificial Sequence
  targeting sequence with ATCN PAM
ucuuuguccacgcgcuggag

SEQ ID NO: 3737 - RNA, 20 nt, Artificial Sequence
  targeting sequence with ATCN PAM
guggaagcaacuggugaugg

SEQ ID NO: 3738 - RNA, 20 nt, Artificial Sequence
  targeting sequence with ATCN PAM
ccaguugcuuccacagauuc

SEQ ID NO: 3739 - RNA, 20 nt, Artificial Sequence
  targeting sequence with ATCN PAM
caggaggcauacaagcagcc

SEQ ID NO: 3740 - RNA, 20 nt, Artificial Sequence
  targeting sequence with ATCN PAM
accguggaagguaaugagcu

SEQ ID NO: 3741 - RNA, 20 nt, Artificial Sequence
  targeting sequence with ATCN PAM
cagcggggcuggacaccccc

SEQ ID NO: 3742 - RNA, 20 nt, Artificial Sequence
  targeting sequence with ATCN PAM
uuuuucacgaaacccuccag

SEQ ID NO: 3743 - RNA, 20 nt, Artificial Sequence
  targeting sequence with ATCN PAM
cuuccaugccucucaugccu

SEQ ID NO: 3744 - RNA, 20 nt, Artificial Sequence
  targeting sequence with ATCN PAM
agugagcagagaaugacagu

SEQ ID NO: 3745 - RNA, 20 nt, Artificial Sequence
  targeting sequence with ATCN PAM
gccuccaacccuucuccccg

SEQ ID NO: 3746 - RNA, 20 nt, Artificial Sequence
  targeting sequence with ATCN PAM
ccuuccuggaguauaagcac

SEQ ID NO: 3747 - RNA, 20 nt, Artificial Sequence
  targeting sequence with ATCN PAM
caccaaggagcugaaccgca

SEQ ID NO: 3748 - RNA, 20 nt, Artificial Sequence
  targeting sequence with ATCN PAM
gucaugucugucugcagcuc

SEQ ID NO: 3749 - RNA, 20 nt, Artificial Sequence
  targeting sequence with ATCN PAM
ccuaggagggaaaguugagg

SEQ ID NO: 3750 - RNA, 20 nt, Artificial Sequence
  targeting sequence with ATCN PAM
gcaaagguagugggcgggga

SEQ ID NO: 3751 - RNA, 20 nt, Artificial Sequence
  targeting sequence with ATCN PAM
gagaggaaauccgcaaaggu

SEQ ID NO: 3752 - RNA, 20 nt, Artificial Sequence
  targeting sequence with ATCN PAM
gagauuccaucuccuccauc

SEQ ID NO: 3753 - RNA, 20 nt, Artificial Sequence
  targeting sequence with ATCN PAM
cagauccgagaggaaauccg

SEQ ID NO: 3754 - RNA, 20 nt, Artificial Sequence
  targeting sequence with ATCN PAM
ccuccaucugcagcagcguc

SEQ ID NO: 3755 - RNA, 20 nt, Artificial Sequence
  targeting sequence with ATCN PAM
gcagcagcgucuucugccag

SEQ ID NO: 3756 - RNA, 20 nt, Artificial Sequence
  targeting sequence with ATCN PAM
ggcauugcuuugcuggccau

SEQ ID NO: 3757 - RNA, 20 nt, Artificial Sequence
  targeting sequence with ATCN PAM
ucccacccaggaaagccacu

SEQ ID NO: 3758 - RNA, 20 nt, Artificial Sequence
  targeting sequence with ATCN PAM
gcuuuuaaaaguuucuuaau

SEQ ID NO: 3759 - RNA, 20 nt, Artificial Sequence
  targeting sequence with ATCN PAM
ccacuaauuuuagagcauuu

SEQ ID NO: 3760 - RNA, 20 nt, Artificial Sequence
  targeting sequence with ATCN PAM
ccauucagcuuucugucucu

SEQ ID NO: 3761 - RNA, 20 nt, Artificial Sequence
  targeting sequence with ATCN PAM
ucucuuaaguaccuucagua

SEQ ID NO: 3762 - RNA, 20 nt, Artificial Sequence
  targeting sequence with ATCN PAM
caagcagagaaauuuggaac

SEQ ID NO: 3763 - RNA, 20 nt, Artificial Sequence
  targeting sequence with ATCN PAM
ccuggccaccuaacaucuuc

SEQ ID NO: 3764 - RNA, 20 nt, Artificial Sequence
  targeting sequence with ATCN PAM
ucuacccauuggugcuggag

SEQ ID NO: 3765 - RNA, 20 nt, Artificial Sequence
  targeting sequence with ATCN PAM
cauccugccuucucccaucu

SEQ ID NO: 3766 - RNA, 20 nt, Artificial Sequence
  targeting sequence with ATCN PAM
ugccuucucccaucugccaa

SEQ ID NO: 3767 - RNA, 20 nt, Artificial Sequence
  targeting sequence with ATCN PAM
gccaaucuucagaggggcug

SEQ ID NO: 3768 - RNA, 20 nt, Artificial Sequence
  targeting sequence with ATCN PAM
ucagaggggcuggggcaagg

SEQ ID NO: 3769 - RNA, 20 nt, Artificial Sequence
  targeting sequence with ATCN PAM
gcagcguccugcugcugcuc

SEQ ID NO: 3770 - RNA, 20 nt, Artificial Sequence
  targeting sequence with ATCN PAM
ucaucugcagcguccugcug

SEQ ID NO: 3771 - RNA, 20 nt, Artificial Sequence
  targeting sequence with ATCN PAM
uguccaucgucaucugcagc

SEQ ID NO: 3772 - RNA, 20 nt, Artificial Sequence
  targeting sequence with ATCN PAM
ucguguccaucgucaucugc

SEQ ID NO: 3773 - RNA, 20 nt, Artificial Sequence
  targeting sequence with ATCN PAM
ccacacugcagcuggggggc

SEQ ID NO: 3774 - RNA, 20 nt, Artificial Sequence
  targeting sequence with ATCN PAM
agguagggaacuucaaccag

SEQ ID NO: 3775 - RNA, 20 nt, Artificial Sequence
  targeting sequence with ATCN PAM
gugcagagguuggggaaggg

SEQ ID NO: 3776 - RNA, 20 nt, Artificial Sequence
  targeting sequence with ATCN PAM
guguggcaccugaggcucag

SEQ ID NO: 3777 - RNA, 20 nt, Artificial Sequence
  targeting sequence with ATCN PAM
cuauguuaucaguguggcac

SEQ ID NO: 3778 - RNA, 20 nt, Artificial Sequence
  targeting sequence with ATCN PAM
cagcccccugcauugagcca

SEQ ID NO: 3779 - RNA, 20 nt, Artificial Sequence
  targeting sequence with ATCN PAM
uuacagccugggaggaguag

SEQ ID NO: 3780 - RNA, 20 nt, Artificial Sequence
  targeting sequence with ATCN PAM
gcaaggcugcccugggacca

SEQ ID NO: 3781 - RNA, 20 nt, Artificial Sequence
  targeting sequence with ATCN PAM
ugggguggcacacgcugcuu

SEQ ID NO: 3782 - RNA, 20 nt, Artificial Sequence
  targeting sequence with ATCN PAM
caggagacaugcaaggagau

SEQ ID NO: 3783 - RNA, 20 nt, Artificial Sequence
  targeting sequence with ATCN PAM
ccuugcaugucuccugggau

SEQ ID NO: 3784 - RNA, 20 nt, Artificial Sequence
  targeting sequence with ATCN PAM
uagagccugggcugccaggc

SEQ ID NO: 3785 - RNA, 20 nt, Artificial Sequence
  targeting sequence with ATCN PAM
gaaaccauaagaaauugucc

SEQ ID NO: 3786 - RNA, 20 nt, Artificial Sequence
  targeting sequence with ATCN PAM
ggaccuggaccaucagaaac

SEQ ID NO: 3787 - RNA, 20 nt, Artificial Sequence
  targeting sequence with ATCN PAM
cugaccucaagcaagucacu

SEQ ID NO: 3788 - RNA, 20 nt, Artificial Sequence
  targeting sequence with ATCN PAM
ccacuugacauaugaggaaa

SEQ ID NO: 3789 - RNA, 20 nt, Artificial Sequence
  targeting sequence with ATCN PAM
gccccucacccagcaccuga

SEQ ID NO: 3790 - RNA, 20 nt, Artificial Sequence
  targeting sequence with ATCN PAM
gccaagcaucugccccucac

SEQ ID NO: 3791 - RNA, 20 nt, Artificial Sequence
  targeting sequence with ATCN PAM
acucacugugaugggcagcu

SEQ ID NO: 3792 - RNA, 20 nt, Artificial Sequence
  targeting sequence with ATCN PAM
cagugaguggauggggcgcc

SEQ ID NO: 3793 - RNA, 20 nt, Artificial Sequence
  targeting sequence with ATCN PAM
acugcucggucaacgagucc

SEQ ID NO: 3794 - RNA, 20 nt, Artificial Sequence
  targeting sequence with ATCN PAM
uccacugcucggucaacgag

SEQ ID NO: 3795 - RNA, 20 nt, Artificial Sequence
  targeting sequence with ATCN PAM
ggaugucgcagcuuacuugg

SEQ ID NO: 3796 - RNA, 20 nt, Artificial Sequence
  targeting sequence with ATCN PAM
agauugucucugacagaauc

SEQ ID NO: 3797 - RNA, 20 nt, Artificial Sequence
  targeting sequence with ATCN PAM
ugacccgguacucgugacuc

SEQ ID NO: 3798 - RNA, 20 nt, Artificial Sequence
  targeting sequence with ATCN PAM
ucccccuuugcacccacaga

SEQ ID NO: 3799 - RNA, 20 nt, Artificial Sequence
  targeting sequence with ATCN PAM
acgugagcaccaaaggggcc

SEQ ID NO: 3800 - RNA, 20 nt, Artificial Sequence
  targeting sequence with ATCN PAM
agcaccaccccggggagccu

SEQ ID NO: 3801 - RNA, 20 nt, Artificial Sequence
  targeting sequence with ATCN PAM
acuucucccucuuggccgua

SEQ ID NO: 3802 - RNA, 20 nt, Artificial Sequence
  targeting sequence with ATCN PAM
augggcgggccuacgcagac

SEQ ID NO: 3803 - RNA, 20 nt, Artificial Sequence
  targeting sequence with ATCN PAM
gcgccaguggacuucuucau

SEQ ID NO: 3804 - RNA, 20 nt, Artificial Sequence
  targeting sequence with ATCN PAM
ccugcccgucccccggggcc

SEQ ID NO: 3805 - RNA, 20 nt, Artificial Sequence
  targeting sequence with ATCN PAM
cggccugggccccuggcucu

SEQ ID NO: 3806 - RNA, 20 nt, Artificial Sequence
  targeting sequence with ATCN PAM
ugcaucccggccugggcccc

SEQ ID NO: 3807 - RNA, 20 nt, Artificial Sequence
  targeting sequence with ATCN PAM
guccauccugcaucccggcc

SEQ ID NO: 3808 - RNA, 20 nt, Artificial Sequence
  targeting sequence with ATCN PAM
cuguccccucuuccucccuc

SEQ ID NO: 3809 - RNA, 20 nt, Artificial Sequence
  targeting sequence with ATCN PAM
ggcccccgaaugccucaccg

SEQ ID NO: 3810 - RNA, 20 nt, Artificial Sequence
  targeting sequence with ATCN PAM
caguggcuggugagcguuuc

SEQ ID NO: 3811 - RNA, 20 nt, Artificial Sequence
  targeting sequence with ATCN PAM
gugcaccugcagccccagag

SEQ ID NO: 3812 - RNA, 20 nt, Artificial Sequence
  targeting sequence with ATCN PAM
guccccgccgcagcccuguc

SEQ ID NO: 3813 - RNA, 20 nt, Artificial Sequence
  targeting sequence with ATCN PAM
cggccaucaguccccgccgc

SEQ ID NO: 3814 - RNA, 20 nt, Artificial Sequence
  targeting sequence with ATCN PAM
ccugcaccaugccugagggg

SEQ ID NO: 3815 - RNA, 20 nt, Artificial Sequence
  targeting sequence with ATCN PAM
gugcgccuggggggagcagc

SEQ ID NO: 3816 - RNA, 20 nt, Artificial Sequence
  targeting sequence with ATCN PAM
gcagggccugccuucugcug

SEQ ID NO: 3817 - RNA, 20 nt, Artificial Sequence
  targeting sequence with ATCN PAM
ucugcccaguuagugcccag

SEQ ID NO: 3818 - RNA, 20 nt, Artificial Sequence
  targeting sequence with ATCN PAM
caccuccuccaggaagccuu

SEQ ID NO: 3819 - RNA, 20 nt, Artificial Sequence
  targeting sequence with ATCN PAM
ggggagagagacuucaccag

SEQ ID NO: 3820 - RNA, 20 nt, Artificial Sequence
  targeting sequence with ATCN PAM
cugaaggcacugacuuuucu

SEQ ID NO: 3821 - RNA, 20 nt, Artificial Sequence
  targeting sequence with ATCN PAM
uagccccacuggauguuccu

SEQ ID NO: 3822 - RNA, 20 nt, Artificial Sequence
  targeting sequence with ATCN PAM
aguggggcuaggauugggag

SEQ ID NO: 3823 - RNA, 20 nt, Artificial Sequence
  targeting sequence with ATCN PAM
ucuggcuggcccaggggugu

SEQ ID NO: 3824 - RNA, 20 nt, Artificial Sequence
  targeting sequence with ATCN PAM
gugugugugcaaucaacacc

SEQ ID NO: 3825 - RNA, 20 nt, Artificial Sequence
  targeting sequence with ATCN PAM
acaccauucucauuacagcu

SEQ ID NO: 3826 - RNA, 20 nt, Artificial Sequence
  targeting sequence with ATCN PAM
cuuauggagcaacuacugua

SEQ ID NO: 3827 - RNA, 20 nt, Artificial Sequence
  targeting sequence with ATCN PAM
uugagccaagccucucuugg

SEQ ID NO: 3828 - RNA, 20 nt, Artificial Sequence
  targeting sequence with ATCN PAM
augggcuugggggcuggcgg

SEQ ID NO: 3829 - RNA, 20 nt, Artificial Sequence
  targeting sequence with ATCN PAM
cuuccagcccagagaaauca

SEQ ID NO: 3830 - RNA, 20 nt, Artificial Sequence
  targeting sequence with ATCN PAM
gcuccgugcaggggucugug

SEQ ID NO: 3831 - RNA, 20 nt, Artificial Sequence
  targeting sequence with ATCN PAM
augggaaugaccuccaugua

SEQ ID NO: 3832 - RNA, 20 nt, Artificial Sequence
  targeting sequence with ATCN PAM
ccauccaugggaaugaccuc

SEQ ID NO: 3833 - RNA, 20 nt, Artificial Sequence
  targeting sequence with ATCN PAM
uggugcccccggccuugggg

SEQ ID NO: 3834 - RNA, 20 nt, Artificial Sequence
  targeting sequence with ATCN PAM
ugugugucacagggccagcc

SEQ ID NO: 3835 - RNA, 20 nt, Artificial Sequence
  targeting sequence with ATCN PAM
ugaggggaggugcugugguc

SEQ ID NO: 3836 - RNA, 20 nt, Artificial Sequence
  targeting sequence with ATCN PAM
cugagccuggcucuagggug

SEQ ID NO: 3837 - RNA, 20 nt, Artificial Sequence
  targeting sequence with ATCN PAM
ccccauuccacgccaugcca

SEQ ID NO: 3838 - RNA, 20 nt, Artificial Sequence
  targeting sequence with ATCN PAM
guuucccacaguucugcaac

SEQ ID NO: 3839 - RNA, 20 nt, Artificial Sequence
  targeting sequence with ATCN PAM
gagacccuuuugucccaccc

SEQ ID NO: 3840 - RNA, 20 nt, Artificial Sequence
  targeting sequence with ATCN PAM
ugagaacgucugcugggcug

SEQ ID NO: 3841 - RNA, 20 nt, Artificial Sequence
  targeting sequence with ATCN PAM
accagcccagcagacguucu

SEQ ID NO: 3842 - RNA, 20 nt, Artificial Sequence
  targeting sequence with ATCN PAM
ggcguguggaagagccguca

SEQ ID NO: 3843 - RNA, 20 nt, Artificial Sequence
  targeting sequence with ATCN PAM
gugacuggcccagaggggcc

SEQ ID NO: 3844 - RNA, 20 nt, Artificial Sequence
  targeting sequence with ATCN PAM
cuaaaccaugccaguagccc

SEQ ID NO: 3845 - RNA, 20 nt, Artificial Sequence
  targeting sequence with ATCN PAM
uuugcaauuaaaaaggcugg

SEQ ID NO: 3846 - RNA, 20 nt, Artificial Sequence
  targeting sequence with ATCN PAM
gagccagagcuggagggaua

SEQ ID NO: 3847 - RNA, 20 nt, Artificial Sequence
  targeting sequence with ATCN PAM
cuccagcucuggcucugaug

SEQ ID NO: 3848 - RNA, 20 nt, Artificial Sequence
  targeting sequence with ATCN PAM
gcuuuaucccuccagcucug

SEQ ID NO: 3849 - RNA, 20 nt, Artificial Sequence
  targeting sequence with ATCN PAM
ugccguuucugcuuggggca

SEQ ID NO: 3850 - RNA, 20 nt, Artificial Sequence
  targeting sequence with ATCN PAM
ucuguccucacucugcugcu

SEQ ID NO: 3851 - RNA, 20 nt, Artificial Sequence
  targeting sequence with ATCN PAM
gucaggcaguggcucacagg

SEQ ID NO: 3852 - RNA, 20 nt, Artificial Sequence
  targeting sequence with ATCN PAM
acacgccgugggccacguca

SEQ ID NO: 3853 - RNA, 20 nt, Artificial Sequence
  targeting sequence with ATCN PAM
gaggaaggaaccugggccgg

SEQ ID NO: 3854 - RNA, 20 nt, Artificial Sequence
  targeting sequence with ATCN PAM
gccaggugacccgagagagg

SEQ ID NO: 3855 - RNA, 20 nt, Artificial Sequence
  targeting sequence with ATCN PAM
cauucgccccucucucgggu

SEQ ID NO: 3856 - RNA, 20 nt, Artificial Sequence
  targeting sequence with ATCN PAM
gaggcugcaggccagcaggc

SEQ ID NO: 3857 - RNA, 20 nt, Artificial Sequence
  targeting sequence with ATCN PAM
uccuugccagcacagugacc

SEQ ID NO: 3858 - RNA, 20 nt, Artificial Sequence
  targeting sequence with ATCN PAM
uccaggagacccccuaagua

SEQ ID NO: 3859 - RNA, 20 nt, Artificial Sequence
  targeting sequence with ATCN PAM
cuaaagccaccaaugacaug

SEQ ID NO: 3860 - RNA, 20 nt, Artificial Sequence
  targeting sequence with ATCN PAM
ugguauccccugaaacuaac

SEQ ID NO: 3861 - RNA, 20 nt, Artificial Sequence
  targeting sequence with ATCN PAM
ccugaaacuaacaacauuca

SEQ ID NO: 3862 - RNA, 20 nt, Artificial Sequence
  targeting sequence with ATCN PAM
acgcgguaagcaugcccagu

SEQ ID NO: 3863 - RNA, 20 nt, Artificial Sequence
  targeting sequence with ATCN PAM
cgggggcggggcaggugcca

SEQ ID NO: 3864 - RNA, 20 nt, Artificial Sequence
  targeting sequence with ATCN PAM
cuccacaugcacaggugacc

SEQ ID NO: 3865 - RNA, 20 nt, Artificial Sequence
  targeting sequence with ATCN PAM
ggcuggccgccccuuuaguu

SEQ ID NO: 3866 - RNA, 20 nt, Artificial Sequence
  targeting sequence with ATCN PAM
ucgaggcugugugggugaau

SEQ ID NO: 3867 - RNA, 20 nt, Artificial Sequence
  targeting sequence with ATCN PAM
ccuccagcccaaaacuacac

SEQ ID NO: 3868 - RNA, 20 nt, Artificial Sequence
  targeting sequence with ATCN PAM
ugaaggcuguguugagcuuu

SEQ ID NO: 3869 - RNA, 20 nt, Artificial Sequence
  targeting sequence with ATCN PAM
agcuuaaaagcccccuguuc

SEQ ID NO: 3870 - RNA, 20 nt, Artificial Sequence
  targeting sequence with ATCN PAM
gggaaggcuucagaacaggg

SEQ ID NO: 3871 - RNA, 20 nt, Artificial Sequence
  targeting sequence with ATCN PAM
ggccuucucaggagcagcac

SEQ ID NO: 3872 - RNA, 20 nt, Artificial Sequence
  targeting sequence with ATCN PAM
gccagccacagggacauaaa

SEQ ID NO: 3873 - RNA, 20 nt, Artificial Sequence
  targeting sequence with ATCN PAM
cagaugcccggcacguggcc

SEQ ID NO: 3874 - RNA, 20 nt, Artificial Sequence
  targeting sequence with ATCN PAM
gggaugugucgggaagccuc

SEQ ID NO: 3875 - RNA, 20 nt, Artificial Sequence
  targeting sequence with ATCN PAM
guuacuuccauggaggagcu

SEQ ID NO: 3876 - RNA, 20 nt, Artificial Sequence
  targeting sequence with ATCN PAM
gggcuggggguuggggacgc

SEQ ID NO: 3877 - RNA, 20 nt, Artificial Sequence
  targeting sequence with ATCN PAM
uggugccucuggccaacacu

SEQ ID NO: 3878 - RNA, 20 nt, Artificial Sequence
  targeting sequence with ATCN PAM
cuaagguggacauggcggga

SEQ ID NO: 3879 - RNA, 20 nt, Artificial Sequence
  targeting sequence with ATCN PAM
cucugagcugggagguaugg

SEQ ID NO: 3880 - RNA, 20 nt, Artificial Sequence
  targeting sequence with ATCN PAM
gguguagaauaaagaagcgu

SEQ ID NO: 3881 - RNA, 20 nt, Artificial Sequence
  targeting sequence with ATCN PAM
gucccuguccugcucucauc

SEQ ID NO: 3882 - RNA, 20 nt, Artificial Sequence
  targeting sequence with ATCN PAM
gagggcauggaauccauguu

SEQ ID NO: 3883 - RNA, 20 nt, Artificial Sequence
  targeting sequence with ATCN PAM
auguuuccacucaggccucg

SEQ ID NO: 3884 - RNA, 20 nt, Artificial Sequence
  targeting sequence with ATCN PAM
guucagagccuccugcacgc

SEQ ID NO: 3885 - RNA, 20 nt, Artificial Sequence
  targeting sequence with ATCN PAM
auaaaaugggaccugccuga

SEQ ID NO: 3886 - RNA, 20 nt, Artificial Sequence
  targeting sequence with ATCN PAM
cucugugccucuguuucccc

SEQ ID NO: 3887 - RNA, 20 nt, Artificial Sequence
  targeting sequence with ATCN PAM
uagggaagcuacugaaucuc

SEQ ID NO: 3888 - RNA, 20 nt, Artificial Sequence
  targeting sequence with ATCN PAM
uacagccacagcucacaccu

SEQ ID NO: 3889 - RNA, 20 nt, Artificial Sequence
  targeting sequence with ATCN PAM
cugaagcccugucuaccccg

SEQ ID NO: 3890 - RNA, 20 nt, Artificial Sequence
  targeting sequence with ATCN PAM
ucucaggaaucccugaagcc

SEQ ID NO: 3891 - RNA, 20 nt, Artificial Sequence
  targeting sequence with ATCN PAM
acuaaauggggugggagcaa

SEQ ID NO: 3892 - RNA, 20 nt, Artificial Sequence
  targeting sequence with ATCN PAM
uucccaggcagccccgauga

SEQ ID NO: 3893 - RNA, 20 nt, Artificial Sequence
  targeting sequence with ATCN PAM
acgacugcagccgcacugca

SEQ ID NO: 3894 - RNA, 20 nt, Artificial Sequence
  targeting sequence with ATCN PAM
ucaaggccaauuucaccauc

SEQ ID NO: 3895 - RNA, 20 nt, Artificial Sequence
  targeting sequence with ATCN PAM
caacagucacguggucugga

SEQ ID NO: 3896 - RNA, 20 nt, Artificial Sequence
  targeting sequence with ATCN PAM
auuccagaccacgugacugu

SEQ ID NO: 3897 - RNA, 20 nt, Artificial Sequence
  targeting sequence with ATCN PAM
ggugaccaaaggcagggccu

SEQ ID NO: 3898 - RNA, 20 nt, Artificial Sequence
  targeting sequence with ATCN PAM
gcacuguggcucggguccca

SEQ ID NO: 3899 - RNA, 20 nt, Artificial Sequence
  targeting sequence with ATCN PAM
ccaugccacugaggcugggc

SEQ ID NO: 3900 - RNA, 20 nt, Artificial Sequence
  targeting sequence with ATCN PAM
cgggcagccugcccagccuc

SEQ ID NO: 3901 - RNA, 20 nt, Artificial Sequence
  targeting sequence with ATCN PAM
gcaggaucaugcccuggggg

SEQ ID NO: 3902 - RNA, 20 nt, Artificial Sequence
  targeting sequence with ATCN PAM
ugcagaucucgggcagccug

SEQ ID NO: 3903 - RNA, 20 nt, Artificial Sequence
  targeting sequence with ATCN PAM
ugcccugggggcaaggagcc

SEQ ID NO: 3904 - RNA, 20 nt, Artificial Sequence
  targeting sequence with ATCN PAM
aucucggaaggcaggacggu

SEQ ID NO: 3905 - RNA, 20 nt, Artificial Sequence
  targeting sequence with ATCN PAM
augugcgccaggaguaccca

SEQ ID NO: 3906 - RNA, 20 nt, Artificial Sequence
  targeting sequence with ATCN PAM
cggaaggcaggacggucaug

SEQ ID NO: 3907 - RNA, 20 nt, Artificial Sequence
  targeting sequence with ATCN PAM
gggggcagaggugggggccc

SEQ ID NO: 3908 - RNA, 20 nt, Artificial Sequence
  targeting sequence with ATCN PAM
cagcaccagccgagcccucu

SEQ ID NO: 3909 - RNA, 20 nt, Artificial Sequence
  targeting sequence with ATCN PAM
gguaaagguaaccggagucu

SEQ ID NO: 3910 - RNA, 20 nt, Artificial Sequence
  targeting sequence with ATCN PAM
accugaacgagagcaugcag

SEQ ID NO: 3911 - RNA, 20 nt, Artificial Sequence
  targeting sequence with ATCN PAM
guggggguagugggcaucag

SEQ ID NO: 3912 - RNA, 20 nt, Artificial Sequence
  targeting sequence with ATCN PAM
gggugcuggagcccauagca

SEQ ID NO: 3913 - RNA, 20 nt, Artificial Sequence
  targeting sequence with ATCN PAM
ugucuuggacccuucaggag

SEQ ID NO: 3914 - RNA, 20 nt, Artificial Sequence
  targeting sequence with ATCN PAM
aggcccggcccugugcccuc

SEQ ID NO: 3915 - RNA, 20 nt, Artificial Sequence
  targeting sequence with ATCN PAM
cgcccugugaacgugugcag

SEQ ID NO: 3916 - RNA, 20 nt, Artificial Sequence
  targeting sequence with ATCN PAM
aaacccaagccccugcccuu

SEQ ID NO: 3917 - RNA, 20 nt, Artificial Sequence
  targeting sequence with ATCN PAM
gccuggccugugucuuauuu

SEQ ID NO: 3918 - RNA, 20 nt, Artificial Sequence
  targeting sequence with ATCN PAM
gaggcugggagcggccgagg

SEQ ID NO: 3919 - RNA, 20 nt, Artificial Sequence
  targeting sequence with ATCN PAM
cuucacuuugugccucuugc

SEQ ID NO: 3920 - RNA, 20 nt, Artificial Sequence
  targeting sequence with ATCN PAM
caaggcuacaaugcaauacc

SEQ ID NO: 3921 - RNA, 20 nt, Artificial Sequence
  targeting sequence with ATCN PAM
uggucuuccuccucccugca

SEQ ID NO: 3922 - RNA, 20 nt, Artificial Sequence
  targeting sequence with ATCN PAM
ggggccuggaagcuucucug

SEQ ID NO: 3923 - RNA, 20 nt, Artificial Sequence
  targeting sequence with ATCN PAM
ucaggaggacacgcagaggg

SEQ ID NO: 3924 - RNA, 20 nt, Artificial Sequence
  targeting sequence with ATCN PAM
caaaaugcccagccuggggc

SEQ ID NO: 3925 - RNA, 20 nt, Artificial Sequence
  targeting sequence with ATCN PAM
ccaggaccuugagugccaga

SEQ ID NO: 3926 - RNA, 20 nt, Artificial Sequence
  targeting sequence with ATCN PAM
aacccggacaaccccagcuu

SEQ ID NO: 3927 - RNA, 20 nt, Artificial Sequence
  targeting sequence with ATCN PAM
ccacccccucaacccugcuc

SEQ ID NO: 3928 - RNA, 20 nt, Artificial Sequence
  targeting sequence with ATCN PAM
uuuauugagcaacuacugug

SEQ ID NO: 3929 - RNA, 20 nt, Artificial Sequence
  targeting sequence with ATCN PAM
ccacacccagcacaggcccu

SEQ ID NO: 3930 - RNA, 20 nt, Artificial Sequence
  targeting sequence with ATCN PAM
uuuccccucucagagccuca

SEQ ID NO: 3931 - RNA, 20 nt, Artificial Sequence
  targeting sequence with ATCN PAM
guggcaugagaaucgugccu

SEQ ID NO: 3932 - RNA, 20 nt, Artificial Sequence
  targeting sequence with ATCN PAM
ugccucugccucccuugcag

SEQ ID NO: 3933 - RNA, 20 nt, Artificial Sequence
  targeting sequence with ATCN PAM
ucucacuuaauucucacacc

SEQ ID NO: 3934 - RNA, 20 nt, Artificial Sequence
  targeting sequence with ATCN PAM
cccaagucccccccaaccca

SEQ ID NO: 3935 - RNA, 20 nt, Artificial Sequence
  targeting sequence with ATCN PAM
gaucugagcaguuaggccgg

SEQ ID NO: 3936 - RNA, 20 nt, Artificial Sequence
  targeting sequence with ATCN PAM
gaucacccaaguccccccca

SEQ ID NO: 3937 - RNA, 20 nt, Artificial Sequence
  targeting sequence with ATCN PAM
gagcaguuaggccgggccug

SEQ ID NO: 3938 - RNA, 20 nt, Artificial Sequence
  targeting sequence with ATCN PAM
cuccugcucccucuugggag

SEQ ID NO: 3939 - RNA, 20 nt, Artificial Sequence
  targeting sequence with ATCN PAM
aguuucccugcucuggggca

SEQ ID NO: 3940 - RNA, 20 nt, Artificial Sequence
  targeting sequence with ATCN PAM
ccucccagcuccaggaaucu

SEQ ID NO: 3941 - RNA, 20 nt, Artificial Sequence
  targeting sequence with ATCN PAM
ccaaccauaccuaccuugag

SEQ ID NO: 3942 - RNA, 20 nt, Artificial Sequence
  targeting sequence with ATCN PAM
ugcagccccugaaggccacg

SEQ ID NO: 3943 - RNA, 20 nt, Artificial Sequence
  targeting sequence with ATCN PAM
gacgugccguuccucuucca

SEQ ID NO: 3944 - RNA, 20 nt, Artificial Sequence
  targeting sequence with ATCN PAM
cagcuccagaaccuucuccg

SEQ ID NO: 3945 - RNA, 20 nt, Artificial Sequence
  targeting sequence with ATCN PAM
cagccagcugugcgggcggg

SEQ ID NO: 3946 - RNA, 20 nt, Artificial Sequence
  targeting sequence with ATCN PAM
caggcccuggcaucagagcu

SEQ ID NO: 3947 - RNA, 20 nt, Artificial Sequence
  targeting sequence with ATCN PAM
gagcuuucaagucuuguucc

SEQ ID NO: 3948 - RNA, 20 nt, Artificial Sequence
  targeting sequence with ATCN PAM
ucagugcucagcugaggccc

SEQ ID NO: 3949 - RNA, 20 nt, Artificial Sequence
  targeting sequence with ATCN PAM
ccaagcccaggccugcccug

SEQ ID NO: 3950 - RNA, 20 nt, Artificial Sequence
  targeting sequence with ATCN PAM
ccuuggaacagcucuguaac

SEQ ID NO: 3951 - RNA, 20 nt, Artificial Sequence
  targeting sequence with ATCN PAM
ucuccuuggaacagcucugu

SEQ ID NO: 3952 - RNA, 20 nt, Artificial Sequence
  targeting sequence with ATCN PAM
aaccugaccuuguucccucg

SEQ ID NO: 3953 - RNA, 20 nt, Artificial Sequence
  targeting sequence with ATCN PAM
gguguggacuccucugcucu

SEQ ID NO: 3954 - RNA, 20 nt, Artificial Sequence
  targeting sequence with ATCN PAM
ccucaucugcccacauuaca

SEQ ID NO: 3955 - RNA, 20 nt, Artificial Sequence
  targeting sequence with ATCN PAM
gcccacauuacagggggaca

SEQ ID NO: 3956 - RNA, 20 nt, Artificial Sequence
  targeting sequence with ATCN PAM
cccaugcccuccagcagcaa

SEQ ID NO: 3957 - RNA, 20 nt, Artificial Sequence
  targeting sequence with ATCN PAM
gcugcggcucacagggcagc

SEQ ID NO: 3958 - RNA, 20 nt, Artificial Sequence
  targeting sequence with ATCN PAM
ccucucacagcugcccugug

SEQ ID NO: 3959 - RNA, 20 nt, Artificial Sequence
  targeting sequence with ATCN PAM
cauguccgggcuguucccug

SEQ ID NO: 3960 - RNA, 20 nt, Artificial Sequence
  targeting sequence with ATCN PAM
gacacauguguguguccccu

SEQ ID NO: 3961 - RNA, 20 nt, Artificial Sequence
  targeting sequence with ATCN PAM
uggcuuaucauccaggagag

SEQ ID NO: 3962 - RNA, 20 nt, Artificial Sequence
  targeting sequence with ATCN PAM
uccaggagagcagcccccau

SEQ ID NO: 3963 - RNA, 20 nt, Artificial Sequence
  targeting sequence with ATCN PAM
aggagagcagcccccauccc

SEQ ID NO: 3964 - RNA, 20 nt, Artificial Sequence
  targeting sequence with ATCN PAM
cgcagugacgccauaagccc

SEQ ID NO: 3965 - RNA, 20 nt, Artificial Sequence
  targeting sequence with ATCN PAM
gugugggcuuauggcgucac

SEQ ID NO: 3966 - RNA, 20 nt, Artificial Sequence
  targeting sequence with ATCN PAM
ugugacuuuucuuguaauca

SEQ ID NO: 3967 - RNA, 20 nt, Artificial Sequence
  targeting sequence with ATCN PAM
uggcagcccuagggguccua

SEQ ID NO: 3968 - RNA, 20 nt, Artificial Sequence
  targeting sequence with ATCN PAM
cacagauggggaaacugagg

SEQ ID NO: 3969 - RNA, 20 nt, Artificial Sequence
  targeting sequence with ATCN PAM
gugagauaggaccccuaggg

SEQ ID NO: 3970 - RNA, 20 nt, Artificial Sequence
  targeting sequence with ATCN PAM
gaggcucagagcaggacuca

SEQ ID NO: 3971 - RNA, 20 nt, Artificial Sequence
  targeting sequence with ATCN PAM
uuagggcaaagcuuuaaaga

SEQ ID NO: 3972 - RNA, 20 nt, Artificial Sequence
  targeting sequence with ATCN PAM
auaguguuuuccgcauagag

SEQ ID NO: 3973 - RNA, 20 nt, Artificial Sequence
  targeting sequence with ATCN PAM
cagccucuaugcggaaaaca

SEQ ID NO: 3974 - RNA, 20 nt, Artificial Sequence
  targeting sequence with ATCN PAM
uuuguuuuaaaguguuccca

SEQ ID NO: 3975 - RNA, 20 nt, Artificial Sequence
  targeting sequence with ATCN PAM
uccagccucagccucccaag

SEQ ID NO: 3976 - RNA, 20 nt, Artificial Sequence
  targeting sequence with ATCN PAM
cuugaguccaggaguucuag

SEQ ID NO: 3977 - RNA, 20 nt, Artificial Sequence
  targeting sequence with ATCN PAM
gcauagcacacuacagccua

SEQ ID NO: 3978 - RNA, 20 nt, Artificial Sequence
  targeting sequence with ATCN PAM
gguguccacacuaaguucag

SEQ ID NO: 3979 - RNA, 20 nt, Artificial Sequence
  targeting sequence with ATCN PAM
auauggugaccucccgggag

SEQ ID NO: 3980 - RNA, 20 nt, Artificial Sequence
  targeting sequence with ATCN PAM
gcuaacacuuccuggacacu

SEQ ID NO: 3981 - RNA, 20 nt, Artificial Sequence
  targeting sequence with ATCN PAM
gcaguugaacauggguaacu

SEQ ID NO: 3982 - RNA, 20 nt, Artificial Sequence
  targeting sequence with ATCN PAM
aaaaagaaagaaagaaaauu

SEQ ID NO: 3983 - RNA, 20 nt, Artificial Sequence
  targeting sequence with ATCN PAM
ugccuaccuuaaagcuuuug

SEQ ID NO: 3984 - RNA, 20 nt, Artificial Sequence
  targeting sequence with ATCN PAM
ucucaccuggacagcccucc

SEQ ID NO: 3985 - RNA, 20 nt, Artificial Sequence
  targeting sequence with ATCN PAM
gcuaacacagcugccaaaug

SEQ ID NO: 3986 - RNA, 20 nt, Artificial Sequence
  targeting sequence with ATCN PAM
ggggagaccugcuuuacauu

SEQ ID NO: 3987 - RNA, 20 nt, Artificial Sequence
  targeting sequence with ATCN PAM
ugaauccuaaauccucccgu

SEQ ID NO: 3988 - RNA, 20 nt, Artificial Sequence
  targeting sequence with ATCN PAM
uaaauccucccguggguccc

SEQ ID NO: 3989 - RNA, 20 nt, Artificial Sequence
  targeting sequence with ATCN PAM
ucccguggguccccucaucu

SEQ ID NO: 3990 - RNA, 20 nt, Artificial Sequence
  targeting sequence with ATCN PAM
ucuaacuccauuucacaccu

SEQ ID NO: 3991 - RNA, 20 nt, Artificial Sequence
  targeting sequence with ATCN PAM
caagcucguuccugccucag

SEQ ID NO: 3992 - RNA, 20 nt, Artificial Sequence
  targeting sequence with ATCN PAM
uuggcaccuccucucagugc

SEQ ID NO: 3993 - RNA, 20 nt, Artificial Sequence
  targeting sequence with ATCN PAM
uguguguguuacaguugggg

SEQ ID NO: 3994 - RNA, 20 nt, Artificial Sequence
  targeting sequence with ATCN PAM
ugcagcugcagggaagaggu

SEQ ID NO: 3995 - RNA, 20 nt, Artificial Sequence
  targeting sequence with ATCN PAM
caccucaccucuucccugca

SEQ ID NO: 3996 - RNA, 20 nt, Artificial Sequence
  targeting sequence with ATCN PAM
ucaccacugcgagggaugau

SEQ ID NO: 3997 - RNA, 20 nt, Artificial Sequence
  targeting sequence with ATCN PAM
cucgcaguggugaggauccc

SEQ ID NO: 3998 - RNA, 20 nt, Artificial Sequence
  targeting sequence with ATCN PAM
ucccucgcaguggugaggau

SEQ ID NO: 3999 - RNA, 20 nt, Artificial Sequence
  targeting sequence with ATCN PAM
uuuaaaaauaaguuguuuaa

SEQ ID NO: 4000 - RNA, 20 nt, Artificial Sequence
  targeting sequence with ATCN PAM
cucccaccaagggaacauaa

SEQ ID NO: 4001 - RNA, 20 nt, Artificial Sequence
  targeting sequence with ATCN PAM
ggggccucccaggugucccc

SEQ ID NO: 4002 - RNA, 20 nt, Artificial Sequence
  targeting sequence with ATCN PAM
agccagggugggguccuggg

SEQ ID NO: 4003 - RNA, 20 nt, Artificial Sequence
  targeting sequence with ATCN PAM
ccccgagcugggcgccuggu

SEQ ID NO: 4004 - RNA, 20 nt, Artificial Sequence
  targeting sequence with ATCN PAM
gugggcuagggcagcaggga

SEQ ID NO: 4005 - RNA, 20 nt, Artificial Sequence
  targeting sequence with ATCN PAM
uaaaauaaaauuuuaaaaaa

SEQ ID NO: 4006 - RNA, 20 nt, Artificial Sequence
  targeting sequence with ATCN PAM
uucggagcagccgacggcuu

SEQ ID NO: 4007 - RNA, 20 nt, Artificial Sequence
  targeting sequence with ATCN PAM
guguuccgagggggaagcug

SEQ ID NO: 4008 - RNA, 20 nt, Artificial Sequence
  targeting sequence with ATCN PAM
gcuucccccucggaacacag

SEQ ID NO: 4009 - RNA, 20 nt, Artificial Sequence
  targeting sequence with ATCN PAM
caaggcaaaccggcucaaac

SEQ ID NO: 4010 - RNA, 20 nt, Artificial Sequence
  targeting sequence with ATCN PAM
cccucccccagcaggggcgg

SEQ ID NO: 4011 - RNA, 20 nt, Artificial Sequence
  targeting sequence with ATCN PAM
ccgcagcgcccuccaaguca

SEQ ID NO: 4012 - RNA, 20 nt, Artificial Sequence
  targeting sequence with ATCN PAM
uucucucacacaaagcuggu

SEQ ID NO: 4013 - RNA, 20 nt, Artificial Sequence
  targeting sequence with ATCN PAM
cgaggacagccaggagcugg

SEQ ID NO: 4014 - RNA, 20 nt, Artificial Sequence
  targeting sequence with ATCN PAM
agccccagcaguccagccuc

SEQ ID NO: 4015 - RNA, 20 nt, Artificial Sequence
  targeting sequence with ATCN PAM
gucuccacagguccuggaau

SEQ ID NO: 4016 - RNA, 20 nt, Artificial Sequence
  targeting sequence with ATCN PAM
caugccucugaggcauucgu

SEQ ID NO: 4017 - RNA, 20 nt, Artificial Sequence
  targeting sequence with ATCN PAM
ugaaaacuugccgucugggc

SEQ ID NO: 4018 - RNA, 20 nt, Artificial Sequence
  targeting sequence with ATCN PAM
caggaguuggggggcugagc

SEQ ID NO: 4019 - RNA, 20 nt, Artificial Sequence
  targeting sequence with ATCN PAM
cucucucacaugggaugagc

SEQ ID NO: 4020 - RNA, 20 nt, Artificial Sequence
  targeting sequence with ATCN PAM
caugugagagagggauaaag

SEQ ID NO: 4021 - RNA, 20 nt, Artificial Sequence
  targeting sequence with ATCN PAM
ugcucucaaaacggggccga

SEQ ID NO: 4022 - RNA, 20 nt, Artificial Sequence
  targeting sequence with ATCN PAM
auaugucagaguuuuaaugg

SEQ ID NO: 4023 - RNA, 20 nt, Artificial Sequence
  targeting sequence with ATCN PAM
ugccgcagacccaccgcagg

SEQ ID NO: 4024 - RNA, 20 nt, Artificial Sequence
  targeting sequence with ATCN PAM
uuuucauagugccaccugcg

SEQ ID NO: 4025 - RNA, 20 nt, Artificial Sequence
  targeting sequence with ATCN PAM
agcgguuccgucacagguac

SEQ ID NO: 4026 - RNA, 20 nt, Artificial Sequence
  targeting sequence with ATCN PAM
aacacuucaggcaggaaggu

SEQ ID NO: 4027 - RNA, 20 nt, Artificial Sequence
  targeting sequence with ATCN PAM
uaaacaaucaaacacuucag

SEQ ID NO: 4028 - RNA, 20 nt, Artificial Sequence
  targeting sequence with ATCN PAM
ugggaaagucagguuuccuu

SEQ ID NO: 4029 - RNA, 20 nt, Artificial Sequence
  targeting sequence with ATCN PAM
ugugcuuucagcucuguggc

SEQ ID NO: 4030 - RNA, 20 nt, Artificial Sequence
  targeting sequence with ATCN PAM
cuuugggguauuaagacugc

SEQ ID NO: 4031 - RNA, 20 nt, Artificial Sequence
  targeting sequence with ATCN PAM
cagcgcuuugggagguggac

SEQ ID NO: 4032 - RNA, 20 nt, Artificial Sequence
  targeting sequence with ATCN PAM
uuccacguccaccucccaaa

SEQ ID NO: 4033 - RNA, 20 nt, Artificial Sequence
  targeting sequence with ATCN PAM
ccugaagccuggaggucaag

SEQ ID NO: 4034 - RNA, 20 nt, Artificial Sequence
  targeting sequence with ATCN PAM
uggccggggacugggcuguc

SEQ ID NO: 4035 - RNA, 20 nt, Artificial Sequence
  targeting sequence with ATCN PAM
uucacgggagccaaagagag

SEQ ID NO: 4036 - RNA, 20 nt, Artificial Sequence
  targeting sequence with ATCN PAM
uaccguuaccgugguacauu

SEQ ID NO: 4037 - RNA, 20 nt, Artificial Sequence
  targeting sequence with ATCN PAM
uuguaacuuuccugaaaauc

SEQ ID NO: 4038 - RNA, 20 nt, Artificial Sequence
  targeting sequence with ATCN PAM
aaaauuauuccaaaguaaaa

SEQ ID NO: 4039 - RNA, 20 nt, Artificial Sequence
  targeting sequence with ATCN PAM
ccugugcagcucaacagcuu

SEQ ID NO: 4040 - RNA, 20 nt, Artificial Sequence
  targeting sequence with ATCN PAM
ggcccugaccucuguggccu

SEQ ID NO: 4041 - RNA, 20 nt, Artificial Sequence
  targeting sequence with ATCN PAM
ucucccuacagccccuccag

SEQ ID NO: 4042 - RNA, 20 nt, Artificial Sequence
  targeting sequence with ATCN PAM
agaccagcuggacaccaucu

SEQ ID NO: 4043 - RNA, 20 nt, Artificial Sequence
  targeting sequence with ATCN PAM
ggaagggcugaagccagcca

SEQ ID NO: 4044 - RNA, 20 nt, Artificial Sequence
  targeting sequence with ATCN PAM
ugcccagucuguguguuggc

SEQ ID NO: 4045 - RNA, 20 nt, Artificial Sequence
  targeting sequence with ATCN PAM
gcccacccaccccaaacagg

SEQ ID NO: 4046 - RNA, 20 nt, Artificial Sequence
  targeting sequence with ATCN PAM
agccaggcuugugaccuaag

SEQ ID NO: 4047 - RNA, 20 nt, Artificial Sequence
  targeting sequence with ATCN PAM
guaaaauggguacgcagcaa

SEQ ID NO: 4048 - RNA, 20 nt, Artificial Sequence
  targeting sequence with ATCN PAM
ccucugaaccucggacucca

SEQ ID NO: 4049 - RNA, 20 nt, Artificial Sequence
  targeting sequence with ATCN PAM
guaaaauaagacagcaauag

SEQ ID NO: 4050 - RNA, 20 nt, Artificial Sequence
  targeting sequence with ATCN PAM
gaggcuggaugggcuacacc

SEQ ID NO: 4051 - RNA, 20 nt, Artificial Sequence
  targeting sequence with ATCN PAM
agccucggaugcuuugacuu

SEQ ID NO: 4052 - RNA, 20 nt, Artificial Sequence
  targeting sequence with ATCN PAM
cacacugugcuccucuggga

SEQ ID NO: 4053 - RNA, 20 nt, Artificial Sequence
  targeting sequence with ATCN PAM
aaccuccaaguccccccagc

SEQ ID NO: 4054 - RNA, 20 nt, Artificial Sequence
  targeting sequence with ATCN PAM
cacacccuccuccccagccc

SEQ ID NO: 4055 - RNA, 20 nt, Artificial Sequence
  targeting sequence with ATCN PAM
cacgaccgcuguggacacag

SEQ ID NO: 4056 - RNA, 20 nt, Artificial Sequence
  targeting sequence with ATCN PAM
ccgggcuggauuccaugagc

SEQ ID NO: 4057 - RNA, 20 nt, Artificial Sequence
  targeting sequence with ATCN PAM
agcccggagauguuugcgca

SEQ ID NO: 4058 - RNA, 20 nt, Artificial Sequence
  targeting sequence with ATCN PAM
gagcucagaggcccagcccc

SEQ ID NO: 4059 - RNA, 20 nt, Artificial Sequence
  targeting sequence with ATCN PAM
uggggcugggccucugagcu

SEQ ID NO: 4060 - RNA, 20 nt, Artificial Sequence
  targeting sequence with ATCN PAM
cauucaacccucaccacacc

SEQ ID NO: 4061 - RNA, 20 nt, Artificial Sequence
  targeting sequence with ATCN PAM
acucuuucagggugugguga

SEQ ID NO: 4062 - RNA, 20 nt, Artificial Sequence
  targeting sequence with ATCN PAM
cuucaacucucugugccuca

SEQ ID NO: 4063 - RNA, 20 nt, Artificial Sequence
  targeting sequence with ATCN PAM
agccauuccggcugugugcc

SEQ ID NO: 4064 - RNA, 20 nt, Artificial Sequence
  targeting sequence with ATCN PAM
aagccuccagcgcaggccug

SEQ ID NO: 4065 - RNA, 20 nt, Artificial Sequence
  targeting sequence with ATCN PAM
ggagcccgcaggccugcgcu

SEQ ID NO: 4066 - RNA, 20 nt, Artificial Sequence
  targeting sequence with ATCN PAM
ccgcccuuaaccacagccuc

SEQ ID NO: 4067 - RNA, 20 nt, Artificial Sequence
  targeting sequence with ATCN PAM
gccgcuuggagcuggaaaaa

SEQ ID NO: 4068 - RNA, 20 nt, Artificial Sequence
  targeting sequence with ATCN PAM
aggugauggcugcuucuaga

SEQ ID NO: 4069 - RNA, 20 nt, Artificial Sequence
  targeting sequence with ATCN PAM
ccuugaugggccucaguuuc

SEQ ID NO: 4070 - RNA, 20 nt, Artificial Sequence
  targeting sequence with ATCN PAM
uuguuugaggugacugagcu

SEQ ID NO: 4071 - RNA, 20 nt, Artificial Sequence
  targeting sequence with ATCN PAM
guaaauaaugggggggggcc

SEQ ID NO: 4072 - RNA, 20 nt, Artificial Sequence
  targeting sequence with ATCN PAM
gagcauaaagugcuacauga

SEQ ID NO: 4073 - RNA, 20 nt, Artificial Sequence
  targeting sequence with ATCN PAM
uguagcacuuuaugcucuga

SEQ ID NO: 4074 - RNA, 20 nt, Artificial Sequence
  targeting sequence with ATCN PAM
ugcgcuggagggggagggaa

SEQ ID NO: 4075 - RNA, 20 nt, Artificial Sequence
  targeting sequence with ATCN PAM
aguuucaggguaaaggacgg

SEQ ID NO: 4076 - RNA, 20 nt, Artificial Sequence
  targeting sequence with ATCN PAM
gggggccagcgccagcgggg

SEQ ID NO: 4077 - RNA, 20 nt, Artificial Sequence
  targeting sequence with ATCN PAM
ugacugcaucgaguaucagc

SEQ ID NO: 4078 - RNA, 20 nt, Artificial Sequence
  targeting sequence with ATCN PAM
aguaucagccgagcagggug

SEQ ID NO: 4079 - RNA, 20 nt, Artificial Sequence
  targeting sequence with ATCN PAM
gccgagcaggguggagcagg

SEQ ID NO: 4080 - RNA, 20 nt, Artificial Sequence
  targeting sequence with ATCN PAM
aguggcaggggcccugcucc

SEQ ID NO: 4081 - RNA, 20 nt, Artificial Sequence
  targeting sequence with ATCN PAM
ucacugccccccaaguacag

SEQ ID NO: 4082 - RNA, 20 nt, Artificial Sequence
  targeting sequence with ATCN PAM
aaguccacguggcuggcacu

SEQ ID NO: 4083 - RNA, 20 nt, Artificial Sequence
  targeting sequence with ATCN PAM
ccacauggcugucagagcug

SEQ ID NO: 4084 - RNA, 20 nt, Artificial Sequence
  targeting sequence with ATCN PAM
aggggcggaggcgcucaccc

SEQ ID NO: 4085 - RNA, 20 nt, Artificial Sequence
  targeting sequence with ATCN PAM
ugccagcaccuggcagggcc

SEQ ID NO: 4086 - RNA, 20 nt, Artificial Sequence
  targeting sequence with ATCN PAM
gguuccggaagggacccugu

SEQ ID NO: 4087 - RNA, 20 nt, Artificial Sequence
  targeting sequence with ATCN PAM
gccaugucucuccuuucccc

SEQ ID NO: 4088 - RNA, 20 nt, Artificial Sequence
  targeting sequence with ATCN PAM
aagucuuuagccugcaggca

SEQ ID NO: 4089 - RNA, 20 nt, Artificial Sequence
  targeting sequence with ATCN PAM
cugagccuuugccccuaucg

SEQ ID NO: 4090 - RNA, 20 nt, Artificial Sequence
  targeting sequence with ATCN PAM
ugugcucugccuggaaugcc

SEQ ID NO: 4091 - RNA, 20 nt, Artificial Sequence
  targeting sequence with ATCN PAM
gucaagugcugcuccaaccu

SEQ ID NO: 4092 - RNA, 20 nt, Artificial Sequence
  targeting sequence with ATCN PAM
gaggagugcgggagggcuuc

SEQ ID NO: 4093 - RNA, 20 nt, Artificial Sequence
  targeting sequence with ATCN PAM
gucugaugucaugaccuccu

SEQ ID NO: 4094 - RNA, 20 nt, Artificial Sequence
  targeting sequence with ATCN PAM
gacagaugccacacacuaac

SEQ ID NO: 4095 - RNA, 20 nt, Artificial Sequence
  targeting sequence with ATCN PAM
caugcccguccaagcucugg

SEQ ID NO: 4096 - RNA, 20 nt, Artificial Sequence
  targeting sequence with ATCN PAM
uaaccccagcccgcgaccau

SEQ ID NO: 4097 - RNA, 20 nt, Artificial Sequence
  targeting sequence with ATCN PAM
uggucgcgggcugggguuag

SEQ ID NO: 4098 - RNA, 20 nt, Artificial Sequence
  targeting sequence with ATCN PAM
uugaccgaaggggugugagc

SEQ ID NO: 4099 - RNA, 20 nt, Artificial Sequence
  targeting sequence with ATCN PAM
ugccugaggucacaccgugg

SEQ ID NO: 4100 - RNA, 20 nt, Artificial Sequence
  targeting sequence with ATCN PAM
ccagucuauggaaggggaaa

SEQ ID NO: 4101 - RNA, 20 nt, Artificial Sequence
  targeting sequence with ATCN PAM
ccccagaaccugaaugacau

SEQ ID NO: 4102 - RNA, 20 nt, Artificial Sequence
  targeting sequence with ATCN PAM
uuuaaucuccccagaaccug

SEQ ID NO: 4103 - RNA, 20 nt, Artificial Sequence
  targeting sequence with ATCN PAM
ugucauaauuacugugguug

SEQ ID NO: 4104 - RNA, 20 nt, Artificial Sequence
  targeting sequence with ATCN PAM
ccauggagaccgggagucac

SEQ ID NO: 4105 - RNA, 20 nt, Artificial Sequence
  targeting sequence with ATCN PAM
gacuuugcagagggcguuuc

SEQ ID NO: 4106 - RNA, 20 nt, Artificial Sequence
  targeting sequence with ATCN PAM
ggcccggcagaaacgcccuc

SEQ ID NO: 4107 - RNA, 20 nt, Artificial Sequence
  targeting sequence with ATCN PAM
auaaagugggcugagcgcag

SEQ ID NO: 4108 - RNA, 20 nt, Artificial Sequence
  targeting sequence with ATCN PAM
guucuuggagccuccauuuu

SEQ ID NO: 4109 - RNA, 20 nt, Artificial Sequence
  targeting sequence with ATCN PAM
ugccucugccccuuccuagc

SEQ ID NO: 4110 - RNA, 20 nt, Artificial Sequence
  targeting sequence with ATCN PAM
gggaaguuggccccaggguc

SEQ ID NO: 4111 - RNA, 20 nt, Artificial Sequence
  targeting sequence with ATCN PAM
cuaggugagugcaggacccu

SEQ ID NO: 4112 - RNA, 20 nt, Artificial Sequence
  targeting sequence with ATCN PAM
agggcgcugacagauccccc

SEQ ID NO: 4113 - RNA, 20 nt, Artificial Sequence
  targeting sequence with ATCN PAM
gucagcgcccuggauacgcc

SEQ ID NO: 4114 - RNA, 20 nt, Artificial Sequence
  targeting sequence with ATCN PAM
cccacucacccuccugggug

SEQ ID NO: 4115 - RNA, 20 nt, Artificial Sequence
  targeting sequence with ATCN PAM
uucacacugaccauugaacc

SEQ ID NO: 4116 - RNA, 20 nt, Artificial Sequence
  targeting sequence with ATCN PAM
cucauuugcacacccaaagg

SEQ ID NO: 4117 - RNA, 20 nt, Artificial Sequence
  targeting sequence with ATCN PAM
gccucuggaaggagugagcc

SEQ ID NO: 4118 - RNA, 20 nt, Artificial Sequence
  targeting sequence with ATCN PAM
ucagccucuggaaggaguga

SEQ ID NO: 4119 - RNA, 20 nt, Artificial Sequence
  targeting sequence with ATCN PAM
cauuuucagacaaaugcaac

SEQ ID NO: 4120 - RNA, 20 nt, Artificial Sequence
  targeting sequence with ATCN PAM
cccagcauguggccuggccu

SEQ ID NO: 4121 - RNA, 20 nt, Artificial Sequence
  targeting sequence with ATCN PAM
gcagaggccaggccacaugc

SEQ ID NO: 4122 - RNA, 20 nt, Artificial Sequence
  targeting sequence with ATCN PAM
caaugggcccugccugaauc

SEQ ID NO: 4123 - RNA, 20 nt, Artificial Sequence
  targeting sequence with ATCN PAM
cuauggcccagccagagggg

SEQ ID NO: 4124 - RNA, 20 nt, Artificial Sequence
  targeting sequence with ATCN PAM
gcggauccagacccucacuc

SEQ ID NO: 4125 - RNA, 20 nt, Artificial Sequence
  targeting sequence with ATCN PAM
gcagauagaagcaggagucc

SEQ ID NO: 4126 - RNA, 20 nt, Artificial Sequence
  targeting sequence with ATCN PAM
agacccucacuccccagcug

SEQ ID NO: 4127 - RNA, 20 nt, Artificial Sequence
  targeting sequence with ATCN PAM
ccagcuuacagaaggggaaa

SEQ ID NO: 4128 - RNA, 20 nt, Artificial Sequence
  targeting sequence with ATCN PAM
uccccagcuuacagaagggg

SEQ ID NO: 4129 - RNA, 20 nt, Artificial Sequence
  targeting sequence with ATCN PAM
ucauccccagcuuacagaag

SEQ ID NO: 4130 - RNA, 20 nt, Artificial Sequence
  targeting sequence with ATCN PAM
cagucucugugcuggggcug

SEQ ID NO: 4131 - RNA, 20 nt, Artificial Sequence
  targeting sequence with ATCN PAM
aauagggccugaaggcaggc

SEQ ID NO: 4132 - RNA, 20 nt, Artificial Sequence
  targeting sequence with ATCN PAM
caucuccuccaaggcccuga

SEQ ID NO: 4133 - RNA, 20 nt, Artificial Sequence
  targeting sequence with ATCN PAM
ccuccaaggcccugacccuc

SEQ ID NO: 4134 - RNA, 20 nt, Artificial Sequence
  targeting sequence with ATCN PAM
ccuguccacugaggccaguu

SEQ ID NO: 4135 - RNA, 20 nt, Artificial Sequence
  targeting sequence with ATCN PAM
agagggagaaaagacaccag

SEQ ID NO: 4136 - RNA, 20 nt, Artificial Sequence
  targeting sequence with ATCN PAM
caggggugucucucucagcc

SEQ ID NO: 4137 - RNA, 20 nt, Artificial Sequence
  targeting sequence with ATCN PAM
acccacauccuaggagggag

SEQ ID NO: 4138 - RNA, 20 nt, Artificial Sequence
  targeting sequence with ATCN PAM
uaggagggaggcauaagacc

SEQ ID NO: 4139 - RNA, 20 nt, Artificial Sequence
  targeting sequence with ATCN PAM
cucccagcccugagaauguc

SEQ ID NO: 4140 - RNA, 20 nt, Artificial Sequence
  targeting sequence with ATCN PAM
guuucuccaggccagagggu

SEQ ID NO: 4141 - RNA, 20 nt, Artificial Sequence
  targeting sequence with ATCN PAM
cagccaauccuccuagaacc

SEQ ID NO: 4142 - RNA, 20 nt, Artificial Sequence
  targeting sequence with ATCN PAM
uccuagaacccccucuccua

SEQ ID NO: 4143 - RNA, 20 nt, Artificial Sequence
  targeting sequence with ATCN PAM
ugccaagugucucugcuugc

SEQ ID NO: 4144 - RNA, 20 nt, Artificial Sequence
  targeting sequence with ATCN PAM
cccagugacgaagggugcaa

SEQ ID NO: 4145 - RNA, 20 nt, Artificial Sequence
  targeting sequence with ATCN PAM
cucccagcccccagcccaaa

SEQ ID NO: 4146 - RNA, 20 nt, Artificial Sequence
  targeting sequence with ATCN PAM
uggaagcucucucucccucc

SEQ ID NO: 4147 - RNA, 20 nt, Artificial Sequence
  targeting sequence with ATCN PAM
cagccccuaaauuggugcaa

SEQ ID NO: 4148 - RNA, 20 nt, Artificial Sequence
  targeting sequence with ATCN PAM
ggcaguuuuaaacuggcaug

SEQ ID NO: 4149 - RNA, 20 nt, Artificial Sequence
  targeting sequence with ATCN PAM
cccaacaagguggggcagac

SEQ ID NO: 4150 - RNA, 20 nt, Artificial Sequence
  targeting sequence with ATCN PAM
guggcacucaacaacuuccc

SEQ ID NO: 4151 - RNA, 20 nt, Artificial Sequence
  targeting sequence with ATCN PAM
caaccuguuuggagugcaag

SEQ ID NO: 4152 - RNA, 20 nt, Artificial Sequence
  targeting sequence with ATCN PAM
cuuuccucaaaucacaaccu

SEQ ID NO: 4153 - RNA, 20 nt, Artificial Sequence
  targeting sequence with ATCN PAM
aagcuacaugcaauggaggc

SEQ ID NO: 4154 - RNA, 20 nt, Artificial Sequence
  targeting sequence with ATCN PAM
uaacugccccaaauacguug

SEQ ID NO: 4155 - RNA, 20 nt, Artificial Sequence
  targeting sequence with ATCN PAM
gggacaaauuuggggacuuc

SEQ ID NO: 4156 - RNA, 20 nt, Artificial Sequence
  targeting sequence with ATCN PAM
ugacccaggcucuggaguug

SEQ ID NO: 4157 - RNA, 20 nt, Artificial Sequence
  targeting sequence with ATCN PAM
cuugagccgcccacaacucc

SEQ ID NO: 4158 - RNA, 20 nt, Artificial Sequence
  targeting sequence with ATCN PAM
agccagaugggaccaggaga

SEQ ID NO: 4159 - RNA, 20 nt, Artificial Sequence
  targeting sequence with ATCN PAM
ggcuggauuucucugucacu

SEQ ID NO: 4160 - RNA, 20 nt, Artificial Sequence
  targeting sequence with ATCN PAM
uuuuuucuccuggucccauc

SEQ ID NO: 4161 - RNA, 20 nt, Artificial Sequence
  targeting sequence with ATCN PAM
ucuuccccagagguacccca

SEQ ID NO: 4162 - RNA, 20 nt, Artificial Sequence
  targeting sequence with ATCN PAM
caugccccaccccaugggua

SEQ ID NO: 4163 - RNA, 20 nt, Artificial Sequence
  targeting sequence with ATCN PAM
auccuguugcugagccugac

SEQ ID NO: 4164 - RNA, 20 nt, Artificial Sequence
  targeting sequence with ATCN PAM
uguugcugagccugacucug

SEQ ID NO: 4165 - RNA, 20 nt, Artificial Sequence
  targeting sequence with ATCN PAM
caucacuccccaccacuggg

SEQ ID NO: 4166 - RNA, 20 nt, Artificial Sequence
  targeting sequence with ATCN PAM
cuccccaccacuggggcugc

SEQ ID NO: 4167 - RNA, 20 nt, Artificial Sequence
  targeting sequence with ATCN PAM
cagcccccaaaucuguccag

SEQ ID NO: 4168 - RNA, 20 nt, Artificial Sequence
  targeting sequence with ATCN PAM
guccagagcccaccugccac

SEQ ID NO: 4169 - RNA, 20 nt, Artificial Sequence
  targeting sequence with ATCN PAM
ccccacugccaucuggcacc

SEQ ID NO: 4170 - RNA, 20 nt, Artificial Sequence
  targeting sequence with ATCN PAM
ggcacccaccacagagccug

SEQ ID NO: 4171 - RNA, 20 nt, Artificial Sequence
  targeting sequence with ATCN PAM
ugagcacuuacugugugcca

SEQ ID NO: 4172 - RNA, 20 nt, Artificial Sequence
  targeting sequence with ATCN PAM
auucccgggaggcggccuca

SEQ ID NO: 4173 - RNA, 20 nt, Artificial Sequence
  targeting sequence with ATCN PAM
uuuauguaccuggcgccugu

SEQ ID NO: 4174 - RNA, 20 nt, Artificial Sequence
  targeting sequence with ATCN PAM
cauuuaauacccccaacagc

SEQ ID NO: 4175 - RNA, 20 nt, Artificial Sequence
  targeting sequence with ATCN PAM
ugggguccugggagccauga

SEQ ID NO: 4176 - RNA, 20 nt, Artificial Sequence
  targeting sequence with ATCN PAM
aggcaaagggagcagccugu

SEQ ID NO: 4177 - RNA, 20 nt, Artificial Sequence
  targeting sequence with ATCN PAM
guccucggcucaccugccca

SEQ ID NO: 4178 - RNA, 20 nt, Artificial Sequence
  targeting sequence with ATCN PAM
ggggcuagaaguaggagaug

SEQ ID NO: 4179 - RNA, 20 nt, Artificial Sequence
  targeting sequence with ATCN PAM
ccuacuucuagccccagaug

SEQ ID NO: 4180 - RNA, 20 nt, Artificial Sequence
  targeting sequence with ATCN PAM
ggcuuguucugcagcuguaa

SEQ ID NO: 4181 - RNA, 20 nt, Artificial Sequence
  targeting sequence with ATCN PAM
gcuuggugcuuacuguguac

SEQ ID NO: 4182 - RNA, 20 nt, Artificial Sequence
  targeting sequence with ATCN PAM
auucaucuaguccuuaaaac

SEQ ID NO: 4183 - RNA, 20 nt, Artificial Sequence
  targeting sequence with ATCN PAM
auaaaugcagcucaguguac

SEQ ID NO: 4184 - RNA, 20 nt, Artificial Sequence
  targeting sequence with ATCN PAM
aguccuuaaaacaaugcuuu

SEQ ID NO: 4185 - RNA, 20 nt, Artificial Sequence
  targeting sequence with ATCN PAM
caaagcauuguuuuaaggac

SEQ ID NO: 4186 - RNA, 20 nt, Artificial Sequence
  targeting sequence with ATCN PAM
uuaucccaaagcauuguuuu

SEQ ID NO: 4187 - RNA, 20 nt, Artificial Sequence
  targeting sequence with ATCN PAM
gugaaguggggacaguaaaa

SEQ ID NO: 4188 - RNA, 20 nt, Artificial Sequence
  targeting sequence with ATCN PAM
ggcugcuuggguucaagucc

SEQ ID NO: 4189 - RNA, 20 nt, Artificial Sequence
  targeting sequence with ATCN PAM
gucgcugcauagcuggcaac

SEQ ID NO: 4190 - RNA, 20 nt, Artificial Sequence
  targeting sequence with ATCN PAM
uuauucuugcuccaggcugu

SEQ ID NO: 4191 - RNA, 20 nt, Artificial Sequence
  targeting sequence with ATCN PAM
cucccccaccccugcccaug

SEQ ID NO: 4192 - RNA, 20 nt, Artificial Sequence
  targeting sequence with ATCN PAM
cccagaggugcucaaggucc

SEQ ID NO: 4193 - RNA, 20 nt, Artificial Sequence
  targeting sequence with ATCN PAM
guggccuugggguggggaag

SEQ ID NO: 4194 - RNA, 20 nt, Artificial Sequence
  targeting sequence with ATCN PAM
cacagaucagcuuacaccaa

SEQ ID NO: 4195 - RNA, 20 nt, Artificial Sequence
  targeting sequence with ATCN PAM
gugggauuccuuaggccagc

SEQ ID NO: 4196 - RNA, 20 nt, Artificial Sequence
  targeting sequence with ATCN PAM
gcuuacaccaaagggccgag

SEQ ID NO: 4197 - RNA, 20 nt, Artificial Sequence
  targeting sequence with ATCN PAM
cgcaggcaacuguguuuggc

SEQ ID NO: 4198 - RNA, 20 nt, Artificial Sequence
  targeting sequence with ATCN PAM
ccaccccagagcuucaucuc

SEQ ID NO: 4199 - RNA, 20 nt, Artificial Sequence
  targeting sequence with ATCN PAM
accaucuccaccccagagcu

SEQ ID NO: 4200 - RNA, 20 nt, Artificial Sequence
  targeting sequence with ATCN PAM
ggccggccacccugaaagua

SEQ ID NO: 4201 - RNA, 20 nt, Artificial Sequence
  targeting sequence with ATCN PAM
gcauuuucucaaagccccag

SEQ ID NO: 4202 - RNA, 20 nt, Artificial Sequence
  targeting sequence with ATCN PAM
caugaaauucuugucacagc

SEQ ID NO: 4203 - RNA, 20 nt, Artificial Sequence
  targeting sequence with ATCN PAM
gcaaaaugcagaacucagcc

SEQ ID NO: 4204 - RNA, 20 nt, Artificial Sequence
  targeting sequence with ATCN PAM
ccaucagcaaaaugcagaac

SEQ ID NO: 4205 - RNA, 20 nt, Artificial Sequence
  targeting sequence with ATCN PAM
gagucuggcgagcccacuuc

SEQ ID NO: 4206 - RNA, 20 nt, Artificial Sequence
  targeting sequence with ATCN PAM
ccauaguucacccugaggaa

SEQ ID NO: 4207 - RNA, 20 nt, Artificial Sequence
  targeting sequence with ATCN PAM
acagacccagcucccaaagc

SEQ ID NO: 4208 - RNA, 20 nt, Artificial Sequence
  targeting sequence with ATCN PAM
cuugccaugaacuuccuuuc

SEQ ID NO: 4209 - RNA, 20 nt, Artificial Sequence
  targeting sequence with ATCN PAM
gcauguguguugacaugaca

SEQ ID NO: 4210 - RNA, 20 nt, Artificial Sequence
  targeting sequence with ATCN PAM
cuccauucuccuggcccugg

SEQ ID NO: 4211 - RNA, 20 nt, Artificial Sequence
  targeting sequence with ATCN PAM
gcccaccccagcugccuggg

SEQ ID NO: 4212 - RNA, 20 nt, Artificial Sequence
  targeting sequence with ATCN PAM
cagagugcguguguuuuggg

SEQ ID NO: 4213 - RNA, 20 nt, Artificial Sequence
  targeting sequence with ATCN PAM
aaguccagaaggcagcaaag

SEQ ID NO: 4214 - RNA, 20 nt, Artificial Sequence
  targeting sequence with ATCN PAM
guguuuuuaaugcccagccu

SEQ ID NO: 4215 - RNA, 20 nt, Artificial Sequence
  targeting sequence with ATCN PAM
agccugucuggccucagcau

SEQ ID NO: 4216 - RNA, 20 nt, Artificial Sequence
  targeting sequence with ATCN PAM
accucugcuagugcccaacu

SEQ ID NO: 4217 - RNA, 20 nt, Artificial Sequence
  targeting sequence with ATCN PAM
cacaguugggcacuagcaga

SEQ ID NO: 4218 - RNA, 20 nt, Artificial Sequence
  targeting sequence with ATCN PAM
ucagcaaguugcuuaaccuc

SEQ ID NO: 4219 - RNA, 20 nt, Artificial Sequence
  targeting sequence with ATCN PAM
guaaaaugugaugagaauag

SEQ ID NO: 4220 - RNA, 20 nt, Artificial Sequence
  targeting sequence with ATCN PAM
cauuuuacagaugaagaaac

SEQ ID NO: 4221 - RNA, 20 nt, Artificial Sequence
  targeting sequence with ATCN PAM
caugucacaauucccaguuc

SEQ ID NO: 4222 - RNA, 20 nt, Artificial Sequence
  targeting sequence with ATCN PAM
cacugcacaccuagcccugu

SEQ ID NO: 4223 - RNA, 20 nt, Artificial Sequence
  targeting sequence with ATCN PAM
gcagggcccuggugcacacc

SEQ ID NO: 4224 - RNA, 20 nt, Artificial Sequence
  targeting sequence with ATCN PAM
ccaacgugcaaugguaacuc

SEQ ID NO: 4225 - RNA, 20 nt, Artificial Sequence
  targeting sequence with ATCN PAM
ggaucucugcgcgcucccac

SEQ ID NO: 4226 - RNA, 20 nt, Artificial Sequence
  targeting sequence with ATCN PAM
agauguacguggaacccagg

SEQ ID NO: 4227 - RNA, 20 nt, Artificial Sequence
  targeting sequence with ATCN PAM
cugcgcgcucccaccuguga

SEQ ID NO: 4228 - RNA, 20 nt, Artificial Sequence
  targeting sequence with ATCN PAM
agguacacccgggcgguggc

SEQ ID NO: 4229 - RNA, 20 nt, Artificial Sequence
  targeting sequence with ATCN PAM
gagcugcgcgcaccgccugc

SEQ ID NO: 4230 - RNA, 20 nt, Artificial Sequence
  targeting sequence with ATCN PAM
aguugggcuugcagugcgcg

SEQ ID NO: 4231 - RNA, 20 nt, Artificial Sequence
  targeting sequence with ATCN PAM
gccugccccacggcgccggc

SEQ ID NO: 4232 - RNA, 20 nt, Artificial Sequence
  targeting sequence with ATCN PAM
agcagggcgccaaggagcag

SEQ ID NO: 4233 - RNA, 20 nt, Artificial Sequence
  targeting sequence with ATCN PAM
ugaggauguugucgucggag

SEQ ID NO: 4234 - RNA, 20 nt, Artificial Sequence
  targeting sequence with ATCN PAM
ucaagaucaagcagggcgcc

SEQ ID NO: 4235 - RNA, 20 nt, Artificial Sequence
  targeting sequence with ATCN PAM
gcucccuggacacgcgcggc

SEQ ID NO: 4236 - RNA, 20 nt, Artificial Sequence
  targeting sequence with ATCN PAM
ccauccgcucccuggacacg

SEQ ID NO: 4237 - RNA, 20 nt, Artificial Sequence
  targeting sequence with ATCN PAM
cgggcguguucucgaagcgg

SEQ ID NO: 4238 - RNA, 20 nt, Artificial Sequence
  targeting sequence with ATCN PAM
cggccguggccgugcgcuuc

SEQ ID NO: 4239 - RNA, 20 nt, Artificial Sequence
  targeting sequence with ATCN PAM
accagggcuucugccagcug

SEQ ID NO: 4240 - RNA, 20 nt, Artificial Sequence
  targeting sequence with ATCN PAM
ugcagcuggaccccggccag

SEQ ID NO: 4241 - RNA, 20 nt, Artificial Sequence
  targeting sequence with ATCN PAM
uguuguaguuguccgugagg

SEQ ID NO: 4242 - RNA, 20 nt, Artificial Sequence
  targeting sequence with ATCN PAM
gcugucgggcgccaaccuga

SEQ ID NO: 4243 - RNA, 20 nt, Artificial Sequence
  targeting sequence with ATCN PAM
agcgucgguuccccucgccc

SEQ ID NO: 4244 - RNA, 20 nt, Artificial Sequence
  targeting sequence with ATCN PAM
ccagggcgccggcccgcgcc

SEQ ID NO: 4245 - RNA, 20 nt, Artificial Sequence
  targeting sequence with ATCN PAM
gggcgugcgcgggcugcgcg

SEQ ID NO: 4246 - RNA, 20 nt, Artificial Sequence
  targeting sequence with ATCN PAM
cggcccgggcccgccccccg

SEQ ID NO: 4247 - RNA, 20 nt, Artificial Sequence
  targeting sequence with ATCN PAM
gucccccaaaccccagaccc

SEQ ID NO: 4248 - RNA, 20 nt, Artificial Sequence
  targeting sequence with ATCN PAM
cuuuuaugggucugggguuu

SEQ ID NO: 4249 - RNA, 20 nt, Artificial Sequence
  targeting sequence with ATCN PAM
gacccugagcacuggucccu

SEQ ID NO: 4250 - RNA, 20 nt, Artificial Sequence
  targeting sequence with ATCN PAM
guugugggccacuggcugga

SEQ ID NO: 4251 - RNA, 20 nt, Artificial Sequence
  targeting sequence with ATCN PAM
ucccaggcuuaguggaagau

SEQ ID NO: 4252 - RNA, 20 nt, Artificial Sequence
  targeting sequence with ATCN PAM
uccacuaagccugggaggau

SEQ ID NO: 4253 - RNA, 20 nt, Artificial Sequence
  targeting sequence with ATCN PAM
agaacccugcccagugccgg

SEQ ID NO: 4254 - RNA, 20 nt, Artificial Sequence
  targeting sequence with ATCN PAM
caaaagcagcguuaggggca

SEQ ID NO: 4255 - RNA, 20 nt, Artificial Sequence
  targeting sequence with ATCN PAM
gugaggaaaaagagagcccg

SEQ ID NO: 4256 - RNA, 20 nt, Artificial Sequence
  targeting sequence with ATCN PAM
uccagauauggaaaccaagg

SEQ ID NO: 4257 - RNA, 20 nt, Artificial Sequence
  targeting sequence with ATCN PAM
ggaagauggguuaccaauag

SEQ ID NO: 4258 - RNA, 20 nt, Artificial Sequence
  targeting sequence with ATCN PAM
ugggccagucccuuccccuc

SEQ ID NO: 4259 - RNA, 20 nt, Artificial Sequence
  targeting sequence with ATCN PAM
gacccccagcuuccacaggg

SEQ ID NO: 4260 - RNA, 20 nt, Artificial Sequence
  targeting sequence with ATCN PAM
ugcccgccuuguuccagacc

SEQ ID NO: 4261 - RNA, 20 nt, Artificial Sequence
  targeting sequence with ATCN PAM
aagcaguggccagaccaggg

SEQ ID NO: 4262 - RNA, 20 nt, Artificial Sequence
  targeting sequence with ATCN PAM
acccaccaagagccacucag

SEQ ID NO: 4263 - RNA, 20 nt, Artificial Sequence
  targeting sequence with ATCN PAM
agagaggaagacagggacac

SEQ ID NO: 4264 - RNA, 20 nt, Artificial Sequence
  targeting sequence with ATCN PAM
ugccacccgugggggccaac

SEQ ID NO: 4265 - RNA, 20 nt, Artificial Sequence
  targeting sequence with ATCN PAM
ucagugcccccaccccaguc

SEQ ID NO: 4266 - RNA, 20 nt, Artificial Sequence
  targeting sequence with ATCN PAM
gcuggucucucugucuuauc

SEQ ID NO: 4267 - RNA, 20 nt, Artificial Sequence
  targeting sequence with ATCN PAM
cucucucuccugcccccacc

SEQ ID NO: 4268 - RNA, 20 nt, Artificial Sequence
  targeting sequence with ATCN PAM
cuguuccuaucugucuugcu

SEQ ID NO: 4269 - RNA, 20 nt, Artificial Sequence
  targeting sequence with ATCN PAM
gucuugcuccucccguucac

SEQ ID NO: 4270 - RNA, 20 nt, Artificial Sequence
  targeting sequence with ATCN PAM
gucucucugugucucuaucu

SEQ ID NO: 4271 - RNA, 20 nt, Artificial Sequence
  targeting sequence with ATCN PAM
cugucucucucucugucucc

SEQ ID NO: 4272 - RNA, 20 nt, Artificial Sequence
  targeting sequence with ATCN PAM
cucacccccacucccucucc

SEQ ID NO: 4273 - RNA, 20 nt, Artificial Sequence
  targeting sequence with ATCN PAM
gguucaucuugcugcauccu

SEQ ID NO: 4274 - RNA, 20 nt, Artificial Sequence
  targeting sequence with ATCN PAM
ugcugcauccugcagcuccc

SEQ ID NO: 4275 - RNA, 20 nt, Artificial Sequence
  targeting sequence with ATCN PAM
ugcagcuccccccacugagc

SEQ ID NO: 4276 - RNA, 20 nt, Artificial Sequence
  targeting sequence with ATCN PAM
ucacggcucaguggggggag

SEQ ID NO: 4277 - RNA, 20 nt, Artificial Sequence
  targeting sequence with ATCN PAM
ccacaggcuggucuaagaca

SEQ ID NO: 4278 - RNA, 20 nt, Artificial Sequence
  targeting sequence with ATCN PAM
ucaccacaggcuggucuaag

SEQ ID NO: 4279 - RNA, 20 nt, Artificial Sequence
  targeting sequence with ATCN PAM
ugggcacuugggacacaagc

SEQ ID NO: 4280 - RNA, 20 nt, Artificial Sequence
  targeting sequence with ATCN PAM
ucacaucaacuggaggugag

SEQ ID NO: 4281 - RNA, 20 nt, Artificial Sequence
  targeting sequence with ATCN PAM
acuggaggugagaagugcug

SEQ ID NO: 4282 - RNA, 20 nt, Artificial Sequence
  targeting sequence with ATCN PAM
uagcagaacaccugccccug

SEQ ID NO: 4283 - RNA, 20 nt, Artificial Sequence
  targeting sequence with ATCN PAM
cacacccucccaggggcagg

SEQ ID NO: 4284 - RNA, 20 nt, Artificial Sequence
  targeting sequence with ATCN PAM
ugugcccagcacugcccuac

SEQ ID NO: 4285 - RNA, 20 nt, Artificial Sequence
  targeting sequence with ATCN PAM
gguagggcagugcugggcac

SEQ ID NO: 4286 - RNA, 20 nt, Artificial Sequence
  targeting sequence with ATCN PAM
uacaccauccuugcagccag

SEQ ID NO: 4287 - RNA, 20 nt, Artificial Sequence
  targeting sequence with ATCN PAM
uugcagccagcugacuaggc

SEQ ID NO: 4288 - RNA, 20 nt, Artificial Sequence
  targeting sequence with ATCN PAM
gugaaauggguuugcugacc

SEQ ID NO: 4289 - RNA, 20 nt, Artificial Sequence
  targeting sequence with ATCN PAM
uuaccuugcuaaugccccuc

SEQ ID NO: 4290 - RNA, 20 nt, Artificial Sequence
  targeting sequence with ATCN PAM
ggguuucaauccuuaccuug

SEQ ID NO: 4291 - RNA, 20 nt, Artificial Sequence
  targeting sequence with ATCN PAM
ggcuccacaucuuaugauuu

SEQ ID NO: 4292 - RNA, 20 nt, Artificial Sequence
  targeting sequence with ATCN PAM
uaugauuucucccuucuacc

SEQ ID NO: 4293 - RNA, 20 nt, Artificial Sequence
  targeting sequence with ATCN PAM
uaagauguggagccagaucu

SEQ ID NO: 4294 - RNA, 20 nt, Artificial Sequence
  targeting sequence with ATCN PAM
ggccaggauggcucauggug

SEQ ID NO: 4295 - RNA, 20 nt, Artificial Sequence
  targeting sequence with ATCN PAM
uggccugauggugcucccag

SEQ ID NO: 4296 - RNA, 20 nt, Artificial Sequence
  targeting sequence with ATCN PAM
uaguaaggccagggaaggug

SEQ ID NO: 4297 - RNA, 20 nt, Artificial Sequence
  targeting sequence with ATCN PAM
ccccuugguucccuccaaaa

SEQ ID NO: 4298 - RNA, 20 nt, Artificial Sequence
  targeting sequence with ATCN PAM
ccacuccugaguaccuuuca

SEQ ID NO: 4299 - RNA, 20 nt, Artificial Sequence
  targeting sequence with ATCN PAM
gacuugaacaaaaacugaaa

SEQ ID NO: 4300 - RNA, 20 nt, Artificial Sequence
  targeting sequence with ATCN PAM
aggaaaaggucuugguuuga

SEQ ID NO: 4301 - RNA, 20 nt, Artificial Sequence
  targeting sequence with ATCN PAM
gcgugcuagaauguacugau

SEQ ID NO: 4302 - RNA, 20 nt, Artificial Sequence
  targeting sequence with ATCN PAM
guacauucuagcacgcugau

SEQ ID NO: 4303 - RNA, 20 nt, Artificial Sequence
  targeting sequence with ATCN PAM
uuacuguacauggaaaacca

SEQ ID NO: 4304 - RNA, 20 nt, Artificial Sequence
  targeting sequence with ATCN PAM
aggaagcuuuacaucauuac

SEQ ID NO: 4305 - RNA, 20 nt, Artificial Sequence
  targeting sequence with ATCN PAM
augcauuuaucaaggaagcu

SEQ ID NO: 4306 - RNA, 20 nt, Artificial Sequence
  targeting sequence with ATCN PAM
ccuauuucacauuugucuuu

SEQ ID NO: 4307 - RNA, 20 nt, Artificial Sequence
  targeting sequence with ATCN PAM
agaugccaccaaaaugccug

SEQ ID NO: 4308 - RNA, 20 nt, Artificial Sequence
  targeting sequence with ATCN PAM
ggauuaucaccuauuucaca

SEQ ID NO: 4309 - RNA, 20 nt, Artificial Sequence
  targeting sequence with ATCN PAM
agccaugggccuagguggug

SEQ ID NO: 4310 - RNA, 20 nt, Artificial Sequence
  targeting sequence with ATCN PAM
cugcugcuucucgggggcug

SEQ ID NO: 4311 - RNA, 20 nt, Artificial Sequence
  targeting sequence with ATCN PAM
caaggacagaaaaccaacac

SEQ ID NO: 4312 - RNA, 20 nt, Artificial Sequence
  targeting sequence with ATCN PAM
uucugagcaaacuaucgcaa

SEQ ID NO: 4313 - RNA, 20 nt, Artificial Sequence
  targeting sequence with ATCN PAM
augucccuacaaaggacaug

SEQ ID NO: 4314 - RNA, 20 nt, Artificial Sequence
  targeting sequence with ATCN PAM
uuuuuuauggcugcauagua

SEQ ID NO: 4315 - RNA, 20 nt, Artificial Sequence
  targeting sequence with ATCN PAM
agucuaucauugauggaccu

SEQ ID NO: 4316 - RNA, 20 nt, Artificial Sequence
  targeting sequence with ATCN PAM
uugauggaccuuugaucaac

SEQ ID NO: 4317 - RNA, 20 nt, Artificial Sequence
  targeting sequence with ATCN PAM
augauagacuggauuaagaa

SEQ ID NO: 4318 - RNA, 20 nt, Artificial Sequence
  targeting sequence with ATCN PAM
cuguguccccguggggcugg

SEQ ID NO: 4319 - RNA, 20 nt, Artificial Sequence
  targeting sequence with ATCN PAM
aacucacagagcacaaaggg

SEQ ID NO: 4320 - RNA, 20 nt, Artificial Sequence
  targeting sequence with ATCN PAM
ccaggcgacaaccgccugag

SEQ ID NO: 4321 - RNA, 20 nt, Artificial Sequence
  targeting sequence with ATCN PAM
aauggggucagcagcacagc

SEQ ID NO: 4322 - RNA, 20 nt, Artificial Sequence
  targeting sequence with ATCN PAM
ccugagccucaauuuaugca

SEQ ID NO: 4323 - RNA, 20 nt, Artificial Sequence
  targeting sequence with ATCN PAM
aggaccagggccucaucucc

SEQ ID NO: 4324 - RNA, 20 nt, Artificial Sequence
  targeting sequence with ATCN PAM
cagcucugcaaccucugccu

SEQ ID NO: 4325 - RNA, 20 nt, Artificial Sequence
  targeting sequence with ATCN PAM
cuugcacccaggaggcagag

SEQ ID NO: 4326 - RNA, 20 nt, Artificial Sequence
  targeting sequence with ATCN PAM
cagcuacucgggaggcugag

SEQ ID NO: 4327 - RNA, 20 nt, Artificial Sequence
  targeting sequence with ATCN PAM
agagugaguguuacucacag

SEQ ID NO: 4328 - RNA, 20 nt, Artificial Sequence
  targeting sequence with ATCN PAM
ucccuccuuacucaagagca

SEQ ID NO: 4329 - RNA, 20 nt, Artificial Sequence
  targeting sequence with ATCN PAM
cuccuuacucaagagcagcc

SEQ ID NO: 4330 - RNA, 20 nt, Artificial Sequence
  targeting sequence with ATCN PAM
cgggaugagccacccucuuu

SEQ ID NO: 4331 - RNA, 20 nt, Artificial Sequence
  targeting sequence with ATCN PAM
cgagauacccagcugucguu

SEQ ID NO: 4332 - RNA, 20 nt, Artificial Sequence
  targeting sequence with ATCN PAM
uggagacaccaggagacuua

SEQ ID NO: 4333 - RNA, 20 nt, Artificial Sequence
  targeting sequence with ATCN PAM
aaaucuuggagacaccagga

SEQ ID NO: 4334 - RNA, 20 nt, Artificial Sequence
  targeting sequence with ATCN PAM
ggcugcuccucuuccaggca

SEQ ID NO: 4335 - RNA, 20 nt, Artificial Sequence
  targeting sequence with ATCN PAM
aggugccucccggguucugc

SEQ ID NO: 4336 - RNA, 20 nt, Artificial Sequence
  targeting sequence with ATCN PAM
aggggaggcuauuuccagcu

SEQ ID NO: 4337 - RNA, 20 nt, Artificial Sequence
  targeting sequence with ATCN PAM
ucuuccucuaggccuccuuc

SEQ ID NO: 4338 - RNA, 20 nt, Artificial Sequence
  targeting sequence with ATCN PAM
gugcugacgaaaccggcuuc

SEQ ID NO: 4339 - RNA, 20 nt, Artificial Sequence
  targeting sequence with ATCN PAM
ucacucgagaggcuuggcug

SEQ ID NO: 4340 - RNA, 20 nt, Artificial Sequence
  targeting sequence with ATCN PAM
uuuugaggcagagguuuccc

SEQ ID NO: 4341 - RNA, 20 nt, Artificial Sequence
  targeting sequence with ATCN PAM
gggcuuggaugggcugugca

SEQ ID NO: 4342 - RNA, 20 nt, Artificial Sequence
  targeting sequence with ATCN PAM
aagcccagauccuuuugagg

SEQ ID NO: 4343 - RNA, 20 nt, Artificial Sequence
  targeting sequence with ATCN PAM
aguugcacagcccauccaag

SEQ ID NO: 4344 - RNA, 20 nt, Artificial Sequence
  targeting sequence with ATCN PAM
ccacugcccauaauucacuu

SEQ ID NO: 4345 - RNA, 20 nt, Artificial Sequence
  targeting sequence with ATCN PAM
uccccaaggggccugggguc

SEQ ID NO: 4346 - RNA, 20 nt, Artificial Sequence
  targeting sequence with ATCN PAM
ccauguaucagagaaggaaa

SEQ ID NO: 4347 - RNA, 20 nt, Artificial Sequence
  targeting sequence with ATCN PAM
gagaaggaaauugaggcuga

SEQ ID NO: 4348 - RNA, 20 nt, Artificial Sequence
  targeting sequence with ATCN PAM
uccgaguccagcccuguggg

SEQ ID NO: 4349 - RNA, 20 nt, Artificial Sequence
  targeting sequence with ATCN PAM
gaguccagcccugugggcug

SEQ ID NO: 4350 - RNA, 20 nt, Artificial Sequence
  targeting sequence with ATCN PAM
gcaccucccacccccagaug

SEQ ID NO: 4351 - RNA, 20 nt, Artificial Sequence
  targeting sequence with ATCN PAM
gggggugggaggugcagaug

SEQ ID NO: 4352 - RNA, 20 nt, Artificial Sequence
  targeting sequence with ATCN PAM
cacuagcgucccuuuccaug

SEQ ID NO: 4353 - RNA, 20 nt, Artificial Sequence
  targeting sequence with ATCN PAM
uccccugugcacugggcaua

SEQ ID NO: 4354 - RNA, 20 nt, Artificial Sequence
  targeting sequence with ATCN PAM
ccuccuccaggaagcccucu

SEQ ID NO: 4355 - RNA, 20 nt, Artificial Sequence
  targeting sequence with ATCN PAM
auuggcagcuccggugccuc

SEQ ID NO: 4356 - RNA, 20 nt, Artificial Sequence
  targeting sequence with ATCN PAM
gucuuucgcuacugcuggcc

SEQ ID NO: 4357 - RNA, 20 nt, Artificial Sequence
  targeting sequence with ATCN PAM
gugcccucccugaccucccc

SEQ ID NO: 4358 - RNA, 20 nt, Artificial Sequence
  targeting sequence with ATCN PAM
ucuccugccggcuccucugc

SEQ ID NO: 4359 - RNA, 20 nt, Artificial Sequence
  targeting sequence with ATCN PAM
agucccacagcucucaauga

SEQ ID NO: 4360 - RNA, 20 nt, Artificial Sequence
  targeting sequence with ATCN PAM
gggaguggagacaaugaaau

SEQ ID NO: 4361 - RNA, 20 nt, Artificial Sequence
  targeting sequence with ATCN PAM
ugccugaaaaacaaaaacaa

SEQ ID NO: 4362 - RNA, 20 nt, Artificial Sequence
  targeting sequence with ATCN PAM
aaccccagcuggggagguuu

SEQ ID NO: 4363 - RNA, 20 nt, Artificial Sequence
  targeting sequence with ATCN PAM
ggcuaucuggcgaggcuuuc

SEQ ID NO: 4364 - RNA, 20 nt, Artificial Sequence
  targeting sequence with ATCN PAM
ggcgaggcuuucaaggaggg

SEQ ID NO: 4365 - RNA, 20 nt, Artificial Sequence
  targeting sequence with ATCN PAM
cccuccuugaaagccucgcc

SEQ ID NO: 4366 - RNA, 20 nt, Artificial Sequence
  targeting sequence with ATCN PAM
cuccaugcuccugccaaauc

SEQ ID NO: 4367 - RNA, 20 nt, Artificial Sequence
  targeting sequence with ATCN PAM
cugcaugcucccaccuccua

SEQ ID NO: 4368 - RNA, 20 nt, Artificial Sequence
  targeting sequence with ATCN PAM
aagggugugccuggucagga

SEQ ID NO: 4369 - RNA, 20 nt, Artificial Sequence
  targeting sequence with ATCN PAM
cagcucugcugugugacuga

SEQ ID NO: 4370 - RNA, 20 nt, Artificial Sequence
  targeting sequence with ATCN PAM
cugaccgggagaccaggagg

SEQ ID NO: 4371 - RNA, 20 nt, Artificial Sequence
  targeting sequence with ATCN PAM
ccacccaggcugagcaggag

SEQ ID NO: 4372 - RNA, 20 nt, Artificial Sequence
  targeting sequence with ATCN PAM
gugugcuaaccacaugcccc

SEQ ID NO: 4373 - RNA, 20 nt, Artificial Sequence
  targeting sequence with ATCN PAM
augccccacccuccuccugu

SEQ ID NO: 4374 - RNA, 20 nt, Artificial Sequence
  targeting sequence with ATCN PAM
ccaucugagaucaguaucca

SEQ ID NO: 4375 - RNA, 20 nt, Artificial Sequence
  targeting sequence with ATCN PAM
gagaucaguauccacgaagg

SEQ ID NO: 4376 - RNA, 20 nt, Artificial Sequence
  targeting sequence with ATCN PAM
cagauggggaugugucgggu

SEQ ID NO: 4377 - RNA, 20 nt, Artificial Sequence
  targeting sequence with ATCN PAM
guauccacgaaggagacucg

SEQ ID NO: 4378 - RNA, 20 nt, Artificial Sequence
  targeting sequence with ATCN PAM
acgaaggagacucgguguga

SEQ ID NO: 4379 - RNA, 20 nt, Artificial Sequence
  targeting sequence with ATCN PAM
caccgagucuccuucgugga

SEQ ID NO: 4380 - RNA, 20 nt, Artificial Sequence
  targeting sequence with ATCN PAM
gcuggcucugccgacagcac

SEQ ID NO: 4381 - RNA, 20 nt, Artificial Sequence
  targeting sequence with ATCN PAM
gagguccaguaggcacccca

SEQ ID NO: 4382 - RNA, 20 nt, Artificial Sequence
  targeting sequence with ATCN PAM
cccguccuuggugccaggcc

SEQ ID NO: 4383 - RNA, 20 nt, Artificial Sequence
  targeting sequence with ATCN PAM
guaaaaugggccuaauuaca

SEQ ID NO: 4384 - RNA, 20 nt, Artificial Sequence
  targeting sequence with ATCN PAM
ugcggcuguuuccgccucgc

SEQ ID NO: 4385 - RNA, 20 nt, Artificial Sequence
  targeting sequence with ATCN PAM
ccuuccucagccacugagcg

SEQ ID NO: 4386 - RNA, 20 nt, Artificial Sequence
  targeting sequence with ATCN PAM
caaucgcccuggccuccucu

SEQ ID NO: 4387 - RNA, 20 nt, Artificial Sequence
  targeting sequence with ATCN PAM
cccuggccuccucuuccuuc

SEQ ID NO: 4388 - RNA, 20 nt, Artificial Sequence
  targeting sequence with ATCN PAM
ugagguauuggggguuucaa

SEQ ID NO: 4389 - RNA, 20 nt, Artificial Sequence
  targeting sequence with ATCN PAM
ggagacagccuuuaaagagu

SEQ ID NO: 4390 - RNA, 20 nt, Artificial Sequence
  targeting sequence with ATCN PAM
cauuuuaacuuaaugaacuc

SEQ ID NO: 4391 - RNA, 20 nt, Artificial Sequence
  targeting sequence with ATCN PAM
ccucauaccaucucauuuua

SEQ ID NO: 4392 - RNA, 20 nt, Artificial Sequence
  targeting sequence with ATCN PAM
caggcgugagccaccgcacc

SEQ ID NO: 4393 - RNA, 20 nt, Artificial Sequence
  targeting sequence with ATCN PAM
uagcacuuugggaggcugau

SEQ ID NO: 4394 - RNA, 20 nt, Artificial Sequence
  targeting sequence with ATCN PAM
gccucccaaagugcuaggau

SEQ ID NO: 4395 - RNA, 20 nt, Artificial Sequence
  targeting sequence with ATCN PAM
uccugcaucagccucccaaa

SEQ ID NO: 4396 - RNA, 20 nt, Artificial Sequence
  targeting sequence with ATCN PAM
cuugagcccaggaguucgag

SEQ ID NO: 4397 - RNA, 20 nt, Artificial Sequence
  targeting sequence with ATCN PAM
cuacaaaaaguuagcugggc

SEQ ID NO: 4398 - RNA, 20 nt, Artificial Sequence
  targeting sequence with ATCN PAM
ucccaccucgguccucuaag

SEQ ID NO: 4399 - RNA, 20 nt, Artificial Sequence
  targeting sequence with ATCN PAM
cucaacaacagaaaccuauu

SEQ ID NO: 4400 - RNA, 20 nt, Artificial Sequence
  targeting sequence with ATCN PAM
agucuguggccucuuguuac

SEQ ID NO: 4401 - RNA, 20 nt, Artificial Sequence
  targeting sequence with ATCN PAM
gcaagccaaggagagaggcu

SEQ ID NO: 4402 - RNA, 20 nt, Artificial Sequence
  targeting sequence with ATCN PAM
ugugaggacacagccagaag

SEQ ID NO: 4403 - RNA, 20 nt, Artificial Sequence
  targeting sequence with ATCN PAM
ucccucacuuccugcauauc

SEQ ID NO: 4404 - RNA, 20 nt, Artificial Sequence
  targeting sequence with ATCN PAM
gaauccucagcuccacuucu

SEQ ID NO: 4405 - RNA, 20 nt, Artificial Sequence
  targeting sequence with ATCN PAM
ucagcuccacuucuuuauuu

SEQ ID NO: 4406 - RNA, 20 nt, Artificial Sequence
  targeting sequence with ATCN PAM
caacacugcacuccagccug

SEQ ID NO: 4407 - RNA, 20 nt, Artificial Sequence
  targeting sequence with ATCN PAM
cagcucacugcagccucgac

SEQ ID NO: 4408 - RNA, 20 nt, Artificial Sequence
  targeting sequence with ATCN PAM
uccaaccucagccuccugag

SEQ ID NO: 4409 - RNA, 20 nt, Artificial Sequence
  targeting sequence with ATCN PAM
aggcuucccuuuggcucucc

SEQ ID NO: 4410 - RNA, 20 nt, Artificial Sequence
  targeting sequence with ATCN PAM
ggaaagggcaugacaggcag

SEQ ID NO: 4411 - RNA, 20 nt, Artificial Sequence
  targeting sequence with ATCN PAM
ccccagggcugccgccuucu

SEQ ID NO: 4412 - RNA, 20 nt, Artificial Sequence
  targeting sequence with ATCN PAM
cucagguuucugcucaaaua

SEQ ID NO: 4413 - RNA, 20 nt, Artificial Sequence
  targeting sequence with ATCN PAM
cccuccaaagaggcccuccc

SEQ ID NO: 4414 - RNA, 20 nt, Artificial Sequence
  targeting sequence with ATCN PAM
gggcuaguauccaucucucu

SEQ ID NO: 4415 - RNA, 20 nt, Artificial Sequence
  targeting sequence with ATCN PAM
aucucucucacuggauggac

SEQ ID NO: 4416 - RNA, 20 nt, Artificial Sequence
  targeting sequence with ATCN PAM
cucucacuggauggaccuuc

SEQ ID NO: 4417 - RNA, 20 nt, Artificial Sequence
  targeting sequence with ATCN PAM
agugagagagauggauacua

SEQ ID NO: 4418 - RNA, 20 nt, Artificial Sequence
  targeting sequence with ATCN PAM
ccugcccuggugaaggucca

SEQ ID NO: 4419 - RNA, 20 nt, Artificial Sequence
  targeting sequence with ATCN PAM
cccaaaacacagggucacag

SEQ ID NO: 4420 - RNA, 20 nt, Artificial Sequence
  targeting sequence with ATCN PAM
acgggccccccuggaggccc

SEQ ID NO: 4421 - RNA, 20 nt, Artificial Sequence
  targeting sequence with ATCN PAM
ccucggcuucccacgcagca

SEQ ID NO: 4422 - RNA, 20 nt, Artificial Sequence
  targeting sequence with ATCN PAM
gucuuccagugauuccucca

SEQ ID NO: 4423 - RNA, 20 nt, Artificial Sequence
  targeting sequence with ATCN PAM
cuggaagacagauggggaag

SEQ ID NO: 4424 - RNA, 20 nt, Artificial Sequence
  targeting sequence with ATCN PAM
agccuucuucccaaacaagc

SEQ ID NO: 4425 - RNA, 20 nt, Artificial Sequence
  targeting sequence with ATCN PAM
cuuuggacuuggggacucug

SEQ ID NO: 4426 - RNA, 20 nt, Artificial Sequence
  targeting sequence with ATCN PAM
gggagcaggaugagggaagg

SEQ ID NO: 4427 - RNA, 20 nt, Artificial Sequence
  targeting sequence with ATCN PAM
ugcucccagauggaggugca

SEQ ID NO: 4428 - RNA, 20 nt, Artificial Sequence
  targeting sequence with ATCN PAM
ucacccacacuugguggugu

SEQ ID NO: 4429 - RNA, 20 nt, Artificial Sequence
  targeting sequence with ATCN PAM
cagcacuuugggaggccgag

SEQ ID NO: 4430 - RNA, 20 nt, Artificial Sequence
  targeting sequence with ATCN PAM
gcccgccucggccucccaaa

SEQ ID NO: 4431 - RNA, 20 nt, Artificial Sequence
  targeting sequence with ATCN PAM
cgaggucaggagauagagac

SEQ ID NO: 4432 - RNA, 20 nt, Artificial Sequence
  targeting sequence with ATCN PAM
ccugaccucgugauccgccc

SEQ ID NO: 4433 - RNA, 20 nt, Artificial Sequence
  targeting sequence with ATCN PAM
cagcuacucaggaggcugag

SEQ ID NO: 4434 - RNA, 20 nt, Artificial Sequence
  targeting sequence with ATCN PAM
cggcucacugcaagcuccgc

SEQ ID NO: 4435 - RNA, 20 nt, Artificial Sequence
  targeting sequence with ATCN PAM
uggcaaucccacgucuagau

SEQ ID NO: 4436 - RNA, 20 nt, Artificial Sequence
  targeting sequence with ATCN PAM
cacgucuagauauuggaaua

SEQ ID NO: 4437 - RNA, 20 nt, Artificial Sequence
  targeting sequence with ATCN PAM
agacgugggauugccaggau

SEQ ID NO: 4438 - RNA, 20 nt, Artificial Sequence
  targeting sequence with ATCN PAM
guacagguuuuuauggaccu

SEQ ID NO: 4439 - RNA, 20 nt, Artificial Sequence
  targeting sequence with ATCN PAM
auggagcugugacaagcauc

SEQ ID NO: 4440 - RNA, 20 nt, Artificial Sequence
  targeting sequence with ATCN PAM
ggaaacaagccaaguguccc

SEQ ID NO: 4441 - RNA, 20 nt, Artificial Sequence
  targeting sequence with ATCN PAM
agaggcuguuccuuuucguu

SEQ ID NO: 4442 - RNA, 20 nt, Artificial Sequence
  targeting sequence with ATCN PAM
uugugucggaguaucaagag

SEQ ID NO: 4443 - RNA, 20 nt, Artificial Sequence
  targeting sequence with ATCN PAM
ccaagccaggcuggaaaggc

SEQ ID NO: 4444 - RNA, 20 nt, Artificial Sequence
  targeting sequence with ATCN PAM
ugcagcguggagccuuucca

SEQ ID NO: 4445 - RNA, 20 nt, Artificial Sequence
  targeting sequence with ATCN PAM
cauguacaugcuguuuggaa

SEQ ID NO: 4446 - RNA, 20 nt, Artificial Sequence
  targeting sequence with ATCN PAM
gugucccguccuguggccug

SEQ ID NO: 4447 - RNA, 20 nt, Artificial Sequence
  targeting sequence with ATCN PAM
caaaugugaagucugguaaa

SEQ ID NO: 4448 - RNA, 20 nt, Artificial Sequence
  targeting sequence with ATCN PAM
gaggccacuucuccugaugu

SEQ ID NO: 4449 - RNA, 20 nt, Artificial Sequence
  targeting sequence with ATCN PAM
ggagaaguggccucagaucu

SEQ ID NO: 4450 - RNA, 20 nt, Artificial Sequence
  targeting sequence with ATCN PAM
cuugcgcagcaugcugcccc

SEQ ID NO: 4451 - RNA, 20 nt, Artificial Sequence
  targeting sequence with ATCN PAM
gcggcuucuaagacgcucaa

SEQ ID NO: 4452 - RNA, 20 nt, Artificial Sequence
  targeting sequence with ATCN PAM
gcgaggcagcguccccuccu

SEQ ID NO: 4453 - RNA, 20 nt, Artificial Sequence
  targeting sequence with ATCN PAM
cugucccugguuccuuuagu

SEQ ID NO: 4454 - RNA, 20 nt, Artificial Sequence
  targeting sequence with ATCN PAM
ggcuucgcgguguguccuca

SEQ ID NO: 4455 - RNA, 20 nt, Artificial Sequence
  targeting sequence with ATCN PAM
gugcaauugaacauucauuc

SEQ ID NO: 4456 - RNA, 20 nt, Artificial Sequence
  targeting sequence with ATCN PAM
acgcggcccucgccgacucc

SEQ ID NO: 4457 - RNA, 20 nt, Artificial Sequence
  targeting sequence with ATCN PAM
aagaaggaaacgguggggcu

SEQ ID NO: 4458 - RNA, 20 nt, Artificial Sequence
  targeting sequence with ATCN PAM
aaagccuucccgacuuccau

SEQ ID NO: 4459 - RNA, 20 nt, Artificial Sequence
  targeting sequence with ATCN PAM
agucgcgcuuggucacuucc

SEQ ID NO: 4460 - RNA, 20 nt, Artificial Sequence
  targeting sequence with ATCN PAM
ggguuggaggcucugaaauu

SEQ ID NO: 4461 - RNA, 20 nt, Artificial Sequence
  targeting sequence with ATCN PAM
uggcuugagaggagccagaa

SEQ ID NO: 4462 - RNA, 20 nt, Artificial Sequence
  targeting sequence with ATCN PAM
aaccggcguaggcaggaacg

SEQ ID NO: 4463 - RNA, 20 nt, Artificial Sequence
  targeting sequence with ATCN PAM
gcauuaauaagggaggcagu

SEQ ID NO: 4464 - RNA, 20 nt, Artificial Sequence
  targeting sequence with ATCN PAM
gagaguaaguugcaggcgcg

SEQ ID NO: 4465 - RNA, 20 nt, Artificial Sequence
  targeting sequence with ATCN PAM
cgccugcaacuuacucuccg

SEQ ID NO: 4466 - RNA, 20 nt, Artificial Sequence
  targeting sequence with ATCN PAM
ugaaaaccacugggguugug

SEQ ID NO: 4467 - RNA, 20 nt, Artificial Sequence
  targeting sequence with ATCN PAM
agugauuuaaccauaauaca

SEQ ID NO: 4468 - RNA, 20 nt, Artificial Sequence
  targeting sequence with ATCN PAM
cucgaucuugaaaaccacug

SEQ ID NO: 4469 - RNA, 20 nt, Artificial Sequence
  targeting sequence with ATCN PAM
gcacaaccuuacucaaauau

SEQ ID NO: 4470 - RNA, 20 nt, Artificial Sequence
  targeting sequence with ATCN PAM
ccaaaugucgcaacgagguc

SEQ ID NO: 4471 - RNA, 20 nt, Artificial Sequence
  targeting sequence with ATCN PAM
ccuucccauccccauccagg

SEQ ID NO: 4472 - RNA, 20 nt, Artificial Sequence
  targeting sequence with ATCN PAM
ccauccaggagccacgccag

SEQ ID NO: 4473 - RNA, 20 nt, Artificial Sequence
  targeting sequence with ATCN PAM
aggagccacgccaggaucac

SEQ ID NO: 4474 - RNA, 20 nt, Artificial Sequence
  targeting sequence with ATCN PAM
uggcguggcuccuggauggg

SEQ ID NO: 4475 - RNA, 20 nt, Artificial Sequence
  targeting sequence with ATCN PAM
cauuuguaaauuuaauuauu

SEQ ID NO: 4476 - RNA, 20 nt, Artificial Sequence
  targeting sequence with ATCN PAM
cgccacugcacuccagccug

SEQ ID NO: 4477 - RNA, 20 nt, Artificial Sequence
  targeting sequence with ATCN PAM
cggcucacugcaagcuccgc

SEQ ID NO: 4478 - RNA, 20 nt, Artificial Sequence
  targeting sequence with ATCN PAM
agaccagacuggcuaacacg

SEQ ID NO: 4479 - RNA, 20 nt, Artificial Sequence
  targeting sequence with ATCN PAM
ccugaccucgugauccgccc

SEQ ID NO: 4480 - RNA, 20 nt, Artificial Sequence
  targeting sequence with ATCN PAM
cgaggucaggagaucgagac

SEQ ID NO: 4481 - RNA, 20 nt, Artificial Sequence
  targeting sequence with ATCN PAM
gcccgccucggccucccaaa

SEQ ID NO: 4482 - RNA, 20 nt, Artificial Sequence
  targeting sequence with ATCN PAM
cagcacuuugggaggccgag

SEQ ID NO: 4483 - RNA, 20 nt, Artificial Sequence
  targeting sequence with ATCN PAM
uggccggucgcaguggcuca

SEQ ID NO: 4484 - RNA, 20 nt, Artificial Sequence
  targeting sequence with ATCN PAM
cauuuaguuguucaccuuuu

SEQ ID NO: 4485 - RNA, 20 nt, Artificial Sequence
  targeting sequence with ATCN PAM
aggcuggagugcaguggcac

SEQ ID NO: 4486 - RNA, 20 nt, Artificial Sequence
  targeting sequence with ATCN PAM
cuugagcccaaaaauucaag

SEQ ID NO: 4487 - RNA, 20 nt, Artificial Sequence
  targeting sequence with ATCN PAM
ucuccccucagucugcagag

SEQ ID NO: 4488 - RNA, 20 nt, Artificial Sequence
  targeting sequence with ATCN PAM
ugagacagacaaaaggccag

SEQ ID NO: 4489 - RNA, 20 nt, Artificial Sequence
  targeting sequence with ATCN PAM
cccaauuuuauugcaaauau

SEQ ID NO: 4490 - RNA, 20 nt, Artificial Sequence
  targeting sequence with ATCN PAM
aaccaacuugucaacuaaua

SEQ ID NO: 4491 - RNA, 20 nt, Artificial Sequence
  targeting sequence with ATCN PAM
uuaagaauuauuuuuguuac

SEQ ID NO: 4492 - RNA, 20 nt, Artificial Sequence
  targeting sequence with ATCN PAM
aucauuaagaauuauuuuug

SEQ ID NO: 4493 - RNA, 20 nt, Artificial Sequence
  targeting sequence with ATCN PAM
auaguaauccaucauuaaga

SEQ ID NO: 4494 - RNA, 20 nt, Artificial Sequence
  targeting sequence with ATCN PAM
ucucuuccaauuucucauuu

SEQ ID NO: 4495 - RNA, 20 nt, Artificial Sequence
  targeting sequence with ATCN PAM
uccugccucagccucuccag

SEQ ID NO: 4496 - RNA, 20 nt, Artificial Sequence
  targeting sequence with ATCN PAM
cuugagacugggaggucaag

SEQ ID NO: 4497 - RNA, 20 nt, Artificial Sequence
  targeting sequence with ATCN PAM
uugaccucccagucucaagu

SEQ ID NO: 4498 - RNA, 20 nt, Artificial Sequence
  targeting sequence with ATCN PAM
cagcucacugcauccuugac

SEQ ID NO: 4499 - RNA, 20 nt, Artificial Sequence
  targeting sequence with ATCN PAM
cuuaaaaaaaauucugguaa

SEQ ID NO: 4500 - RNA, 20 nt, Artificial Sequence
  targeting sequence with ATCN PAM
uauuggucacaccauccuac

SEQ ID NO: 4501 - RNA, 20 nt, Artificial Sequence
  targeting sequence with ATCN PAM
uuguaggcucaaaguuugug

SEQ ID NO: 4502 - RNA, 20 nt, Artificial Sequence
  targeting sequence with ATCN PAM
guuuauuucucuuagaaacu

SEQ ID NO: 4503 - RNA, 20 nt, Artificial Sequence
  targeting sequence with ATCN PAM
cagcacuuugggaggcugag

SEQ ID NO: 4504 - RNA, 20 nt, Artificial Sequence
  targeting sequence with ATCN PAM
acccuccucagccucccaaa

SEQ ID NO: 4505 - RNA, 20 nt, Artificial Sequence
  targeting sequence with ATCN PAM
ccugaggucaggaguucgag

SEQ ID NO: 4506 - RNA, 20 nt, Artificial Sequence
  targeting sequence with ATCN PAM
cuacuaacaauacaaaaaau

SEQ ID NO: 4507 - RNA, 20 nt, Artificial Sequence
  targeting sequence with ATCN PAM
uccugccuuggcuuacuccu

SEQ ID NO: 4508 - RNA, 20 nt, Artificial Sequence
  targeting sequence with ATCN PAM
uuugaguuuaagaccagccu

SEQ ID NO: 4509 - RNA, 20 nt, Artificial Sequence
  targeting sequence with ATCN PAM
caucucuaccaacaaagaag

SEQ ID NO: 4510 - RNA, 20 nt, Artificial Sequence
  targeting sequence with ATCN PAM
cuaccaacaaagaagaaauu

SEQ ID NO: 4511 - RNA, 20 nt, Artificial Sequence
  targeting sequence with ATCN PAM
cccaggcuggagugcaacgg

SEQ ID NO: 4512 - RNA, 20 nt, Artificial Sequence
  targeting sequence with ATCN PAM
caugcaucaggagaggacag

SEQ ID NO: 4513 - RNA, 20 nt, Artificial Sequence
  targeting sequence with ATCN PAM
ggagaggacagggucaggga

SEQ ID NO: 4514 - RNA, 20 nt, Artificial Sequence
  targeting sequence with ATCN PAM
cugacccuguccucuccuga

SEQ ID NO: 4515 - RNA, 20 nt, Artificial Sequence
  targeting sequence with ATCN PAM
agccuuggaaccaagccucu

SEQ ID NO: 4516 - RNA, 20 nt, Artificial Sequence
  targeting sequence with ATCN PAM
uguuggccccaaccauggcu

SEQ ID NO: 4517 - RNA, 20 nt, Artificial Sequence
  targeting sequence with ATCN PAM
uccagcuggguggacagaag

SEQ ID NO: 4518 - RNA, 20 nt, Artificial Sequence
  targeting sequence with ATCN PAM
agcuggguggacagaagugu

SEQ ID NO: 4519 - RNA, 20 nt, Artificial Sequence
  targeting sequence with ATCN PAM
acuucacuucuggcugccuc

SEQ ID NO: 4520 - RNA, 20 nt, Artificial Sequence
  targeting sequence with ATCN PAM
agacugugcucuggcagccc

SEQ ID NO: 4521 - RNA, 20 nt, Artificial Sequence
  targeting sequence with ATCN PAM
aagucaggccaacuggaguc

SEQ ID NO: 4522 - RNA, 20 nt, Artificial Sequence
  targeting sequence with ATCN PAM
cguguccaucccuugagcca

SEQ ID NO: 4523 - RNA, 20 nt, Artificial Sequence
  targeting sequence with ATCN PAM
cuugagccagaggucaggug

SEQ ID NO: 4524 - RNA, 20 nt, Artificial Sequence
  targeting sequence with ATCN PAM
cuugaccucgugauccgccu

SEQ ID NO: 4525 - RNA, 20 nt, Artificial Sequence
  targeting sequence with ATCN PAM
cgaggucaagagauggagac

SEQ ID NO: 4526 - RNA, 20 nt, Artificial Sequence
  targeting sequence with ATCN PAM
gccugccucggccucccaaa

SEQ ID NO: 4527 - RNA, 20 nt, Artificial Sequence
  targeting sequence with ATCN PAM
cagcacuuugggaggccgag

SEQ ID NO: 4528 - RNA, 20 nt, Artificial Sequence
  targeting sequence with ATCN PAM
cugggccaggcgcuguggcu

SEQ ID NO: 4529 - RNA, 20 nt, Artificial Sequence
  targeting sequence with ATCN PAM
aaaaacugugaagagccucu

SEQ ID NO: 4530 - RNA, 20 nt, Artificial Sequence
  targeting sequence with ATCN PAM
uguaaguagaggcucuucac

SEQ ID NO: 4531 - RNA, 20 nt, Artificial Sequence
  targeting sequence with ATCN PAM
auaggcaaaagaccaaauac

SEQ ID NO: 4532 - RNA, 20 nt, Artificial Sequence
  targeting sequence with ATCN PAM
guuggguguuugaggaaugg

SEQ ID NO: 4533 - RNA, 20 nt, Artificial Sequence
  targeting sequence with ATCN PAM
caaucaguuggguguuugag

SEQ ID NO: 4534 - RNA, 20 nt, Artificial Sequence
  targeting sequence with ATCN PAM
ugaauaccacgcuaaagguu

SEQ ID NO: 4535 - RNA, 20 nt, Artificial Sequence
  targeting sequence with ATCN PAM
uaugugggggccaaguugca

SEQ ID NO: 4536 - RNA, 20 nt, Artificial Sequence
  targeting sequence with ATCN PAM
auugcuugaacugcucaccu

SEQ ID NO: 4537 - RNA, 20 nt, Artificial Sequence
  targeting sequence with ATCN PAM
uaaagccaccaucuuucagu

SEQ ID NO: 4538 - RNA, 20 nt, Artificial Sequence
  targeting sequence with ATCN PAM
uucaguccagauaccauggc

SEQ ID NO: 4539 - RNA, 20 nt, Artificial Sequence
  targeting sequence with ATCN PAM
ggacugaaagaugguggcuu

SEQ ID NO: 4540 - RNA, 20 nt, Artificial Sequence
  targeting sequence with ATCN PAM
augugacccccaagccuaga

SEQ ID NO: 4541 - RNA, 20 nt, Artificial Sequence
  targeting sequence with ATCN PAM
agggcuggaagaaagcucaa

SEQ ID NO: 4542 - RNA, 20 nt, Artificial Sequence
  targeting sequence with ATCN PAM
ggaggcaaaagauggucuag

SEQ ID NO: 4543 - RNA, 20 nt, Artificial Sequence
  targeting sequence with ATCN PAM
uuugccuccagauugccuua

SEQ ID NO: 4544 - RNA, 20 nt, Artificial Sequence
  targeting sequence with ATCN PAM
uacuagaccaucuuuugccu

SEQ ID NO: 4545 - RNA, 20 nt, Artificial Sequence
  targeting sequence with ATCN PAM
gucauuaggaacacuaucaa

SEQ ID NO: 4546 - RNA, 20 nt, Artificial Sequence
  targeting sequence with ATCN PAM
auucuuuuuucacuucucac

SEQ ID NO: 4547 - RNA, 20 nt, Artificial Sequence
  targeting sequence with ATCN PAM
aaaacuuaaaaauaggucca

SEQ ID NO: 4548 - RNA, 20 nt, Artificial Sequence
  targeting sequence with ATCN PAM
cuuugaagaaaauguauuug

SEQ ID NO: 4549 - RNA, 20 nt, Artificial Sequence
  targeting sequence with ATCN PAM
acaugcauauauuuacacaa

SEQ ID NO: 4550 - RNA, 20 nt, Artificial Sequence
  targeting sequence with ATCN PAM
uaaugcacugauuauacagg

SEQ ID NO: 4551 - RNA, 20 nt, Artificial Sequence
  targeting sequence with ATCN PAM
gugcauuaagauuuaaaaag

SEQ ID NO: 4552 - RNA, 20 nt, Artificial Sequence
  targeting sequence with ATCN PAM
cggcucacugcaagcuccgc

SEQ ID NO: 4553 - RNA, 20 nt, Artificial Sequence
  targeting sequence with ATCN PAM
gacuguaccucaaaggaaca

SEQ ID NO: 4554 - RNA, 20 nt, Artificial Sequence
  targeting sequence with ATCN PAM
gaaacaaaaccaaaugcagu

SEQ ID NO: 4555 - RNA, 20 nt, Artificial Sequence
  targeting sequence with ATCN PAM
gacuuuuacuccauucagaa

SEQ ID NO: 4556 - RNA, 20 nt, Artificial Sequence
  targeting sequence with ATCN PAM
uaaacaauguaaaaugcgca

SEQ ID NO: 4557 - RNA, 20 nt, Artificial Sequence
  targeting sequence with ATCN PAM
cccaggccaacacagccagc

SEQ ID NO: 4558 - RNA, 20 nt, Artificial Sequence
  targeting sequence with ATCN PAM
uguuacuuuugaguuucuuu

SEQ ID NO: 4559 - RNA, 20 nt, Artificial Sequence
  targeting sequence with ATCN PAM
guuuucauucuuugcuguac

SEQ ID NO: 4560 - RNA, 20 nt, Artificial Sequence
  targeting sequence with ATCN PAM
ggugcaguaauggcuuucuu

SEQ ID NO: 4561 - RNA, 20 nt, Artificial Sequence
  targeting sequence with ATCN PAM
gcacugaagguccuuccuaa

SEQ ID NO: 4562 - RNA, 20 nt, Artificial Sequence
  targeting sequence with ATCN PAM
uccuuucucaaacugucuua

SEQ ID NO: 4563 - RNA, 20 nt, Artificial Sequence
  targeting sequence with ATCN PAM
aaggaagguuuucaccugua

SEQ ID NO: 4564 - RNA, 20 nt, Artificial Sequence
  targeting sequence with ATCN PAM
aucaaaggaagguuuucacc

SEQ ID NO: 4565 - RNA, 20 nt, Artificial Sequence
  targeting sequence with ATCN PAM
aucuaucaaagugacuucca

SEQ ID NO: 4566 - RNA, 20 nt, Artificial Sequence
  targeting sequence with ATCN PAM
aucaaagugacuuccagugc

SEQ ID NO: 4567 - RNA, 20 nt, Artificial Sequence
  targeting sequence with ATCN PAM
aagugacuuccagugcccac

SEQ ID NO: 4568 - RNA, 20 nt, Artificial Sequence
  targeting sequence with ATCN PAM
accaguuuuucuaagcuaga

SEQ ID NO: 4569 - RNA, 20 nt, Artificial Sequence
  targeting sequence with ATCN PAM
uuuaaauaacuuuguggggg

SEQ ID NO: 4570 - RNA, 20 nt, Artificial Sequence
  targeting sequence with ATCN PAM
gcugagguuggggugaagac

SEQ ID NO: 4571 - RNA, 20 nt, Artificial Sequence
  targeting sequence with ATCN PAM
aaguaguuauggaaacaaca

SEQ ID NO: 4572 - RNA, 20 nt, Artificial Sequence
  targeting sequence with ATCN PAM
agcuugccaaagcaaaagga

SEQ ID NO: 4573 - RNA, 20 nt, Artificial Sequence
  targeting sequence with ATCN PAM
aguucugaaggaauuuccug

SEQ ID NO: 4574 - RNA, 20 nt, Artificial Sequence
  targeting sequence with ATCN PAM
uauaugcacuugguugcaca

SEQ ID NO: 4575 - RNA, 20 nt, Artificial Sequence
  targeting sequence with ATCN PAM
uuccauauuauuuguaguau

SEQ ID NO: 4576 - RNA, 20 nt, Artificial Sequence
  targeting sequence with ATCN PAM
agagagcuugguuaaucuuu

SEQ ID NO: 4577 - RNA, 20 nt, Artificial Sequence
  targeting sequence with ATCN PAM
ugguggaacuugaacauuua

SEQ ID NO: 4578 - RNA, 20 nt, Artificial Sequence
  targeting sequence with ATCN PAM
uccugguggaacuugaacau

SEQ ID NO: 4579 - RNA, 20 nt, Artificial Sequence
  targeting sequence with ATCN PAM
auagaaguccacugagcaua

SEQ ID NO: 4580 - RNA, 20 nt, Artificial Sequence
  targeting sequence with ATCN PAM
ccuuugguugauucucuuag

SEQ ID NO: 4581 - RNA, 20 nt, Artificial Sequence
  targeting sequence with ATCN PAM
accaaaggugauucuccuaa

SEQ ID NO: 4582 - RNA, 20 nt, Artificial Sequence
  targeting sequence with ATCN PAM
ucacuuugguuguaauuagg

SEQ ID NO: 4583 - RNA, 20 nt, Artificial Sequence
  targeting sequence with ATCN PAM
cuuugguuguaauuaggggu

SEQ ID NO: 4584 - RNA, 20 nt, Artificial Sequence
  targeting sequence with ATCN PAM
ugggcugggguugucuuuag

SEQ ID NO: 4585 - RNA, 20 nt, Artificial Sequence
  targeting sequence with ATCN PAM
cugggugaacguuuucuugg

SEQ ID NO: 4586 - RNA, 20 nt, Artificial Sequence
  targeting sequence with ATCN PAM
cuauccuacuacacugguuu

SEQ ID NO: 4587 - RNA, 20 nt, Artificial Sequence
  targeting sequence with ATCN PAM
uacuacacugguuuuuggaa

SEQ ID NO: 4588 - RNA, 20 nt, Artificial Sequence
  targeting sequence with ATCN PAM
caaaacaaaggcggcagagg

SEQ ID NO: 4589 - RNA, 20 nt, Artificial Sequence
  targeting sequence with ATCN PAM
acacauuucuucauuuaaaa

SEQ ID NO: 4590 - RNA, 20 nt, Artificial Sequence
  targeting sequence with ATCN PAM
cuucuuuauuucaaaggaaa

SEQ ID NO: 4591 - RNA, 20 nt, Artificial Sequence
  targeting sequence with ATCN PAM
uauuagaaaccauaaggaag

SEQ ID NO: 4592 - RNA, 20 nt, Artificial Sequence
  targeting sequence with ATCN PAM
gaacagcauacuugaagaau

SEQ ID NO: 4593 - RNA, 20 nt, Artificial Sequence
  targeting sequence with ATCN PAM
cuuggccgcacuuuuaaggu

SEQ ID NO: 4594 - RNA, 20 nt, Artificial Sequence
  targeting sequence with ATCN PAM
cugcacaguccuacuacagu

SEQ ID NO: 4595 - RNA, 20 nt, Artificial Sequence
  targeting sequence with ATCN PAM
uuugggggaugaugcuuuca

SEQ ID NO: 4596 - RNA, 20 nt, Artificial Sequence
  targeting sequence with ATCN PAM
cccaaaggaucacugcacag

SEQ ID NO: 4597 - RNA, 20 nt, Artificial Sequence
  targeting sequence with ATCN PAM
ucccccaaaggaucacugca

SEQ ID NO: 4598 - RNA, 20 nt, Artificial Sequence
  targeting sequence with ATCN PAM
ucgucaagguuaaggggcag

SEQ ID NO: 4599 - RNA, 20 nt, Artificial Sequence
  targeting sequence with ATCN PAM
cuuuugaaccugccccuuaa

SEQ ID NO: 4600 - RNA, 20 nt, Artificial Sequence
  targeting sequence with ATCN PAM
uacuuccaggauuagcguaa

SEQ ID NO: 4601 - RNA, 20 nt, Artificial Sequence
  targeting sequence with ATCN PAM
uggaaguaugaucacuuuug

SEQ ID NO: 4602 - RNA, 20 nt, Artificial Sequence
  targeting sequence with ATCN PAM
cucuggcuuucucacccaag

SEQ ID NO: 4603 - RNA, 20 nt, Artificial Sequence
  targeting sequence with ATCN PAM
auguguucuuccacggacaa

SEQ ID NO: 4604 - RNA, 20 nt, Artificial Sequence
  targeting sequence with ATCN PAM
accccgaauccaaaaauuca

SEQ ID NO: 4605 - RNA, 20 nt, Artificial Sequence
  targeting sequence with ATCN PAM
aaaaauucagacauggaaug

SEQ ID NO: 4606 - RNA, 20 nt, Artificial Sequence
  targeting sequence with ATCN PAM
uaccacauuccaugucugaa

SEQ ID NO: 4607 - RNA, 20 nt, Artificial Sequence
  targeting sequence with ATCN PAM
cagacuaacuuuacugugaa

SEQ ID NO: 4608 - RNA, 20 nt, Artificial Sequence
  targeting sequence with ATCN PAM
ccucucccuaucccagacua

SEQ ID NO: 4609 - RNA, 20 nt, Artificial Sequence
  targeting sequence with ATCN PAM
gguuuucgcaucuuuuuagu

SEQ ID NO: 4610 - RNA, 20 nt, Artificial Sequence
  targeting sequence with ATCN PAM
uuuuaguggguuuuagugca

SEQ ID NO: 4611 - RNA, 20 nt, Artificial Sequence
  targeting sequence with ATCN PAM
aaauuguggcuugaaggacu

SEQ ID NO: 4612 - RNA, 20 nt, Artificial Sequence
  targeting sequence with ATCN PAM
ggagcacaccgaagggcaau

SEQ ID NO: 4613 - RNA, 20 nt, Artificial Sequence
  targeting sequence with ATCN PAM
uaaaacaguccuuuaauaug

SEQ ID NO: 4614 - RNA, 20 nt, Artificial Sequence
  targeting sequence with ATCN PAM
caaggaaaaucaugcuacau

SEQ ID NO: 4615 - RNA, 20 nt, Artificial Sequence
  targeting sequence with ATCN PAM
ugcuacauaaaaaugaucca

SEQ ID NO: 4616 - RNA, 20 nt, Artificial Sequence
  targeting sequence with ATCN PAM
uuuuuauguagcaugauuuu

SEQ ID NO: 4617 - RNA, 20 nt, Artificial Sequence
  targeting sequence with ATCN PAM
aagauuuucgcccaaaaaac

SEQ ID NO: 4618 - RNA, 20 nt, Artificial Sequence
  targeting sequence with ATCN PAM
uggaucauuuuuauguagca

SEQ ID NO: 4619 - RNA, 20 nt, Artificial Sequence
  targeting sequence with ATCN PAM
aagaaguuuuuugggcgaaa

SEQ ID NO: 4620 - RNA, 20 nt, Artificial Sequence
  targeting sequence with ATCN PAM
aaaaaauacuauugcaauug

SEQ ID NO: 4621 - RNA, 20 nt, Artificial Sequence
  targeting sequence with ATCN PAM
guuuacauuuagaauaaugu

SEQ ID NO: 4622 - RNA, 20 nt, Artificial Sequence
  targeting sequence with ATCN PAM
ucuaggggaugaaaagaacc

SEQ ID NO: 4623 - RNA, 20 nt, Artificial Sequence
  targeting sequence with ATCN PAM
aggggaugaaaagaaccguu

SEQ ID NO: 4624 - RNA, 20 nt, Artificial Sequence
  targeting sequence with ATCN PAM
ccuagaugaugcuggcacag

SEQ ID NO: 4625 - RNA, 20 nt, Artificial Sequence
  targeting sequence with ATCN PAM
uccuggcugucauggcaguc

SEQ ID NO: 4626 - RNA, 20 nt, Artificial Sequence
  targeting sequence with ATCN PAM
acauccuccuggcugucaug

SEQ ID NO: 4627 - RNA, 20 nt, Artificial Sequence
  targeting sequence with ATCN PAM
uggagaugcgcgucuggcau

SEQ ID NO: 4628 - RNA, 20 nt, Artificial Sequence
  targeting sequence with ATCN PAM
ccaagauggagcugcagcag

SEQ ID NO: 4629 - RNA, 20 nt, Artificial Sequence
  targeting sequence with ATCN PAM
cagaauacuugugagcagaa

SEQ ID NO: 4630 - RNA, 20 nt, Artificial Sequence
  targeting sequence with ATCN PAM
ggcuugcccagggggcaugu

SEQ ID NO: 4631 - RNA, 20 nt, Artificial Sequence
  targeting sequence with ATCN PAM
ugagcaaugccaaugauuuu

SEQ ID NO: 4632 - RNA, 20 nt, Artificial Sequence
  targeting sequence with ATCN PAM
uuggcauugcucaagaugca

SEQ ID NO: 4633 - RNA, 20 nt, Artificial Sequence
  targeting sequence with ATCN PAM
agccuuuuacauucauucaa

SEQ ID NO: 4634 - RNA, 20 nt, Artificial Sequence
  targeting sequence with ATCN PAM
cuugaauagugaguuauaca

SEQ ID NO: 4635 - RNA, 20 nt, Artificial Sequence
  targeting sequence with ATCN PAM
cacuggaaugcaguggaggg

SEQ ID NO: 4636 - RNA, 20 nt, Artificial Sequence
  targeting sequence with ATCN PAM
aaguugcacagaauauauuu

SEQ ID NO: 4637 - RNA, 20 nt, Artificial Sequence
  targeting sequence with ATCN PAM
uauuugaaauuuuuuauguu

SEQ ID NO: 4638 - RNA, 20 nt, Artificial Sequence
  targeting sequence with ATCN PAM
cugucccugaggcaguacug

SEQ ID NO: 4639 - RNA, 20 nt, Artificial Sequence
  targeting sequence with ATCN PAM
guaaacuaaaaauaaaaucc

SEQ ID NO: 4640 - RNA, 20 nt, Artificial Sequence
  targeting sequence with ATCN PAM
uaagacccccagccaaauga

SEQ ID NO: 4641 - RNA, 20 nt, Artificial Sequence
  targeting sequence with ATCN PAM
uugccaagaacucacuuuuu

SEQ ID NO: 4642 - RNA, 20 nt, Artificial Sequence
  targeting sequence with ATCN PAM
ccucccuuuuugaguugugg

SEQ ID NO: 4643 - RNA, 20 nt, Artificial Sequence
  targeting sequence with ATCN PAM
cuauuuucacauuaaugcug

SEQ ID NO: 4644 - RNA, 20 nt, Artificial Sequence
  targeting sequence with ATCN PAM
uaagacugacagaauggacu

SEQ ID NO: 4645 - RNA, 20 nt, Artificial Sequence
  targeting sequence with ATCN PAM
aauuauaaacaagaccuaag

SEQ ID NO: 4646 - RNA, 20 nt, Artificial Sequence
  targeting sequence with ATCN PAM
cacccuauaaaccauaaaau

SEQ ID NO: 4647 - RNA, 20 nt, Artificial Sequence
  targeting sequence with ATCN PAM
caucaguuuuuaaaaaaauu

SEQ ID NO: 4648 - RNA, 20 nt, Artificial Sequence
  targeting sequence with ATCN PAM
guuuuuaaaaaaauuaacug

SEQ ID NO: 4649 - RNA, 20 nt, Artificial Sequence
  targeting sequence with ATCN PAM
caugacagacaacagacucc

SEQ ID NO: 4650 - RNA, 20 nt, Artificial Sequence
  targeting sequence with ATCN PAM
cuaaguaggggcuaacaagu

SEQ ID NO: 4651 - RNA, 20 nt, Artificial Sequence
  targeting sequence with ATCN PAM
acacauggaaaguauacauu

SEQ ID NO: 4652 - RNA, 20 nt, Artificial Sequence
  targeting sequence with ATCN PAM
uaaaucaacacauggaaagu

SEQ ID NO: 4653 - RNA, 20 nt, Artificial Sequence
  targeting sequence with ATCN PAM
cacuauaggaaucgauucac

SEQ ID NO: 4654 - RNA, 20 nt, Artificial Sequence
  targeting sequence with ATCN PAM
auucacaacuugcuuuuuuu

SEQ ID NO: 4655 - RNA, 20 nt, Artificial Sequence
  targeting sequence with ATCN PAM
auuccuauagugugauacua

SEQ ID NO: 4656 - RNA, 20 nt, Artificial Sequence
  targeting sequence with ATCN PAM
ccaagacccacuguugaaug

SEQ ID NO: 4657 - RNA, 20 nt, Artificial Sequence
  targeting sequence with ATCN PAM
cuccaugucaauacacagaa

SEQ ID NO: 4658 - RNA, 20 nt, Artificial Sequence
  targeting sequence with ATCN PAM
accucauuuuuuuuuaacug

SEQ ID NO: 4659 - RNA, 20 nt, Artificial Sequence
  targeting sequence with ATCN PAM
ccaagggggaacuagcugca

SEQ ID NO: 4660 - RNA, 20 nt, Artificial Sequence
  targeting sequence with ATCN PAM
uuguuauaguggaaaaguug

SEQ ID NO: 4661 - RNA, 20 nt, Artificial Sequence
  targeting sequence with ATCN PAM
cugacaucaguggaaaggga

SEQ ID NO: 4662 - RNA, 20 nt, Artificial Sequence
  targeting sequence with ATCN PAM
guggaaagggaucucugauc

SEQ ID NO: 4663 - RNA, 20 nt, Artificial Sequence
  targeting sequence with ATCN PAM
cuuuccacugaugucaggga

SEQ ID NO: 4664 - RNA, 20 nt, Artificial Sequence
  targeting sequence with ATCN PAM
cugaucugccuucuuaagaa

SEQ ID NO: 4665 - RNA, 20 nt, Artificial Sequence
  targeting sequence with ATCN PAM
gagaucccuuuccacugaug

SEQ ID NO: 4666 - RNA, 20 nt, Artificial Sequence
  targeting sequence with ATCN PAM
gccuucuuaagaagggcaca

SEQ ID NO: 4667 - RNA, 20 nt, Artificial Sequence
  targeting sequence with ATCN PAM
aacuaaaggagagugugccc

SEQ ID NO: 4668 - RNA, 20 nt, Artificial Sequence
  targeting sequence with ATCN PAM
ucuguaaagaggacacuaug

SEQ ID NO: 4669 - RNA, 20 nt, Artificial Sequence
  targeting sequence with ATCN PAM
cgccgcugcacucuagccug

SEQ ID NO: 4670 - RNA, 20 nt, Artificial Sequence
  targeting sequence with ATCN PAM
cagcucacugccagcuccac

SEQ ID NO: 4671 - RNA, 20 nt, Artificial Sequence
  targeting sequence with ATCN PAM
cuacuaaaaauacaaaaauu

SEQ ID NO: 4672 - RNA, 20 nt, Artificial Sequence
  targeting sequence with ATCN PAM
uaacacggugaaaccccauc

SEQ ID NO: 4673 - RNA, 20 nt, Artificial Sequence
  targeting sequence with ATCN PAM
agaccauccuaacacgguga

SEQ ID NO: 4674 - RNA, 20 nt, Artificial Sequence
  targeting sequence with ATCN PAM
ccugaccuugugauccgccc

SEQ ID NO: 4675 - RNA, 20 nt, Artificial Sequence
  targeting sequence with ATCN PAM
caaggucaggagaucaagac

SEQ ID NO: 4676 - RNA, 20 nt, Artificial Sequence
  targeting sequence with ATCN PAM
gcccgccucggccucccaaa

SEQ ID NO: 4677 - RNA, 20 nt, Artificial Sequence
  targeting sequence with ATCN PAM
caaauccccugggauuacag

SEQ ID NO: 4678 - RNA, 20 nt, Artificial Sequence
  targeting sequence with ATCN PAM
ccugggauuacaggcgugcg

SEQ ID NO: 4679 - RNA, 20 nt, Artificial Sequence
  targeting sequence with ATCN PAM
caggggauuugggauuuugg

SEQ ID NO: 4680 - RNA, 20 nt, Artificial Sequence
  targeting sequence with ATCN PAM
ggucuugguaauauagacuu

SEQ ID NO: 4681 - RNA, 20 nt, Artificial Sequence
  targeting sequence with ATCN PAM
cucaauuacuaaaaaaacuu

SEQ ID NO: 4682 - RNA, 20 nt, Artificial Sequence
  targeting sequence with ATCN PAM
cuugaauacuuuggaauuaa

SEQ ID NO: 4683 - RNA, 20 nt, Artificial Sequence
  targeting sequence with ATCN PAM
gaccauagcuagggaaauag

SEQ ID NO: 4684 - RNA, 20 nt, Artificial Sequence
  targeting sequence with ATCN PAM
uccaaaguuggucugagccu

SEQ ID NO: 4685 - RNA, 20 nt, Artificial Sequence
  targeting sequence with ATCN PAM
caggaaaccaggaccagaaa

SEQ ID NO: 4686 - RNA, 20 nt, Artificial Sequence
  targeting sequence with ATCN PAM
auugucugucuauaguuggc

SEQ ID NO: 4687 - RNA, 20 nt, Artificial Sequence
  targeting sequence with ATCN PAM
uucuggacuggacagcaucc

SEQ ID NO: 4688 - RNA, 20 nt, Artificial Sequence
  targeting sequence with ATCN PAM
uaggaaaaaauaauuaaaac

SEQ ID NO: 4689 - RNA, 20 nt, Artificial Sequence
  targeting sequence with ATCN PAM
ucuucaggcccugcuuaugu

SEQ ID NO: 4690 - RNA, 20 nt, Artificial Sequence
  targeting sequence with ATCN PAM
ggguaaaugaucuagacauu

SEQ ID NO: 4691 - RNA, 20 nt, Artificial Sequence
  targeting sequence with ATCN PAM
uuuacccagaugccaucuuc

SEQ ID NO: 4692 - RNA, 20 nt, Artificial Sequence
  targeting sequence with ATCN PAM
agacauucccuugauucuuu

SEQ ID NO: 4693 - RNA, 20 nt, Artificial Sequence
  targeting sequence with ATCN PAM
agggaaugucuagaucauuu

SEQ ID NO: 4694 - RNA, 20 nt, Artificial Sequence
  targeting sequence with ATCN PAM
auuuuauucugugaggaagu

SEQ ID NO: 4695 - RNA, 20 nt, Artificial Sequence
  targeting sequence with ATCN PAM
cauauaggcacauugccuga

SEQ ID NO: 4696 - RNA, 20 nt, Artificial Sequence
  targeting sequence with ATCN PAM
aaaucucauauaggcacauu

SEQ ID NO: 4697 - RNA, 20 nt, Artificial Sequence
  targeting sequence with ATCN PAM
uauuuguccauuacugcuuc

SEQ ID NO: 4698 - RNA, 20 nt, Artificial Sequence
  targeting sequence with ATCN PAM
caguguauggaaaaccacau

SEQ ID NO: 4699 - RNA, 20 nt, Artificial Sequence
  targeting sequence with ATCN PAM
caguaaucucaguguaugga

SEQ ID NO: 4700 - RNA, 20 nt, Artificial Sequence
  targeting sequence with ATCN PAM
uaagaaacauuucccaagua

SEQ ID NO: 4701 - RNA, 20 nt, Artificial Sequence
  targeting sequence with ATCN PAM
caaucauuuuaagaguaggu

SEQ ID NO: 4702 - RNA, 20 nt, Artificial Sequence
  targeting sequence with ATCN PAM
uuuuaagaguagguauacuc

SEQ ID NO: 4703 - RNA, 20 nt, Artificial Sequence
  targeting sequence with ATCN PAM
uuuuuccuuccgcuguuuuc

SEQ ID NO: 4704 - RNA, 20 nt, Artificial Sequence
  targeting sequence with ATCN PAM
agguuaguaugaaggaaaag

SEQ ID NO: 4705 - RNA, 20 nt, Artificial Sequence
  targeting sequence with ATCN PAM
guccuaugaacgggcccggg

SEQ ID NO: 4706 - RNA, 20 nt, Artificial Sequence
  targeting sequence with ATCN PAM
cguaucaguccuaugaacgg

SEQ ID NO: 4707 - RNA, 20 nt, Artificial Sequence
  targeting sequence with ATCN PAM
ugaacuugaagcaggaacug

SEQ ID NO: 4708 - RNA, 20 nt, Artificial Sequence
  targeting sequence with ATCN PAM
uucacaucuaaggagaaaaa

SEQ ID NO: 4709 - RNA, 20 nt, Artificial Sequence
  targeting sequence with ATCN PAM
aaggagaaaaaaaaaguuua

SEQ ID NO: 4710 - RNA, 20 nt, Artificial Sequence
  targeting sequence with ATCN PAM
uuccuggcauuauuuacauc

SEQ ID NO: 4711 - RNA, 20 nt, Artificial Sequence
  targeting sequence with ATCN PAM
aacucccaaaacacauucua

SEQ ID NO: 4712 - RNA, 20 nt, Artificial Sequence
  targeting sequence with ATCN PAM
uuuccagagacuaagagcua

SEQ ID NO: 4713 - RNA, 20 nt, Artificial Sequence
  targeting sequence with ATCN PAM
cguggcaacauggcuguucc

SEQ ID NO: 4714 - RNA, 20 nt, Artificial Sequence
  targeting sequence with ATCN PAM
uuucaauacacaguauuugc

SEQ ID NO: 4715 - RNA, 20 nt, Artificial Sequence
  targeting sequence with ATCN PAM
cugcaaauacuguguauuga

SEQ ID NO: 4716 - RNA, 20 nt, Artificial Sequence
  targeting sequence with ATCN PAM
gggcugcuggcaucgcugca

SEQ ID NO: 4717 - RNA, 20 nt, Artificial Sequence
  targeting sequence with ATCN PAM
uuucaugaggcuugcuuaau

SEQ ID NO: 4718 - RNA, 20 nt, Artificial Sequence
  targeting sequence with ATCN PAM
gggugagugagcuggccagu

SEQ ID NO: 4719 - RNA, 20 nt, Artificial Sequence
  targeting sequence with ATCN PAM
caaacauccgggugagugag

SEQ ID NO: 4720 - RNA, 20 nt, Artificial Sequence
  targeting sequence with ATCN PAM
uccccauggccaaacacaag

SEQ ID NO: 4721 - RNA, 20 nt, Artificial Sequence
  targeting sequence with ATCN PAM
ccauggccaaacacaagugu

SEQ ID NO: 4722 - RNA, 20 nt, Artificial Sequence
  targeting sequence with ATCN PAM
ugccucccccacuccuuaga

SEQ ID NO: 4723 - RNA, 20 nt, Artificial Sequence
  targeting sequence with ATCN PAM
ucuugccucccccacuccuu

SEQ ID NO: 4724 - RNA, 20 nt, Artificial Sequence
  targeting sequence with ATCN PAM
ucuuuguuuuacuucuccau

SEQ ID NO: 4725 - RNA, 20 nt, Artificial Sequence
  targeting sequence with ATCN PAM
guagagguauaagacagagu

SEQ ID NO: 4726 - RNA, 20 nt, Artificial Sequence
  targeting sequence with ATCN PAM
ccggcacucugucuuauacc

SEQ ID NO: 4727 - RNA, 20 nt, Artificial Sequence
  targeting sequence with ATCN PAM
ccugccuuggucucccaaag

SEQ ID NO: 4728 - RNA, 20 nt, Artificial Sequence
  targeting sequence with ATCN PAM
cagcacuuugggagaccaag

SEQ ID NO: 4729 - RNA, 20 nt, Artificial Sequence
  targeting sequence with ATCN PAM
uuuaaaccuuuucuaggcug

SEQ ID NO: 4730 - RNA, 20 nt, Artificial Sequence
  targeting sequence with ATCN PAM
cauccuuuaaaccuuuucua

SEQ ID NO: 4731 - RNA, 20 nt, Artificial Sequence
  targeting sequence with ATCN PAM
gagauucuagguggaaaaau

SEQ ID NO: 4732 - RNA, 20 nt, Artificial Sequence
  targeting sequence with ATCN PAM
cugaucucauccuuuaaacc

SEQ ID NO: 4733 - RNA, 20 nt, Artificial Sequence
  targeting sequence with ATCN PAM
auuucucuccagcccuuuac

SEQ ID NO: 4734 - RNA, 20 nt, Artificial Sequence
  targeting sequence with ATCN PAM
uccauuucucuccagcccuu

SEQ ID NO: 4735 - RNA, 20 nt, Artificial Sequence
  targeting sequence with ATCN PAM
auguuggaggaaaaaauggg

SEQ ID NO: 4736 - RNA, 20 nt, Artificial Sequence
  targeting sequence with ATCN PAM
ggaagauccgaagaguuggg

SEQ ID NO: 4737 - RNA, 20 nt, Artificial Sequence
  targeting sequence with ATCN PAM
uccagauuucccauuuuuuc

SEQ ID NO: 4738 - RNA, 20 nt, Artificial Sequence
  targeting sequence with ATCN PAM
gaagaguugggauucuagaa

SEQ ID NO: 4739 - RNA, 20 nt, Artificial Sequence
  targeting sequence with ATCN PAM
caacucuucggaucuuccag

SEQ ID NO: 4740 - RNA, 20 nt, Artificial Sequence
  targeting sequence with ATCN PAM
auucuagaaucccaacucuu

SEQ ID NO: 4741 - RNA, 20 nt, Artificial Sequence
  targeting sequence with ATCN PAM
ugugacuccucugcucagua

SEQ ID NO: 4742 - RNA, 20 nt, Artificial Sequence
  targeting sequence with ATCN PAM
acuuagcucuuuaguuccug

SEQ ID NO: 4743 - RNA, 20 nt, Artificial Sequence
  targeting sequence with ATCN PAM
gcccucugccugacagagag

SEQ ID NO: 4744 - RNA, 20 nt, Artificial Sequence
  targeting sequence with ATCN PAM
caacagggaauguacuauca

SEQ ID NO: 4745 - RNA, 20 nt, Artificial Sequence
  targeting sequence with ATCN PAM
cucagguagcauacauuuaa

SEQ ID NO: 4746 - RNA, 20 nt, Artificial Sequence
  targeting sequence with ATCN PAM
aaaacuaucuccuuucuuuc

SEQ ID NO: 4747 - RNA, 20 nt, Artificial Sequence
  targeting sequence with ATCN PAM
ccuuucuuucuucuuuuuaa

SEQ ID NO: 4748 - RNA, 20 nt, Artificial Sequence
  targeting sequence with ATCN PAM
caucuauaauauguaaacaa

SEQ ID NO: 4749 - RNA, 20 nt, Artificial Sequence
  targeting sequence with ATCN PAM
auaauauguaaacaaacuuu

SEQ ID NO: 4750 - RNA, 20 nt, Artificial Sequence
  targeting sequence with ATCN PAM
uaaacauucucccuuccaau

SEQ ID NO: 4751 - RNA, 20 nt, Artificial Sequence
  targeting sequence with ATCN PAM
uaaacuccacugcuuuucua

SEQ ID NO: 4752 - RNA, 20 nt, Artificial Sequence
  targeting sequence with ATCN PAM
uuguuucuuagaaaagcagu

SEQ ID NO: 4753 - RNA, 20 nt, Artificial Sequence
  targeting sequence with ATCN PAM
uaaaaaggguaagacaaugc

SEQ ID NO: 4754 - RNA, 20 nt, Artificial Sequence
  targeting sequence with ATCN PAM
uugauaggagucucuauacu

SEQ ID NO: 4755 - RNA, 20 nt, Artificial Sequence
  targeting sequence with ATCN PAM
aggauaaagaagaacuaaau

SEQ ID NO: 4756 - RNA, 20 nt, Artificial Sequence
  targeting sequence with ATCN PAM
aaaguaggacugcuuucuca

SEQ ID NO: 4757 - RNA, 20 nt, Artificial Sequence
  targeting sequence with ATCN PAM
aucaaaaguaggacugcuuu

SEQ ID NO: 4758 - RNA, 20 nt, Artificial Sequence
  targeting sequence with ATCN PAM
gcugcccagaguacgugauc

SEQ ID NO: 4759 - RNA, 20 nt, Artificial Sequence
  targeting sequence with ATCN PAM
cguacucugggcagcagaug

SEQ ID NO: 4760 - RNA, 20 nt, Artificial Sequence
  targeting sequence with ATCN PAM
ggaacaggucccaucccuag

SEQ ID NO: 4761 - RNA, 20 nt, Artificial Sequence
  targeting sequence with ATCN PAM
cuagaauugauuuuccacca

SEQ ID NO: 4762 - RNA, 20 nt, Artificial Sequence
  targeting sequence with ATCN PAM
auucuagggaugggaccugu

SEQ ID NO: 4763 - RNA, 20 nt, Artificial Sequence
  targeting sequence with ATCN PAM
uauggcauuuugugaacuua

SEQ ID NO: 4764 - RNA, 20 nt, Artificial Sequence
  targeting sequence with ATCN PAM
aacaccgaaaacaccacaga

SEQ ID NO: 4765 - RNA, 20 nt, Artificial Sequence
  targeting sequence with ATCN PAM
uucucucucuuuaccagaga

SEQ ID NO: 4766 - RNA, 20 nt, Artificial Sequence
  targeting sequence with ATCN PAM
caagagaccagcacuuugga

SEQ ID NO: 4767 - RNA, 20 nt, Artificial Sequence
  targeting sequence with ATCN PAM
ggcaggaaauuacucuccuc

SEQ ID NO: 4768 - RNA, 20 nt, Artificial Sequence
  targeting sequence with ATCN PAM
ugauaaaagcagacacaugu

SEQ ID NO: 4769 - RNA, 20 nt, Artificial Sequence
  targeting sequence with ATCN PAM
agauguaggcuggugaccac

SEQ ID NO: 4770 - RNA, 20 nt, Artificial Sequence
  targeting sequence with ATCN PAM
cacaugugucugcuuuuauc

SEQ ID NO: 4771 - RNA, 20 nt, Artificial Sequence
  targeting sequence with ATCN PAM
cugcaugugucccacaggcu

SEQ ID NO: 4772 - RNA, 20 nt, Artificial Sequence
  targeting sequence with ATCN PAM
uauuugauauuaaacauggc

SEQ ID NO: 4773 - RNA, 20 nt, Artificial Sequence
  targeting sequence with ATCN PAM
aauaagauuccuaagaagcc

SEQ ID NO: 4774 - RNA, 20 nt, Artificial Sequence
  targeting sequence with ATCN PAM
guucuacugguauguaugag

SEQ ID NO: 4775 - RNA, 20 nt, Artificial Sequence
  targeting sequence with ATCN PAM
gugccuacuaugcaaauuca

SEQ ID NO: 4776 - RNA, 20 nt, Artificial Sequence
  targeting sequence with ATCN PAM
gcauuuuauagaugaggaaa

SEQ ID NO: 4777 - RNA, 20 nt, Artificial Sequence
  targeting sequence with ATCN PAM
auaaaaugcagauaauaccu

SEQ ID NO: 4778 - RNA, 20 nt, Artificial Sequence
  targeting sequence with ATCN PAM
uugcugcccuacuuaauauu

SEQ ID NO: 4779 - RNA, 20 nt, Artificial Sequence
  targeting sequence with ATCN PAM
aguuuugacuuuaaaaucca

SEQ ID NO: 4780 - RNA, 20 nt, Artificial Sequence
  targeting sequence with ATCN PAM
aaguucuuaaacuuuacaau

SEQ ID NO: 4781 - RNA, 20 nt, Artificial Sequence
  targeting sequence with ATCN PAM
cauuguaaaguuuaagaacu

SEQ ID NO: 4782 - RNA, 20 nt, Artificial Sequence
  targeting sequence with ATCN PAM
ggguuuguagaguuucaaaa

SEQ ID NO: 4783 - RNA, 20 nt, Artificial Sequence
  targeting sequence with ATCN PAM
acuaacucuccucauaagua

SEQ ID NO: 4784 - RNA, 20 nt, Artificial Sequence
  targeting sequence with ATCN PAM
gagucagagugcuagcgauc

SEQ ID NO: 4785 - RNA, 20 nt, Artificial Sequence
  targeting sequence with ATCN PAM
cuagcacucugacucugauu

SEQ ID NO: 4786 - RNA, 20 nt, Artificial Sequence
  targeting sequence with ATCN PAM
aaaucacuuagcaaaaguga

SEQ ID NO: 4787 - RNA, 20 nt, Artificial Sequence
  targeting sequence with ATCN PAM
cuuagcaaaagugagcugga

SEQ ID NO: 4788 - RNA, 20 nt, Artificial Sequence
  targeting sequence with ATCN PAM
guguagcucuuuccagcuca

SEQ ID NO: 4789 - RNA, 20 nt, Artificial Sequence
  targeting sequence with ATCN PAM
caucaguguagcucuuucca

SEQ ID NO: 4790 - RNA, 20 nt, Artificial Sequence
  targeting sequence with ATCN PAM
gacuccaaaccaucacauca

SEQ ID NO: 4791 - RNA, 20 nt, Artificial Sequence
  targeting sequence with ATCN PAM
acuccacuuugacaucagac

SEQ ID NO: 4792 - RNA, 20 nt, Artificial Sequence
  targeting sequence with ATCN PAM
uuuuaauuguagguucauaa

SEQ ID NO: 4793 - RNA, 20 nt, Artificial Sequence
  targeting sequence with ATCN PAM
aaacccucauauacugcugu

SEQ ID NO: 4794 - RNA, 20 nt, Artificial Sequence
  targeting sequence with ATCN PAM
gggguagaauugcugaguca

SEQ ID NO: 4795 - RNA, 20 nt, Artificial Sequence
  targeting sequence with ATCN PAM
ucauugccaaaaaguauaaa

SEQ ID NO: 4796 - RNA, 20 nt, Artificial Sequence
  targeting sequence with ATCN PAM
uugccaaaaaguauaaacaa

SEQ ID NO: 4797 - RNA, 20 nt, Artificial Sequence
  targeting sequence with ATCN PAM
ucuuggcuguucacaaguca

SEQ ID NO: 4798 - RNA, 20 nt, Artificial Sequence
  targeting sequence with ATCN PAM
uggcuguucacaagucaagu

SEQ ID NO: 4799 - RNA, 20 nt, Artificial Sequence
  targeting sequence with ATCN PAM
auauuuuguauccuaaucug

SEQ ID NO: 4800 - RNA, 20 nt, Artificial Sequence
  targeting sequence with ATCN PAM
uaaucugcuugucauuugcc

SEQ ID NO: 4801 - RNA, 20 nt, Artificial Sequence
  targeting sequence with ATCN PAM
gcuugucauuugccaccugg

SEQ ID NO: 4802 - RNA, 20 nt, Artificial Sequence
  targeting sequence with ATCN PAM
auggaugcucacagaaacau

SEQ ID NO: 4803 - RNA, 20 nt, Artificial Sequence
  targeting sequence with ATCN PAM
auugaaggagaaaggaagaa

SEQ ID NO: 4804 - RNA, 20 nt, Artificial Sequence
  targeting sequence with ATCN PAM
aucgauugaaggagaaagga

SEQ ID NO: 4805 - RNA, 20 nt, Artificial Sequence
  targeting sequence with ATCN PAM
ucauaugcauacauguagug

SEQ ID NO: 4806 - RNA, 20 nt, Artificial Sequence
  targeting sequence with ATCN PAM
cgagcccuaggcaaaacuac

SEQ ID NO: 4807 - RNA, 20 nt, Artificial Sequence
  targeting sequence with ATCN PAM
uuuccucaucuucucaccug

SEQ ID NO: 4808 - RNA, 20 nt, Artificial Sequence
  targeting sequence with ATCN PAM
ucucaccugaccuuucauaa

SEQ ID NO: 4809 - RNA, 20 nt, Artificial Sequence
  targeting sequence with ATCN PAM
uaagucaaagagugucugua

SEQ ID NO: 4810 - RNA, 20 nt, Artificial Sequence
  targeting sequence with ATCN PAM
uaaaugggaaauauuguuuu

SEQ ID NO: 4811 - RNA, 20 nt, Artificial Sequence
  targeting sequence with ATCN PAM
aaccauuguuagccagggac

SEQ ID NO: 4812 - RNA, 20 nt, Artificial Sequence
  targeting sequence with ATCN PAM
caggccccaguccugggaau

SEQ ID NO: 4813 - RNA, 20 nt, Artificial Sequence
  targeting sequence with ATCN PAM
uuacaaauaacaugaggcaa

SEQ ID NO: 4814 - RNA, 20 nt, Artificial Sequence
  targeting sequence with ATCN PAM
uuuugaauucagucugcugu

SEQ ID NO: 4815 - RNA, 20 nt, Artificial Sequence
  targeting sequence with ATCN PAM
gucaauaucauuuugaauuc

SEQ ID NO: 4816 - RNA, 20 nt, Artificial Sequence
  targeting sequence with ATCN PAM
cugguaaagucuuggcugca

SEQ ID NO: 4817 - RNA, 20 nt, Artificial Sequence
  targeting sequence with ATCN PAM
agagcucauguaaugagggg

SEQ ID NO: 4818 - RNA, 20 nt, Artificial Sequence
  targeting sequence with ATCN PAM
uagaaaaugagacccugcua

SEQ ID NO: 4819 - RNA, 20 nt, Artificial Sequence
  targeting sequence with ATCN PAM
cugguagcagggucucauuu

SEQ ID NO: 4820 - RNA, 20 nt, Artificial Sequence
  targeting sequence with ATCN PAM
cugacaagcagccucuccuu

SEQ ID NO: 4821 - RNA, 20 nt, Artificial Sequence
  targeting sequence with ATCN PAM
ucuauugaaagagauuuaac

SEQ ID NO: 4822 - RNA, 20 nt, Artificial Sequence
  targeting sequence with ATCN PAM
cuuucaauagaggauuuauu

SEQ ID NO: 4823 - RNA, 20 nt, Artificial Sequence
  targeting sequence with ATCN PAM
cagaggucuaguuaaaucuc

SEQ ID NO: 4824 - RNA, 20 nt, Artificial Sequence
  targeting sequence with ATCN PAM
uuucuaacaccuagaguuug

SEQ ID NO: 4825 - RNA, 20 nt, Artificial Sequence
  targeting sequence with ATCN PAM
aacucuagguguuagaaaag

SEQ ID NO: 4826 - RNA, 20 nt, Artificial Sequence
  targeting sequence with ATCN PAM
cuuuaaaaaaaaaaaaaaaa

SEQ ID NO: 4827 - RNA, 20 nt, Artificial Sequence
  targeting sequence with ATCN PAM
uggcucacugcagccucaaa

SEQ ID NO: 4828 - RNA, 20 nt, Artificial Sequence
  targeting sequence with ATCN PAM
cuugagcucuggaauuugag

SEQ ID NO: 4829 - RNA, 20 nt, Artificial Sequence
  targeting sequence with ATCN PAM
ucccaccucagccuucugag

SEQ ID NO: 4830 - RNA, 20 nt, Artificial Sequence
  targeting sequence with ATCN PAM
uccugccucagcuucccaaa

SEQ ID NO: 4831 - RNA, 20 nt, Artificial Sequence
  targeting sequence with ATCN PAM
uucaaacuauagauacuuua

SEQ ID NO: 4832 - RNA, 20 nt, Artificial Sequence
  targeting sequence with ATCN PAM
auaguuugaaagaugaaaau

SEQ ID NO: 4833 - RNA, 20 nt, Artificial Sequence
  targeting sequence with ATCN PAM
auacguugugaaggcaaaua

SEQ ID NO: 4834 - RNA, 20 nt, Artificial Sequence
  targeting sequence with ATCN PAM
ggugugaaauauugggauuc

SEQ ID NO: 4835 - RNA, 20 nt, Artificial Sequence
  targeting sequence with ATCN PAM
caauauuucacaccugauuu

SEQ ID NO: 4836 - RNA, 20 nt, Artificial Sequence
  targeting sequence with ATCN PAM
gagaauacuugcaaaagucc

SEQ ID NO: 4837 - RNA, 20 nt, Artificial Sequence
  targeting sequence with ATCN PAM
uaagaagguugcaaaccugu

SEQ ID NO: 4838 - RNA, 20 nt, Artificial Sequence
  targeting sequence with ATCN PAM
aguuugaaaaugacuuccag

SEQ ID NO: 4839 - RNA, 20 nt, Artificial Sequence
  targeting sequence with ATCN PAM
cauauuaugucuagaggugc

SEQ ID NO: 4840 - RNA, 20 nt, Artificial Sequence
  targeting sequence with ATCN PAM
ucacuccugccauuuugcac

SEQ ID NO: 4841 - RNA, 20 nt, Artificial Sequence
  targeting sequence with ATCN PAM
aaaaccuggacugagcacau

SEQ ID NO: 4842 - RNA, 20 nt, Artificial Sequence
  targeting sequence with ATCN PAM
cagcucugcaacucgcuagc

SEQ ID NO: 4843 - RNA, 20 nt, Artificial Sequence
  targeting sequence with ATCN PAM
cccaagcuagcgaguugcag

SEQ ID NO: 4844 - RNA, 20 nt, Artificial Sequence
  targeting sequence with ATCN PAM
uuuucauccucuauaaagag

SEQ ID NO: 4845 - RNA, 20 nt, Artificial Sequence
  targeting sequence with ATCN PAM
ucuauaaagaggaaaucuac

SEQ ID NO: 4846 - RNA, 20 nt, Artificial Sequence
  targeting sequence with ATCN PAM
accuacuccaaagggcaauu

SEQ ID NO: 4847 - RNA, 20 nt, Artificial Sequence
  targeting sequence with ATCN PAM
uugcaauugcccuuuggagu

SEQ ID NO: 4848 - RNA, 20 nt, Artificial Sequence
  targeting sequence with ATCN PAM
aauaccuggcacacaagagg

SEQ ID NO: 4849 - RNA, 20 nt, Artificial Sequence
  targeting sequence with ATCN PAM
gucucacagagcaccucuug

SEQ ID NO: 4850 - RNA, 20 nt, Artificial Sequence
  targeting sequence with ATCN PAM
caaauauacauuugguuuca

SEQ ID NO: 4851 - RNA, 20 nt, Artificial Sequence
  targeting sequence with ATCN PAM
cgccacugcacuccaaccug

SEQ ID NO: 4852 - RNA, 20 nt, Artificial Sequence
  targeting sequence with ATCN PAM
uggcucauuguggucucaau

SEQ ID NO: 4853 - RNA, 20 nt, Artificial Sequence
  targeting sequence with ATCN PAM
ccuaggcucuagugacccuu

SEQ ID NO: 4854 - RNA, 20 nt, Artificial Sequence
  targeting sequence with ATCN PAM
aggaauucaagaccagccug

SEQ ID NO: 4855 - RNA, 20 nt, Artificial Sequence
  targeting sequence with ATCN PAM
cuucaauccaggaauucaag

SEQ ID NO: 4856 - RNA, 20 nt, Artificial Sequence
  targeting sequence with ATCN PAM
uccugccuuggccucccaaa

SEQ ID NO: 4857 - RNA, 20 nt, Artificial Sequence
  targeting sequence with ATCN PAM
cagcacuuugggaggccaag

SEQ ID NO: 4858 - RNA, 20 nt, Artificial Sequence
  targeting sequence with ATCN PAM
uaaauauacugaaaacagug

SEQ ID NO: 4859 - RNA, 20 nt, Artificial Sequence
  targeting sequence with ATCN PAM
cagaaauggguuuacugggc

SEQ ID NO: 4860 - RNA, 20 nt, Artificial Sequence
  targeting sequence with ATCN PAM
uccucaauccuagauacaag

SEQ ID NO: 4861 - RNA, 20 nt, Artificial Sequence
  targeting sequence with ATCN PAM
uagauacaagccucuuuuac

SEQ ID NO: 4862 - RNA, 20 nt, Artificial Sequence
  targeting sequence with ATCN PAM
aggauugaggaggauggagu

SEQ ID NO: 4863 - RNA, 20 nt, Artificial Sequence
  targeting sequence with ATCN PAM
agguuccugccauuucccug

SEQ ID NO: 4864 - RNA, 20 nt, Artificial Sequence
  targeting sequence with ATCN PAM
ggcaaacuugagccagggaa

SEQ ID NO: 4865 - RNA, 20 nt, Artificial Sequence
  targeting sequence with ATCN PAM
accuauguaugugugugagg

SEQ ID NO: 4866 - RNA, 20 nt, Artificial Sequence
  targeting sequence with ATCN PAM
uggugcacugcagccucaaa

SEQ ID NO: 4867 - RNA, 20 nt, Artificial Sequence
  targeting sequence with ATCN PAM
cuugagcccaggaguuugag

SEQ ID NO: 4868 - RNA, 20 nt, Artificial Sequence
  targeting sequence with ATCN PAM
ucccaucucagccuccugag

SEQ ID NO: 4869 - RNA, 20 nt, Artificial Sequence
  targeting sequence with ATCN PAM
cagccuccugaguagcuggg

SEQ ID NO: 4870 - RNA, 20 nt, Artificial Sequence
  targeting sequence with ATCN PAM
aauuuuuucaaaucuccaaa

SEQ ID NO: 4871 - RNA, 20 nt, Artificial Sequence
  targeting sequence with ATCN PAM
ccaaaaagaguuauauagaa

SEQ ID NO: 4872 - RNA, 20 nt, Artificial Sequence
  targeting sequence with ATCN PAM
ucaccaugcucuuacagaaa

SEQ ID NO: 4873 - RNA, 20 nt, Artificial Sequence
  targeting sequence with ATCN PAM
cugugaacaauaguuacauu

SEQ ID NO: 4874 - RNA, 20 nt, Artificial Sequence
  targeting sequence with ATCN PAM
uucuacuuacccaaaugcug

SEQ ID NO: 4875 - RNA, 20 nt, Artificial Sequence
  targeting sequence with ATCN PAM
cagcagaugaaacagacaaa

SEQ ID NO: 4876 - RNA, 20 nt, Artificial Sequence
  targeting sequence with ATCN PAM
gcugagaucauucuacuuac

SEQ ID NO: 4877 - RNA, 20 nt, Artificial Sequence
  targeting sequence with ATCN PAM
gggcaaaauagcaaaacccu

SEQ ID NO: 4878 - RNA, 20 nt, Artificial Sequence
  targeting sequence with ATCN PAM
ucccaccucagccuccugag

SEQ ID NO: 4879 - RNA, 20 nt, Artificial Sequence
  targeting sequence with ATCN PAM
cuugagcccgagaggucaag

SEQ ID NO: 4880 - RNA, 20 nt, Artificial Sequence
  targeting sequence with ATCN PAM
uucugggacuccuguuuuug

SEQ ID NO: 4881 - RNA, 20 nt, Artificial Sequence
  targeting sequence with ATCN PAM
uuauuaaaccucacuacuaa

SEQ ID NO: 4882 - RNA, 20 nt, Artificial Sequence
  targeting sequence with ATCN PAM
gaaccaauuggcuugugccu

SEQ ID NO: 4883 - RNA, 20 nt, Artificial Sequence
  targeting sequence with ATCN PAM
aauaacaggcacaagccaau

SEQ ID NO: 4884 - RNA, 20 nt, Artificial Sequence
  targeting sequence with ATCN PAM
gguuggugugguggcaugug

SEQ ID NO: 4885 - RNA, 20 nt, Artificial Sequence
  targeting sequence with ATCN PAM
cagcuacuugggaggcugag

SEQ ID NO: 4886 - RNA, 20 nt, Artificial Sequence
  targeting sequence with ATCN PAM
ccauuacuaauauuauaauc

SEQ ID NO: 4887 - RNA, 20 nt, Artificial Sequence
  targeting sequence with ATCN PAM
ucuuagcacacuuuauuuuc

SEQ ID NO: 4888 - RNA, 20 nt, Artificial Sequence
  targeting sequence with ATCN PAM
ucucauuaaauauuaacacc

SEQ ID NO: 4889 - RNA, 20 nt, Artificial Sequence
  targeting sequence with ATCN PAM
ucccuuuuucuccccuacug

SEQ ID NO: 4890 - RNA, 20 nt, Artificial Sequence
  targeting sequence with ATCN PAM
uguaaagggguuaaaauucc

SEQ ID NO: 4891 - RNA, 20 nt, Artificial Sequence
  targeting sequence with ATCN PAM
gggcagaggagauggugggu

SEQ ID NO: 4892 - RNA, 20 nt, Artificial Sequence
  targeting sequence with ATCN PAM
ccucugccccgauuuguguc

SEQ ID NO: 4893 - RNA, 20 nt, Artificial Sequence
  targeting sequence with ATCN PAM
uacaagaacagucaugccuc

SEQ ID NO: 4894 - RNA, 20 nt, Artificial Sequence
  targeting sequence with ATCN PAM
uuaagugaggcaugacuguu

SEQ ID NO: 4895 - RNA, 20 nt, Artificial Sequence
  targeting sequence with ATCN PAM
ugagaaaugaguuguuacgu

SEQ ID NO: 4896 - RNA, 20 nt, Artificial Sequence
  targeting sequence with ATCN PAM
cuaugugaacaccauacagu

SEQ ID NO: 4897 - RNA, 20 nt, Artificial Sequence
  targeting sequence with ATCN PAM
agauaguacagccuaugaua

SEQ ID NO: 4898 - RNA, 20 nt, Artificial Sequence
  targeting sequence with ATCN PAM
agauuuguguaaguacacug

SEQ ID NO: 4899 - RNA, 20 nt, Artificial Sequence
  targeting sequence with ATCN PAM
uaggcuguacuaucuagauu

SEQ ID NO: 4900 - RNA, 20 nt, Artificial Sequence
  targeting sequence with ATCN PAM
agacauaucuaaacauagaa

SEQ ID NO: 4901 - RNA, 20 nt, Artificial Sequence
  targeting sequence with ATCN PAM
aaacauagaaaaggcacacu

SEQ ID NO: 4902 - RNA, 20 nt, Artificial Sequence
  targeting sequence with ATCN PAM
cagcugcuuggaagcugagg

SEQ ID NO: 4903 - RNA, 20 nt, Artificial Sequence
  targeting sequence with ATCN PAM
caaaaaaacaaaacaaaaca

SEQ ID NO: 4904 - RNA, 20 nt, Artificial Sequence
  targeting sequence with ATCN PAM
acaacauauaagacaguugu

SEQ ID NO: 4905 - RNA, 20 nt, Artificial Sequence
  targeting sequence with ATCN PAM
aaaugucauuauucagcaca

SEQ ID NO: 4906 - RNA, 20 nt, Artificial Sequence
  targeting sequence with ATCN PAM
cacauagucaugugcugaau

SEQ ID NO: 4907 - RNA, 20 nt, Artificial Sequence
  targeting sequence with ATCN PAM
uuugccagccaaaaucacac

SEQ ID NO: 4908 - RNA, 20 nt, Artificial Sequence
  targeting sequence with ATCN PAM
aagcggaggugcgugaacau

SEQ ID NO: 4909 - RNA, 20 nt, Artificial Sequence
  targeting sequence with ATCN PAM
caugcuacuuguaauccaag

SEQ ID NO: 4910 - RNA, 20 nt, Artificial Sequence
  targeting sequence with ATCN PAM
uauuuuaaggauuuuuacuc

SEQ ID NO: 4911 - RNA, 20 nt, Artificial Sequence
  targeting sequence with ATCN PAM
uuaaaauaagauuauuaauc

SEQ ID NO: 4912 - RNA, 20 nt, Artificial Sequence
  targeting sequence with ATCN PAM
gcaaacagaaagccuuugca

SEQ ID NO: 4913 - RNA, 20 nt, Artificial Sequence
  targeting sequence with ATCN PAM
uacagugcaaaggcuuucug

SEQ ID NO: 4914 - RNA, 20 nt, Artificial Sequence
  targeting sequence with ATCN PAM
uauuuugguagaugaaauuc

SEQ ID NO: 4915 - RNA, 20 nt, Artificial Sequence
  targeting sequence with ATCN PAM
accaaaauaugauacuugcu

SEQ ID NO: 4916 - RNA, 20 nt, Artificial Sequence
  targeting sequence with ATCN PAM
cccacuggaagcaaaaccug

SEQ ID NO: 4917 - RNA, 20 nt, Artificial Sequence
  targeting sequence with ATCN PAM
acaaaguauuaaacacauca

SEQ ID NO: 4918 - RNA, 20 nt, Artificial Sequence
  targeting sequence with ATCN PAM
agauuuugucguagguaaau

SEQ ID NO: 4919 - RNA, 20 nt, Artificial Sequence
  targeting sequence with ATCN PAM
ugauguguuuaauacuuugu

SEQ ID NO: 4920 - RNA, 20 nt, Artificial Sequence
  targeting sequence with ATCN PAM
aggaaguugacuacuguguu

SEQ ID NO: 4921 - RNA, 20 nt, Artificial Sequence
  targeting sequence with ATCN PAM
gagaugagccaggggccuuu

SEQ ID NO: 4922 - RNA, 20 nt, Artificial Sequence
  targeting sequence with ATCN PAM
cugaucuaggaaguugacua

SEQ ID NO: 4923 - RNA, 20 nt, Artificial Sequence
  targeting sequence with ATCN PAM
guaauuugacacaaaaggcc

SEQ ID NO: 4924 - RNA, 20 nt, Artificial Sequence
  targeting sequence with ATCN PAM
cugagaaccaauggugcuuc

SEQ ID NO: 4925 - RNA, 20 nt, Artificial Sequence
  targeting sequence with ATCN PAM
ugugcuagugaccuauugcc

SEQ ID NO: 4926 - RNA, 20 nt, Artificial Sequence
  targeting sequence with ATCN PAM
acucuccccaauucagcuag

SEQ ID NO: 4927 - RNA, 20 nt, Artificial Sequence
  targeting sequence with ATCN PAM
uuuucccuuuucagcugaag

SEQ ID NO: 4928 - RNA, 20 nt, Artificial Sequence
  targeting sequence with ATCN PAM
gucccccacaauauuucaag

SEQ ID NO: 4929 - RNA, 20 nt, Artificial Sequence
  targeting sequence with ATCN PAM
uaaugacaagaaaacaguaa

SEQ ID NO: 4930 - RNA, 20 nt, Artificial Sequence
  targeting sequence with ATCN PAM
aaauaauacaggaaauaaau

SEQ ID NO: 4931 - RNA, 20 nt, Artificial Sequence
  targeting sequence with ATCN PAM
ggguugugccagaauguuag

SEQ ID NO: 4932 - RNA, 20 nt, Artificial Sequence
  targeting sequence with ATCN PAM
uuguauuccccuagaaaaaa

SEQ ID NO: 4933 - RNA, 20 nt, Artificial Sequence
  targeting sequence with ATCN PAM
cacuagguacuuccauauau

SEQ ID NO: 4934 - RNA, 20 nt, Artificial Sequence
  targeting sequence with ATCN PAM
ccuuuaauaacuucaacaac

SEQ ID NO: 4935 - RNA, 20 nt, Artificial Sequence
  targeting sequence with ATCN PAM
uuacauuuuuacagagggag

SEQ ID NO: 4936 - RNA, 20 nt, Artificial Sequence
  targeting sequence with ATCN PAM
gagccucaguuucucccucu

SEQ ID NO: 4937 - RNA, 20 nt, Artificial Sequence
  targeting sequence with ATCN PAM
acucagagcuggcaagcaaa

SEQ ID NO: 4938 - RNA, 20 nt, Artificial Sequence
  targeting sequence with ATCN PAM
ccuccauuccucuuuagcgg

SEQ ID NO: 4939 - RNA, 20 nt, Artificial Sequence
  targeting sequence with ATCN PAM
caguuuagcguuuagccgcu

SEQ ID NO: 4940 - RNA, 20 nt, Artificial Sequence
  targeting sequence with ATCN PAM
cuuuuauggaagauuguaua

SEQ ID NO: 4941 - RNA, 20 nt, Artificial Sequence
  targeting sequence with ATCN PAM
uccauaaaagagauuuaugg

SEQ ID NO: 4942 - RNA, 20 nt, Artificial Sequence
  targeting sequence with ATCN PAM
caauuaggaaauaugacgua

SEQ ID NO: 4943 - RNA, 20 nt, Artificial Sequence
  targeting sequence with ATCN PAM
aauuagcccuucauuuauga

SEQ ID NO: 4944 - RNA, 20 nt, Artificial Sequence
  targeting sequence with ATCN PAM
agccuacauaucgucuggag

SEQ ID NO: 4945 - RNA, 20 nt, Artificial Sequence
  targeting sequence with ATCN PAM
ucuggagauucucagaucac

SEQ ID NO: 4946 - RNA, 20 nt, Artificial Sequence
  targeting sequence with ATCN PAM
ccagacgauauguaggcuag

SEQ ID NO: 4947 - RNA, 20 nt, Artificial Sequence
  targeting sequence with ATCN PAM
gagaaucuccagacgauaug

SEQ ID NO: 4948 - RNA, 20 nt, Artificial Sequence
  targeting sequence with ATCN PAM
cuuuucaguugacaggucuc

SEQ ID NO: 4949 - RNA, 20 nt, Artificial Sequence
  targeting sequence with ATCN PAM
gagcauacaucauuggguua

SEQ ID NO: 4950 - RNA, 20 nt, Artificial Sequence
  targeting sequence with ATCN PAM
uuggguuauguccaaugaug

SEQ ID NO: 4951 - RNA, 20 nt, Artificial Sequence
  targeting sequence with ATCN PAM
uuggacauaacccaaugaug

SEQ ID NO: 4952 - RNA, 20 nt, Artificial Sequence
  targeting sequence with ATCN PAM
acuaaaauuauauuuaaaca

SEQ ID NO: 4953 - RNA, 20 nt, Artificial Sequence
  targeting sequence with ATCN PAM
ccggguuuaauacaaacuuu

SEQ ID NO: 4954 - RNA, 20 nt, Artificial Sequence
  targeting sequence with ATCN PAM
gcuucugagaaaguuuguau

SEQ ID NO: 4955 - RNA, 20 nt, Artificial Sequence
  targeting sequence with ATCN PAM
ccuucaaauacaagcuuuca

SEQ ID NO: 4956 - RNA, 20 nt, Artificial Sequence
  targeting sequence with ATCN PAM
acaccugggggguuuuuagc

SEQ ID NO: 4957 - RNA, 20 nt, Artificial Sequence
  targeting sequence with ATCN PAM
uacugagcuacuguagccug

SEQ ID NO: 4958 - RNA, 20 nt, Artificial Sequence
  targeting sequence with ATCN PAM
ggccuggaauccuacugagc

SEQ ID NO: 4959 - RNA, 20 nt, Artificial Sequence
  targeting sequence with ATCN PAM
ccuaagaaaaaaacuaccaa

SEQ ID NO: 4960 - RNA, 20 nt, Artificial Sequence
  targeting sequence with ATCN PAM
ucaguuucuagcagcaaauu

SEQ ID NO: 4961 - RNA, 20 nt, Artificial Sequence
  targeting sequence with ATCN PAM
uucugagcuucaguguucuc

SEQ ID NO: 4962 - RNA, 20 nt, Artificial Sequence
  targeting sequence with ATCN PAM
uauuuacaguugagaacacu

SEQ ID NO: 4963 - RNA, 20 nt, Artificial Sequence
  targeting sequence with ATCN PAM
agauaucuaagggucccuuc

SEQ ID NO: 4964 - RNA, 20 nt, Artificial Sequence
  targeting sequence with ATCN PAM
agauuaaucuuauuuacagu

SEQ ID NO: 4965 - RNA, 20 nt, Artificial Sequence
  targeting sequence with ATCN PAM
aagggucccuucuacuucug

SEQ ID NO: 4966 - RNA, 20 nt, Artificial Sequence
  targeting sequence with ATCN PAM
cauguuuuguuaguggcagc

SEQ ID NO: 4967 - RNA, 20 nt, Artificial Sequence
  targeting sequence with ATCN PAM
gaaguuggcacaggucucau

SEQ ID NO: 4968 - RNA, 20 nt, Artificial Sequence
  targeting sequence with ATCN PAM
cuuaaaaaaauuucuaaacc

SEQ ID NO: 4969 - RNA, 20 nt, Artificial Sequence
  targeting sequence with ATCN PAM
uguauuuggggaaggcagga

SEQ ID NO: 4970 - RNA, 20 nt, Artificial Sequence
  targeting sequence with ATCN PAM
cacucauagcugaaugcaca

SEQ ID NO: 4971 - RNA, 20 nt, Artificial Sequence
  targeting sequence with ATCN PAM
gaacuccaccucagccuuug

SEQ ID NO: 4972 - RNA, 20 nt, Artificial Sequence
  targeting sequence with ATCN PAM
aagcucugcuacaauggcuu

SEQ ID NO: 4973 - RNA, 20 nt, Artificial Sequence
  targeting sequence with ATCN PAM
gaagcauuccaaagccuaua

SEQ ID NO: 4974 - RNA, 20 nt, Artificial Sequence
  targeting sequence with ATCN PAM
gccuaacucuggaauaauca

SEQ ID NO: 4975 - RNA, 20 nt, Artificial Sequence
  targeting sequence with ATCN PAM
ucacuuggagcuacucacuu

SEQ ID NO: 4976 - RNA, 20 nt, Artificial Sequence
  targeting sequence with ATCN PAM
cuucucaauaauguccuucg

SEQ ID NO: 4977 - RNA, 20 nt, Artificial Sequence
  targeting sequence with ATCN PAM
cuacuucggucauuauuucc

SEQ ID NO: 4978 - RNA, 20 nt, Artificial Sequence
  targeting sequence with ATCN PAM
caaguugaaguaaauguuua

SEQ ID NO: 4979 - RNA, 20 nt, Artificial Sequence
  targeting sequence with ATCN PAM
aaugcuucagagagcuaggc

SEQ ID NO: 4980 - RNA, 20 nt, Artificial Sequence
  targeting sequence with ATCN PAM
auaugguugaaagccuagcu

SEQ ID NO: 4981 - RNA, 20 nt, Artificial Sequence
  targeting sequence with ATCN PAM
cgaaaucuauaugguugaaa

SEQ ID NO: 4982 - RNA, 20 nt, Artificial Sequence
  targeting sequence with ATCN PAM
uccugguaugaaaauaacac

SEQ ID NO: 4983 - RNA, 20 nt, Artificial Sequence
  targeting sequence with ATCN PAM
ugguaugaaaauaacacuga

SEQ ID NO: 4984 - RNA, 20 nt, Artificial Sequence
  targeting sequence with ATCN PAM
uggcuuuaccacuuacugag

SEQ ID NO: 4985 - RNA, 20 nt, Artificial Sequence
  targeting sequence with ATCN PAM
uuaaaaugggaauaauacaa

SEQ ID NO: 4986 - RNA, 20 nt, Artificial Sequence
  targeting sequence with ATCN PAM
ucacaguaggcccuacaggu

SEQ ID NO: 4987 - RNA, 20 nt, Artificial Sequence
  targeting sequence with ATCN PAM
agcacuaggcacaucacagg

SEQ ID NO: 4988 - RNA, 20 nt, Artificial Sequence
  targeting sequence with ATCN PAM
caggaguuuaacacuguucg

SEQ ID NO: 4989 - RNA, 20 nt, Artificial Sequence
  targeting sequence with ATCN PAM
ucaucaaauaacaaacagca

SEQ ID NO: 4990 - RNA, 20 nt, Artificial Sequence
  targeting sequence with ATCN PAM
ucaaauaacaaacagcaaca

SEQ ID NO: 4991 - RNA, 20 nt, Artificial Sequence
  targeting sequence with ATCN PAM
aauaacaaacagcaacacug

SEQ ID NO: 4992 - RNA, 20 nt, Artificial Sequence
  targeting sequence with ATCN PAM
acucagauacuaguaaaaua

SEQ ID NO: 4993 - RNA, 20 nt, Artificial Sequence
  targeting sequence with ATCN PAM
gaguugaugagagggaggcc

SEQ ID NO: 4994 - RNA, 20 nt, Artificial Sequence
  targeting sequence with ATCN PAM
ugagcauccacgcaugcauu

SEQ ID NO: 4995 - RNA, 20 nt, Artificial Sequence
  targeting sequence with ATCN PAM
acgcaugcauuaacugguuc

SEQ ID NO: 4996 - RNA, 20 nt, Artificial Sequence
  targeting sequence with ATCN PAM
uucugugaccaagaaccagu

SEQ ID NO: 4997 - RNA, 20 nt, Artificial Sequence
  targeting sequence with ATCN PAM
gugaaguccauccacagccu

SEQ ID NO: 4998 - RNA, 20 nt, Artificial Sequence
  targeting sequence with ATCN PAM
acagccuacuuucuuccuac

SEQ ID NO: 4999 - RNA, 20 nt, Artificial Sequence
  targeting sequence with ATCN PAM
cucuaagcugaauacuacca

SEQ ID NO: 5000 - RNA, 20 nt, Artificial Sequence
  targeting sequence with ATCN PAM
aagcucuuuccauuaaguua

SEQ ID NO: 5001 - RNA, 20 nt, Artificial Sequence
  targeting sequence with ATCN PAM
aacuuaauggaaagagcuua

SEQ ID NO: 5002 - RNA, 20 nt, Artificial Sequence
  targeting sequence with ATCN PAM
cagcauugugggaggcugag

SEQ ID NO: 5003 - RNA, 20 nt, Artificial Sequence
  targeting sequence with ATCN PAM
acccaccucagccucccaca

SEQ ID NO: 5004 - RNA, 20 nt, Artificial Sequence
  targeting sequence with ATCN PAM
ccugaggucaggaguucgag

SEQ ID NO: 5005 - RNA, 20 nt, Artificial Sequence
  targeting sequence with ATCN PAM
cagcuacuggggaggcuaag

SEQ ID NO: 5006 - RNA, 20 nt, Artificial Sequence
  targeting sequence with ATCN PAM
cuugaacccaggaggcggag

SEQ ID NO: 5007 - RNA, 20 nt, Artificial Sequence
  targeting sequence with ATCN PAM
ugacuugcugcaaccuccgc

SEQ ID NO: 5008 - RNA, 20 nt, Artificial Sequence
  targeting sequence with ATCN PAM
caccacugcacuccagccug

SEQ ID NO: 5009 - RNA, 20 nt, Artificial Sequence
  targeting sequence with ATCN PAM
ugccacugcacuccagccug

SEQ ID NO: 5010 - RNA, 20 nt, Artificial Sequence
  targeting sequence with ATCN PAM
cagcucacugcaaccuccac

SEQ ID NO: 5011 - RNA, 20 nt, Artificial Sequence
  targeting sequence with ATCN PAM
gagagguggagguugcagug

SEQ ID NO: 5012 - RNA, 20 nt, Artificial Sequence
  targeting sequence with ATCN PAM
cuacuaaaaauacaaaaaaa

SEQ ID NO: 5013 - RNA, 20 nt, Artificial Sequence
  targeting sequence with ATCN PAM
uggcuaacauggugaaaccc

SEQ ID NO: 5014 - RNA, 20 nt, Artificial Sequence
  targeting sequence with ATCN PAM
ucugaccuugugauccaccc

SEQ ID NO: 5015 - RNA, 20 nt, Artificial Sequence
  targeting sequence with ATCN PAM
caaggucagaagauugagac

SEQ ID NO: 5016 - RNA, 20 nt, Artificial Sequence
  targeting sequence with ATCN PAM
acccaccucagccucccaaa

SEQ ID NO: 5017 - RNA, 20 nt, Artificial Sequence
  targeting sequence with ATCN PAM
uagcacuuugggaggcugag

SEQ ID NO: 5018 - RNA, 20 nt, Artificial Sequence
  targeting sequence with ATCN PAM
uuucugggcuccaaaaguuc

SEQ ID NO: 5019 - RNA, 20 nt, Artificial Sequence
  targeting sequence with ATCN PAM
uuuccuugaaguugcaauca

SEQ ID NO: 5020 - RNA, 20 nt, Artificial Sequence
  targeting sequence with ATCN PAM
ggguauaauuaaaaagauac

SEQ ID NO: 5021 - RNA, 20 nt, Artificial Sequence
  targeting sequence with ATCN PAM
uuuuaauuauacccugauug

SEQ ID NO: 5022 - RNA, 20 nt, Artificial Sequence
  targeting sequence with ATCN PAM
agguaucuuuuuaauuauac

SEQ ID NO: 5023 - RNA, 20 nt, Artificial Sequence
  targeting sequence with ATCN PAM
guuugaaaaaucuagguauc

SEQ ID NO: 5024 - RNA, 20 nt, Artificial Sequence
  targeting sequence with ATCN PAM
ccauuggugccucaugcaca

SEQ ID NO: 5025 - RNA, 20 nt, Artificial Sequence
  targeting sequence with ATCN PAM
uuucuaaggaguguagaagc

SEQ ID NO: 5026 - RNA, 20 nt, Artificial Sequence
  targeting sequence with ATCN PAM
aucaaucuaaacagucugua

SEQ ID NO: 5027 - RNA, 20 nt, Artificial Sequence
  targeting sequence with ATCN PAM
aucuaaacagucuguauucu

SEQ ID NO: 5028 - RNA, 20 nt, Artificial Sequence
  targeting sequence with ATCN PAM
aaacagucuguauucuccac

SEQ ID NO: 5029 - RNA, 20 nt, Artificial Sequence
  targeting sequence with ATCN PAM
uuagacuucaaacaaccagu

SEQ ID NO: 5030 - RNA, 20 nt, Artificial Sequence
  targeting sequence with ATCN PAM
uauuuccugggcuuacagag

SEQ ID NO: 5031 - RNA, 20 nt, Artificial Sequence
  targeting sequence with ATCN PAM
gaaaaauaauacuggauggc

SEQ ID NO: 5032 - RNA, 20 nt, Artificial Sequence
  targeting sequence with ATCN PAM
aguauuauuuuucagauaag

SEQ ID NO: 5033 - RNA, 20 nt, Artificial Sequence
  targeting sequence with ATCN PAM
guuugcugagccauccagua

SEQ ID NO: 5034 - RNA, 20 nt, Artificial Sequence
  targeting sequence with ATCN PAM
gagauaggguccuaaguaua

SEQ ID NO: 5035 - RNA, 20 nt, Artificial Sequence
  targeting sequence with ATCN PAM
cugauuuaaaaucaguuugc

SEQ ID NO: 5036 - RNA, 20 nt, Artificial Sequence
  targeting sequence with ATCN PAM
gcccaguagaggacucccug

SEQ ID NO: 5037 - RNA, 20 nt, Artificial Sequence
  targeting sequence with ATCN PAM
ucaauaccuaaaauacaggg

SEQ ID NO: 5038 - RNA, 20 nt, Artificial Sequence
  targeting sequence with ATCN PAM
ucauguuuguaguccuagcu

SEQ ID NO: 5039 - RNA, 20 nt, Artificial Sequence
  targeting sequence with ATCN PAM
cugaaguucuuugucuuuuc

SEQ ID NO: 5040 - RNA, 20 nt, Artificial Sequence
  targeting sequence with ATCN PAM
aacccuguccccauccuacc

SEQ ID NO: 5041 - RNA, 20 nt, Artificial Sequence
  targeting sequence with ATCN PAM
uaccuuaaaaugcacucucu

SEQ ID NO: 5042 - RNA, 20 nt, Artificial Sequence
  targeting sequence with ATCN PAM
cagcacuuugggaggccgag

SEQ ID NO: 5043 - RNA, 20 nt, Artificial Sequence
  targeting sequence with ATCN PAM
ugaggucagguguucacgac

SEQ ID NO: 5044 - RNA, 20 nt, Artificial Sequence
  targeting sequence with ATCN PAM
cuugaaccugggaggcagaa

SEQ ID NO: 5045 - RNA, 20 nt, Artificial Sequence
  targeting sequence with ATCN PAM
caaacaaacaaacaaacaaa

SEQ ID NO: 5046 - RNA, 20 nt, Artificial Sequence
  targeting sequence with ATCN PAM
gcucugugcuugaagugaaa

SEQ ID NO: 5047 - RNA, 20 nt, Artificial Sequence
  targeting sequence with ATCN PAM
ccuucuaguucucuguacuu

SEQ ID NO: 5048 - RNA, 20 nt, Artificial Sequence
  targeting sequence with ATCN PAM
uauacauucuugaacuccuu

SEQ ID NO: 5049 - RNA, 20 nt, Artificial Sequence
  targeting sequence with ATCN PAM
caucggucuacuaaaaaguu

SEQ ID NO: 5050 - RNA, 20 nt, Artificial Sequence
  targeting sequence with ATCN PAM
gucuacuaaaaaguuucugu

SEQ ID NO: 5051 - RNA, 20 nt, Artificial Sequence
  targeting sequence with ATCN PAM
ucuccaaauuacuaaaucca

SEQ ID NO: 5052 - RNA, 20 nt, Artificial Sequence
  targeting sequence with ATCN PAM
ccaaauuacuaaauccaaag

SEQ ID NO: 5053 - RNA, 20 nt, Artificial Sequence
  targeting sequence with ATCN PAM
aaagagaaguucuuaguccu

SEQ ID NO: 5054 - RNA, 20 nt, Artificial Sequence
  targeting sequence with ATCN PAM
gcagcauuugacauacuuga

SEQ ID NO: 5055 - RNA, 20 nt, Artificial Sequence
  targeting sequence with ATCN PAM
aguaugucaaaugcugcaga

SEQ ID NO: 5056 - RNA, 20 nt, Artificial Sequence
  targeting sequence with ATCN PAM
ucucuagauuuuccucuucu

SEQ ID NO: 5057 - RNA, 20 nt, Artificial Sequence
  targeting sequence with ATCN PAM
agagaggaugguguacugga

SEQ ID NO: 5058 - RNA, 20 nt, Artificial Sequence
  targeting sequence with ATCN PAM
ucuuccuuuucuucuucucc

SEQ ID NO: 5059 - RNA, 20 nt, Artificial Sequence
  targeting sequence with ATCN PAM
uaugacucuaagagucucua

SEQ ID NO: 5060 - RNA, 20 nt, Artificial Sequence
  targeting sequence with ATCN PAM
aagugggaauguugaauagg

SEQ ID NO: 5061 - RNA, 20 nt, Artificial Sequence
  targeting sequence with ATCN PAM
gccaucuaagugggaauguu

SEQ ID NO: 5062 - RNA, 20 nt, Artificial Sequence
  targeting sequence with ATCN PAM
caguuaaugacaaaucuauu

SEQ ID NO: 5063 - RNA, 20 nt, Artificial Sequence
  targeting sequence with ATCN PAM
auucuuccagcuguuuaggu

SEQ ID NO: 5064 - RNA, 20 nt, Artificial Sequence
  targeting sequence with ATCN PAM
ucauaguuacugauuucuuu

SEQ ID NO: 5065 - RNA, 20 nt, Artificial Sequence
  targeting sequence with ATCN PAM
guaacuaugaggauuuuaac

SEQ ID NO: 5066 - RNA, 20 nt, Artificial Sequence
  targeting sequence with ATCN PAM
aaccugccagaaaauucugu

SEQ ID NO: 5067 - RNA, 20 nt, Artificial Sequence
  targeting sequence with ATCN PAM
ccuucaaaauacaucuaaaa

SEQ ID NO: 5068 - RNA, 20 nt, Artificial Sequence
  targeting sequence with ATCN PAM
aaaauccaacuacaucuuau

SEQ ID NO: 5069 - RNA, 20 nt, Artificial Sequence
  targeting sequence with ATCN PAM
aacuacaucuuauaaucuuc

SEQ ID NO: 5070 - RNA, 20 nt, Artificial Sequence
  targeting sequence with ATCN PAM
uauaaucuucacuuguacuu

SEQ ID NO: 5071 - RNA, 20 nt, Artificial Sequence
  targeting sequence with ATCN PAM
ucacuuguacuuuagucuga

SEQ ID NO: 5072 - RNA, 20 nt, Artificial Sequence
  targeting sequence with ATCN PAM
ugguucagacuaaaguacaa

SEQ ID NO: 5073 - RNA, 20 nt, Artificial Sequence
  targeting sequence with ATCN PAM
uauauugucugaguuacuaa

SEQ ID NO: 5074 - RNA, 20 nt, Artificial Sequence
  targeting sequence with ATCN PAM
uuuuaguaacucagacaaua

SEQ ID NO: 5075 - RNA, 20 nt, Artificial Sequence
  targeting sequence with ATCN PAM
ugcccacauaucuguucuua

SEQ ID NO: 5076 - RNA, 20 nt, Artificial Sequence
  targeting sequence with ATCN PAM
guucuuaauacuacaaccag

SEQ ID NO: 5077 - RNA, 20 nt, Artificial Sequence
  targeting sequence with ATCN PAM
uucugguuguaguauuaaga

SEQ ID NO: 5078 - RNA, 20 nt, Artificial Sequence
  targeting sequence with ATCN PAM
uuuaaaaaccuaagucaaau

SEQ ID NO: 5079 - RNA, 20 nt, Artificial Sequence
  targeting sequence with ATCN PAM
caucaguccucugcuuaaaa

SEQ ID NO: 5080 - RNA, 20 nt, Artificial Sequence
  targeting sequence with ATCN PAM
guccucugcuuaaaauucuu

SEQ ID NO: 5081 - RNA, 20 nt, Artificial Sequence
  targeting sequence with ATCN PAM
caggaauucauugaagaauu

SEQ ID NO: 5082 - RNA, 20 nt, Artificial Sequence
  targeting sequence with ATCN PAM
auguaguucagaccuuuguu

SEQ ID NO: 5083 - RNA, 20 nt, Artificial Sequence
  targeting sequence with ATCN PAM
acuuauaugcauauuuuuuc

SEQ ID NO: 5084 - RNA, 20 nt, Artificial Sequence
  targeting sequence with ATCN PAM
ccaaaauauuuuccaauaua

SEQ ID NO: 5085 - RNA, 20 nt, Artificial Sequence
  targeting sequence with ATCN PAM
uaauuuuuugguauuccuag

SEQ ID NO: 5086 - RNA, 20 nt, Artificial Sequence
  targeting sequence with ATCN PAM
uuuaacaccauaaaguaugu

SEQ ID NO: 5087 - RNA, 20 nt, Artificial Sequence
  targeting sequence with ATCN PAM
gaaguuaauucuaucaaaau

SEQ ID NO: 5088 - RNA, 20 nt, Artificial Sequence
  targeting sequence with ATCN PAM
aaauuuauacaaacacuuac

SEQ ID NO: 5089 - RNA, 20 nt, Artificial Sequence
  targeting sequence with ATCN PAM
uuguuuacauuucucuugac

SEQ ID NO: 5090 - RNA, 20 nt, Artificial Sequence
  targeting sequence with ATCN PAM
uaacugcauaaacugcauaa

SEQ ID NO: 5091 - RNA, 20 nt, Artificial Sequence
  targeting sequence with ATCN PAM
acuuaaagugcaugugacac

SEQ ID NO: 5092 - RNA, 20 nt, Artificial Sequence
  targeting sequence with ATCN PAM
ccugagugaccaguuccucu

SEQ ID NO: 5093 - RNA, 20 nt, Artificial Sequence
  targeting sequence with ATCN PAM
caguaaaaagcgaucucuug

SEQ ID NO: 5094 - RNA, 20 nt, Artificial Sequence
  targeting sequence with ATCN PAM
cuuuuuacugagauaugcag

SEQ ID NO: 5095 - RNA, 20 nt, Artificial Sequence
  targeting sequence with ATCN PAM
cuugagacuucucuauuauu

SEQ ID NO: 5096 - RNA, 20 nt, Artificial Sequence
  targeting sequence with ATCN PAM
caugguauuauucgagguuu

SEQ ID NO: 5097 - RNA, 20 nt, Artificial Sequence
  targeting sequence with ATCN PAM
acuuuuucuuguaaugucau

SEQ ID NO: 5098 - RNA, 20 nt, Artificial Sequence
  targeting sequence with ATCN PAM
agcaaucaacuuuuucuugu

SEQ ID NO: 5099 - RNA, 20 nt, Artificial Sequence
  targeting sequence with ATCN PAM
guaugaaauggcaggcaacc

SEQ ID NO: 5100 - RNA, 20 nt, Artificial Sequence
  targeting sequence with ATCN PAM
ucuguaugaaauggcaggca

SEQ ID NO: 5101 - RNA, 20 nt, Artificial Sequence
  targeting sequence with ATCN PAM
uaaggaagagaaaauacauu

SEQ ID NO: 5102 - RNA, 20 nt, Artificial Sequence
  targeting sequence with ATCN PAM
uaaggaaaauguuauuuuaa

SEQ ID NO: 5103 - RNA, 20 nt, Artificial Sequence
  targeting sequence with ATCN PAM
auaacauaaacuguuaacac

SEQ ID NO: 5104 - RNA, 20 nt, Artificial Sequence
  targeting sequence with ATCN PAM
guguauaacuucugacuccc

SEQ ID NO: 5105 - RNA, 20 nt, Artificial Sequence
  targeting sequence with ATCN PAM
uugauugugugugagggucc

SEQ ID NO: 5106 - RNA, 20 nt, Artificial Sequence
  targeting sequence with ATCN PAM
aagauccguguauaacuucu

SEQ ID NO: 5107 - RNA, 20 nt, Artificial Sequence
  targeting sequence with ATCN PAM
ccacuuugaucaagaguuaa

SEQ ID NO: 5108 - RNA, 20 nt, Artificial Sequence
  targeting sequence with ATCN PAM
aaguggggauuaggggugcu

SEQ ID NO: 5109 - RNA, 20 nt, Artificial Sequence
  targeting sequence with ATCN PAM
agaguuaacuguauuugguc

SEQ ID NO: 5110 - RNA, 20 nt, Artificial Sequence
  targeting sequence with ATCN PAM
uuggaaucuccaaagugaug

SEQ ID NO: 5111 - RNA, 20 nt, Artificial Sequence
  targeting sequence with ATCN PAM
ccaaagugaugugucuuuuu

SEQ ID NO: 5112 - RNA, 20 nt, Artificial Sequence
  targeting sequence with ATCN PAM
cuuuggagauuccaaggauu

SEQ ID NO: 5113 - RNA, 20 nt, Artificial Sequence
  targeting sequence with ATCN PAM
gccgucuuauuagcauacaa

SEQ ID NO: 5114 - RNA, 20 nt, Artificial Sequence
  targeting sequence with ATCN PAM
gaaagaccaaggcauaauua

SEQ ID NO: 5115 - RNA, 20 nt, Artificial Sequence
  targeting sequence with ATCN PAM
uuuaaccuucacucuccuuc

SEQ ID NO: 5116 - RNA, 20 nt, Artificial Sequence
  targeting sequence with ATCN PAM
ccaauggcaagcaauuuaau

SEQ ID NO: 5117 - RNA, 20 nt, Artificial Sequence
  targeting sequence with ATCN PAM
aucacacccacauaaugaag

SEQ ID NO: 5118 - RNA, 20 nt, Artificial Sequence
  targeting sequence with ATCN PAM
cacccacauaaugaaguuuc

SEQ ID NO: 5119 - RNA, 20 nt, Artificial Sequence
  targeting sequence with ATCN PAM
agaagcucccuaacccuguc

SEQ ID NO: 5120 - RNA, 20 nt, Artificial Sequence
  targeting sequence with ATCN PAM
cuucccauaugccuugccua

SEQ ID NO: 5121 - RNA, 20 nt, Artificial Sequence
  targeting sequence with ATCN PAM
uuucaucugcauccuuuaua

SEQ ID NO: 5122 - RNA, 20 nt, Artificial Sequence
  targeting sequence with ATCN PAM
gcauccuuuauaauaggcca

SEQ ID NO: 5123 - RNA, 20 nt, Artificial Sequence
  targeting sequence with ATCN PAM
uuuauaauaggccaguauac

SEQ ID NO: 5124 - RNA, 20 nt, Artificial Sequence
  targeting sequence with ATCN PAM
aaggagggggcuguggaaac

SEQ ID NO: 5125 - RNA, 20 nt, Artificial Sequence
  targeting sequence with ATCN PAM
cauuuccaaugcccauugaa

SEQ ID NO: 5126 - RNA, 20 nt, Artificial Sequence
  targeting sequence with ATCN PAM
aauacuaucuccagguagac

SEQ ID NO: 5127 - RNA, 20 nt, Artificial Sequence
  targeting sequence with ATCN PAM
ccagguagacagagucagaa

SEQ ID NO: 5128 - RNA, 20 nt, Artificial Sequence
  targeting sequence with ATCN PAM
uuuaauucaauucaauucug

SEQ ID NO: 5129 - RNA, 20 nt, Artificial Sequence
  targeting sequence with ATCN PAM
ccacagaccuggcaucagaa

SEQ ID NO: 5130 - RNA, 20 nt, Artificial Sequence
  targeting sequence with ATCN PAM
gaauuguguuguugagagga

SEQ ID NO: 5131 - RNA, 20 nt, Artificial Sequence
  targeting sequence with ATCN PAM
ucucaacaacacaauucuga

SEQ ID NO: 5132 - RNA, 20 nt, Artificial Sequence
  targeting sequence with ATCN PAM
acucaauuuccuuuacacuc

SEQ ID NO: 5133 - RNA, 20 nt, Artificial Sequence
  targeting sequence with ATCN PAM
gauuuggccuucuuuauggu

SEQ ID NO: 5134 - RNA, 20 nt, Artificial Sequence
  targeting sequence with ATCN PAM
gaugugccuuugaaggccau

SEQ ID NO: 5135 - RNA, 20 nt, Artificial Sequence
  targeting sequence with ATCN PAM
accauaaagaaggccaaauc

SEQ ID NO: 5136 - RNA, 20 nt, Artificial Sequence
  targeting sequence with ATCN PAM
aaucucguauacccuucccu

SEQ ID NO: 5137 - RNA, 20 nt, Artificial Sequence
  targeting sequence with ATCN PAM
cguauacccuucccuuuaua

SEQ ID NO: 5138 - RNA, 20 nt, Artificial Sequence
  targeting sequence with ATCN PAM
aaauuauaaagggaagggua

SEQ ID NO: 5139 - RNA, 20 nt, Artificial Sequence
  targeting sequence with ATCN PAM
caacauuuugggaggccaaa

SEQ ID NO: 5140 - RNA, 20 nt, Artificial Sequence
  targeting sequence with ATCN PAM
uccugccuuuuggccuccca

SEQ ID NO: 5141 - RNA, 20 nt, Artificial Sequence
  targeting sequence with ATCN PAM
cuugagcccaggaguuugag

SEQ ID NO: 5142 - RNA, 20 nt, Artificial Sequence
  targeting sequence with ATCN PAM
uuuccuucugaucaccccac

SEQ ID NO: 5143 - RNA, 20 nt, Artificial Sequence
  targeting sequence with ATCN PAM
gaaggaaaggauucauagga

SEQ ID NO: 5144 - RNA, 20 nt, Artificial Sequence
  targeting sequence with ATCN PAM
ccccacucacccugggcuag

SEQ ID NO: 5145 - RNA, 20 nt, Artificial Sequence
  targeting sequence with ATCN PAM
auuuuauuaagaaugcuagc

SEQ ID NO: 5146 - RNA, 20 nt, Artificial Sequence
  targeting sequence with ATCN PAM
cuguuuguucugagguuaua

SEQ ID NO: 5147 - RNA, 20 nt, Artificial Sequence
  targeting sequence with ATCN PAM
aagauauauagcaaacaaca

SEQ ID NO: 5148 - RNA, 20 nt, Artificial Sequence
  targeting sequence with ATCN PAM
uggauucaaaaccccugaca

SEQ ID NO: 5149 - RNA, 20 nt, Artificial Sequence
  targeting sequence with ATCN PAM
gcuuaaaaaguuggcauuua

SEQ ID NO: 5150 - RNA, 20 nt, Artificial Sequence
  targeting sequence with ATCN PAM
accauaaggcauaagagggu

SEQ ID NO: 5151 - RNA, 20 nt, Artificial Sequence
  targeting sequence with ATCN PAM
aacuucacagugaaaaaucu

SEQ ID NO: 5152 - RNA, 20 nt, Artificial Sequence
  targeting sequence with ATCN PAM
guuuggaucuuaaauccaac

SEQ ID NO: 5153 - RNA, 20 nt, Artificial Sequence
  targeting sequence with ATCN PAM
aaacagauuuuucacuguga

SEQ ID NO: 5154 - RNA, 20 nt, Artificial Sequence
  targeting sequence with ATCN PAM
uaaauccaacugcucaauag

SEQ ID NO: 5155 - RNA, 20 nt, Artificial Sequence
  targeting sequence with ATCN PAM
aacugcucaauagcaaacaa

SEQ ID NO: 5156 - RNA, 20 nt, Artificial Sequence
  targeting sequence with ATCN PAM
ggcaaaacuauaaagaaucu

SEQ ID NO: 5157 - RNA, 20 nt, Artificial Sequence
  targeting sequence with ATCN PAM
ccuuugcuuuaguauuuauc

SEQ ID NO: 5158 - RNA, 20 nt, Artificial Sequence
  targeting sequence with ATCN PAM
cuuagaaaauauguaucauu

SEQ ID NO: 5159 - RNA, 20 nt, Artificial Sequence
  targeting sequence with ATCN PAM
uuuauaagaucaacuaaaaa

SEQ ID NO: 5160 - RNA, 20 nt, Artificial Sequence
  targeting sequence with ATCN PAM
uauaaaugauacauauuuuc

SEQ ID NO: 5161 - RNA, 20 nt, Artificial Sequence
  targeting sequence with ATCN PAM
acuaaaaaauggcaagguca

SEQ ID NO: 5162 - RNA, 20 nt, Artificial Sequence
  targeting sequence with ATCN PAM
aacuauaggcuaaguuugua

SEQ ID NO: 5163 - RNA, 20 nt, Artificial Sequence
  targeting sequence with ATCN PAM
auaguccugaguacaaacuu

SEQ ID NO: 5164 - RNA, 20 nt, Artificial Sequence
  targeting sequence with ATCN PAM
agcuuuauucaacacaacca

SEQ ID NO: 5165 - RNA, 20 nt, Artificial Sequence
  targeting sequence with ATCN PAM
uccuccaauccaguuuuauc

SEQ ID NO: 5166 - RNA, 20 nt, Artificial Sequence
  targeting sequence with ATCN PAM
uccaauccaguuuuaucuca

SEQ ID NO: 5167 - RNA, 20 nt, Artificial Sequence
  targeting sequence with ATCN PAM
aguuuuaucucagagauuug

SEQ ID NO: 5168 - RNA, 20 nt, Artificial Sequence
  targeting sequence with ATCN PAM
cagagauuuguucugcugau

SEQ ID NO: 5169 - RNA, 20 nt, Artificial Sequence
  targeting sequence with ATCN PAM
cugagauaaaacuggauugg

SEQ ID NO: 5170 - RNA, 20 nt, Artificial Sequence
  targeting sequence with ATCN PAM
gcagaacaaaucucugagau

SEQ ID NO: 5171 - RNA, 20 nt, Artificial Sequence
  targeting sequence with ATCN PAM
ggagauacaaguuucacacu

SEQ ID NO: 5172 - RNA, 20 nt, Artificial Sequence
  targeting sequence with ATCN PAM
ccagaucagcagaacaaauc

SEQ ID NO: 5173 - RNA, 20 nt, Artificial Sequence
  targeting sequence with ATCN PAM
cagugugaaacuuguaucuc

SEQ ID NO: 5174 - RNA, 20 nt, Artificial Sequence
  targeting sequence with ATCN PAM
uuuucuuuuuuuuuuuuuuu

SEQ ID NO: 5175 - RNA, 20 nt, Artificial Sequence
  targeting sequence with ATCN PAM
agguggccaaaaaaaaaaaa

SEQ ID NO: 5176 - RNA, 20 nt, Artificial Sequence
  targeting sequence with ATCN PAM
aucaagaauuuuuuuuuuuu

SEQ ID NO: 5177 - RNA, 20 nt, Artificial Sequence
  targeting sequence with ATCN PAM
agaauuuuuuuuuuuuaauu

SEQ ID NO: 5178 - RNA, 20 nt, Artificial Sequence
  targeting sequence with ATCN PAM
aauuccuauuuguuaugcau

SEQ ID NO: 5179 - RNA, 20 nt, Artificial Sequence
  targeting sequence with ATCN PAM
ucgaauuuaacccauguuuu

SEQ ID NO: 5180 - RNA, 20 nt, Artificial Sequence
  targeting sequence with ATCN PAM
guguuucuuucaaugaacaa

SEQ ID NO: 5181 - RNA, 20 nt, Artificial Sequence
  targeting sequence with ATCN PAM
ucacuuucucaagcgaaaua

SEQ ID NO: 5182 - RNA, 20 nt, Artificial Sequence
  targeting sequence with ATCN PAM
uggagugucccgucucuugu

SEQ ID NO: 5183 - RNA, 20 nt, Artificial Sequence
  targeting sequence with ATCN PAM
uccuggagugucccgucucu

SEQ ID NO: 5184 - RNA, 20 nt, Artificial Sequence
  targeting sequence with ATCN PAM
gagcauguccauacagcuac

SEQ ID NO: 5185 - RNA, 20 nt, Artificial Sequence
  targeting sequence with ATCN PAM
cagccaggggcauuugcuau

SEQ ID NO: 5186 - RNA, 20 nt, Artificial Sequence
  targeting sequence with ATCN PAM
acugcugaaaaacgcuaagu

SEQ ID NO: 5187 - RNA, 20 nt, Artificial Sequence
  targeting sequence with ATCN PAM
uauaguuaguuaguccugca

SEQ ID NO: 5188 - RNA, 20 nt, Artificial Sequence
  targeting sequence with ATCN PAM
ugaauccuauaguuaguuag

SEQ ID NO: 5189 - RNA, 20 nt, Artificial Sequence
  targeting sequence with ATCN PAM
cauccugaauccuauaguua

SEQ ID NO: 5190 - RNA, 20 nt, Artificial Sequence
  targeting sequence with ATCN PAM
gucuuuuaaaaaaaaaaaaa

SEQ ID NO: 5191 - RNA, 20 nt, Artificial Sequence
  targeting sequence with ATCN PAM
gggagaaaccugaggguuau

SEQ ID NO: 5192 - RNA, 20 nt, Artificial Sequence
  targeting sequence with ATCN PAM
cuguaauaugaagcaagagg

SEQ ID NO: 5193 - RNA, 20 nt, Artificial Sequence
  targeting sequence with ATCN PAM
ucuugcuucauauuacagug

SEQ ID NO: 5194 - RNA, 20 nt, Artificial Sequence
  targeting sequence with ATCN PAM
cuuguuuuggaauugccauu

SEQ ID NO: 5195 - RNA, 20 nt, Artificial Sequence
  targeting sequence with ATCN PAM
auggugucacaugagauaau

SEQ ID NO: 5196 - RNA, 20 nt, Artificial Sequence
  targeting sequence with ATCN PAM
caugugacaccauagaucuc

SEQ ID NO: 5197 - RNA, 20 nt, Artificial Sequence
  targeting sequence with ATCN PAM
ucagcccaguuaagcaauaa

SEQ ID NO: 5198 - RNA, 20 nt, Artificial Sequence
  targeting sequence with ATCN PAM
caaacacaggcagcucaaaa

SEQ ID NO: 5199 - RNA, 20 nt, Artificial Sequence
  targeting sequence with ATCN PAM
ggaagaagaaaacuggaaga

SEQ ID NO: 5200 - RNA, 20 nt, Artificial Sequence
  targeting sequence with ATCN PAM
uuaguuaauuugaucuguau

SEQ ID NO: 5201 - RNA, 20 nt, Artificial Sequence
  targeting sequence with ATCN PAM
aauuaacuaaugauucuucc

SEQ ID NO: 5202 - RNA, 20 nt, Artificial Sequence
  targeting sequence with ATCN PAM
guaucauaaacaacauacug

SEQ ID NO: 5203 - RNA, 20 nt, Artificial Sequence
  targeting sequence with ATCN PAM
uaaacaacauacugauucug

SEQ ID NO: 5204 - RNA, 20 nt, Artificial Sequence
  targeting sequence with ATCN PAM
guauguuguuuaugauacag

SEQ ID NO: 5205 - RNA, 20 nt, Artificial Sequence
  targeting sequence with ATCN PAM
gaaucaguauguuguuuaug

SEQ ID NO: 5206 - RNA, 20 nt, Artificial Sequence
  targeting sequence with ATCN PAM
gaucuguuccugggcacuac

SEQ ID NO: 5207 - RNA, 20 nt, Artificial Sequence
  targeting sequence with ATCN PAM
gaucagaaucaguauguugu

SEQ ID NO: 5208 - RNA, 20 nt, Artificial Sequence
  targeting sequence with ATCN PAM
guuccugggcacuacgaccu

SEQ ID NO: 5209 - RNA, 20 nt, Artificial Sequence
  targeting sequence with ATCN PAM
auuaccaaaaauguauuucc

SEQ ID NO: 5210 - RNA, 20 nt, Artificial Sequence
  targeting sequence with ATCN PAM
ucauuucuuuuuaguucaag

SEQ ID NO: 5211 - RNA, 20 nt, Artificial Sequence
  targeting sequence with ATCN PAM
uuucuuuuuaguucaagaau

SEQ ID NO: 5212 - RNA, 20 nt, Artificial Sequence
  targeting sequence with ATCN PAM
ccauugucuuguguuuccug

SEQ ID NO: 5213 - RNA, 20 nt, Artificial Sequence
  targeting sequence with ATCN PAM
auaagaaguucuucaauagu

SEQ ID NO: 5214 - RNA, 20 nt, Artificial Sequence
  targeting sequence with ATCN PAM
cacugaacuauugaagaacu

SEQ ID NO: 5215 - RNA, 20 nt, Artificial Sequence
  targeting sequence with ATCN PAM
cuccuuaucccacugaacua

SEQ ID NO: 5216 - RNA, 20 nt, Artificial Sequence
  targeting sequence with ATCN PAM
ugaaaaguuuuuauuucuuu

SEQ ID NO: 5217 - RNA, 20 nt, Artificial Sequence
  targeting sequence with ATCN PAM
agucuuucaaaauuaccugc

SEQ ID NO: 5218 - RNA, 20 nt, Artificial Sequence
  targeting sequence with ATCN PAM
acuuugaacauugauuuuuu

SEQ ID NO: 5219 - RNA, 20 nt, Artificial Sequence
  targeting sequence with ATCN PAM
auguucaaaguagauuacuc

SEQ ID NO: 5220 - RNA, 20 nt, Artificial Sequence
  targeting sequence with ATCN PAM
aaggaaauuuugauucccua

SEQ ID NO: 5221 - RNA, 20 nt, Artificial Sequence
  targeting sequence with ATCN PAM
aaauuuccuuugauagugua

SEQ ID NO: 5222 - RNA, 20 nt, Artificial Sequence
  targeting sequence with ATCN PAM
uaaaacuagggaaucaaaau

SEQ ID NO: 5223 - RNA, 20 nt, Artificial Sequence
  targeting sequence with ATCN PAM
gaucuagaauccacauguac

SEQ ID NO: 5224 - RNA, 20 nt, Artificial Sequence
  targeting sequence with ATCN PAM
gauagggccacaacuacauc

SEQ ID NO: 5225 - RNA, 20 nt, Artificial Sequence
  targeting sequence with ATCN PAM
agaauccacauguacugauu

SEQ ID NO: 5226 - RNA, 20 nt, Artificial Sequence
  targeting sequence with ATCN PAM
acauguacugauucuccauu

SEQ ID NO: 5227 - RNA, 20 nt, Artificial Sequence
  targeting sequence with ATCN PAM
guacauguggauucuagauc

SEQ ID NO: 5228 - RNA, 20 nt, Artificial Sequence
  targeting sequence with ATCN PAM
uguuccuacuucaugcacug

SEQ ID NO: 5229 - RNA, 20 nt, Artificial Sequence
  targeting sequence with ATCN PAM
guuuuuuuaugucaccauug

SEQ ID NO: 5230 - RNA, 20 nt, Artificial Sequence
  targeting sequence with ATCN PAM
cugcaaagugaguacauugc

SEQ ID NO: 5231 - RNA, 20 nt, Artificial Sequence
  targeting sequence with ATCN PAM
uacaaacuuacccgcuccgc

SEQ ID NO: 5232 - RNA, 20 nt, Artificial Sequence
  targeting sequence with ATCN PAM
uagcagagcugguaggugca

SEQ ID NO: 5233 - RNA, 20 nt, Artificial Sequence
  targeting sequence with ATCN PAM
guuguggaugaagaccuggg

SEQ ID NO: 5234 - RNA, 20 nt, Artificial Sequence
  targeting sequence with ATCN PAM
acaacugaugcaccuaccag

SEQ ID NO: 5235 - RNA, 20 nt, Artificial Sequence
  targeting sequence with ATCN PAM
ccugaccagacuuccuguug

SEQ ID NO: 5236 - RNA, 20 nt, Artificial Sequence
  targeting sequence with ATCN PAM
acaggaagucuggucaggag

SEQ ID NO: 5237 - RNA, 20 nt, Artificial Sequence
  targeting sequence with ATCN PAM
uggguggcacucgaaucugc

SEQ ID NO: 5238 - RNA, 20 nt, Artificial Sequence
  targeting sequence with ATCN PAM
gcugcaggacacgauucaga

SEQ ID NO: 5239 - RNA, 20 nt, Artificial Sequence
  targeting sequence with ATCN PAM
uguccugcagcagauucgag

SEQ ID NO: 5240 - RNA, 20 nt, Artificial Sequence
  targeting sequence with ATCN PAM
aucucagcacaugcguucug

SEQ ID NO: 5241 - RNA, 20 nt, Artificial Sequence
  targeting sequence with ATCN PAM
cagcacaugcguucuggcuu

SEQ ID NO: 5242 - RNA, 20 nt, Artificial Sequence
  targeting sequence with ATCN PAM
ggaaagccagaacgcaugug

SEQ ID NO: 5243 - RNA, 20 nt, Artificial Sequence
  targeting sequence with ATCN PAM
auuucagguucuggaucugc

SEQ ID NO: 5244 - RNA, 20 nt, Artificial Sequence
  targeting sequence with ATCN PAM
agaaccugaaauggaucugg

SEQ ID NO: 5245 - RNA, 20 nt, Artificial Sequence
  targeting sequence with ATCN PAM
gccugaauuugcugcacauc

SEQ ID NO: 5246 - RNA, 20 nt, Artificial Sequence
  targeting sequence with ATCN PAM
uguggagacacugaugaccu

SEQ ID NO: 5247 - RNA, 20 nt, Artificial Sequence
  targeting sequence with ATCN PAM
gugucuccacaugaugugca

SEQ ID NO: 5248 - RNA, 20 nt, Artificial Sequence
  targeting sequence with ATCN PAM
cuuccagcaccagcgcagga

SEQ ID NO: 5249 - RNA, 20 nt, Artificial Sequence
  targeting sequence with ATCN PAM
cguuaauguucuccaaagca

SEQ ID NO: 5250 - RNA, 20 nt, Artificial Sequence
  targeting sequence with ATCN PAM
gaacaaaaauugucuaaaau

SEQ ID NO: 5251 - RNA, 20 nt, Artificial Sequence
  targeting sequence with ATCN PAM
ugggauuugccuccaggauc

SEQ ID NO: 5252 - RNA, 20 nt, Artificial Sequence
  targeting sequence with ATCN PAM
caagaugcagaggccagaaa

SEQ ID NO: 5253 - RNA, 20 nt, Artificial Sequence
  targeting sequence with ATCN PAM
uggaggcaaaucccaagaug

SEQ ID NO: 5254 - RNA, 20 nt, Artificial Sequence
  targeting sequence with ATCN PAM
ggguccucaaauaacuguuc

SEQ ID NO: 5255 - RNA, 20 nt, Artificial Sequence
  targeting sequence with ATCN PAM
guagacuuaauaugcuuauu

SEQ ID NO: 5256 - RNA, 20 nt, Artificial Sequence
  targeting sequence with ATCN PAM
aauguuaaaaacaaaaaaac

SEQ ID NO: 5257 - RNA, 20 nt, Artificial Sequence
  targeting sequence with ATCN PAM
aauagguuuacucuagcuga

SEQ ID NO: 5258 - RNA, 20 nt, Artificial Sequence
  targeting sequence with ATCN PAM
cucucauucauaaccacagu

SEQ ID NO: 5259 - RNA, 20 nt, Artificial Sequence
  targeting sequence with ATCN PAM
aagaacaacagugagaaaug

SEQ ID NO: 5260 - RNA, 20 nt, Artificial Sequence
  targeting sequence with ATCN PAM
auuucucacuguuguucuuu

SEQ ID NO: 5261 - RNA, 20 nt, Artificial Sequence
  targeting sequence with ATCN PAM
caaucuaacuauauguggau

SEQ ID NO: 5262 - RNA, 20 nt, Artificial Sequence
  targeting sequence with ATCN PAM
aacuauauguggauuuuaau

SEQ ID NO: 5263 - RNA, 20 nt, Artificial Sequence
  targeting sequence with ATCN PAM
acauauaguuagauugggau

SEQ ID NO: 5264 - RNA, 20 nt, Artificial Sequence
  targeting sequence with ATCN PAM
aguucacugguaacuagaga

SEQ ID NO: 5265 - RNA, 20 nt, Artificial Sequence
  targeting sequence with ATCN PAM
cuaguuaccagugaacuuga

SEQ ID NO: 5266 - RNA, 20 nt, Artificial Sequence
  targeting sequence with ATCN PAM
uguaaguugaauucucugcu

SEQ ID NO: 5267 - RNA, 20 nt, Artificial Sequence
  targeting sequence with ATCN PAM
gaaucagagacuagagcuuu

SEQ ID NO: 5268 - RNA, 20 nt, Artificial Sequence
  targeting sequence with ATCN PAM
gagacuagagcuuugcucag

SEQ ID NO: 5269 - RNA, 20 nt, Artificial Sequence
  targeting sequence with ATCN PAM
agaaaggagauucaaagaaa

SEQ ID NO: 5270 - RNA, 20 nt, Artificial Sequence
  targeting sequence with ATCN PAM
ccuuucuugauagcugguac

SEQ ID NO: 5271 - RNA, 20 nt, Artificial Sequence
  targeting sequence with ATCN PAM
cuuucucuauagugucaucc

SEQ ID NO: 5272 - RNA, 20 nt, Artificial Sequence
  targeting sequence with ATCN PAM
cugacagaagcuucccauau

SEQ ID NO: 5273 - RNA, 20 nt, Artificial Sequence
  targeting sequence with ATCN PAM
auacaaacucaaaagcaaag

SEQ ID NO: 5274 - RNA, 20 nt, Artificial Sequence
  targeting sequence with ATCN PAM
uacccaguuacuuugcuuuu

SEQ ID NO: 5275 - RNA, 20 nt, Artificial Sequence
  targeting sequence with ATCN PAM
cuuaguuucagcuuccuuuu

SEQ ID NO: 5276 - RNA, 20 nt, Artificial Sequence
  targeting sequence with ATCN PAM
acgcaacugccaugguuacu

SEQ ID NO: 5277 - RNA, 20 nt, Artificial Sequence
  targeting sequence with ATCN PAM
caugcaaaaaaaaaaaaaaa

SEQ ID NO: 5278 - RNA, 20 nt, Artificial Sequence
  targeting sequence with ATCN PAM
cccccucccuuuuuuuuuuu

SEQ ID NO: 5279 - RNA, 20 nt, Artificial Sequence
  targeting sequence with ATCN PAM
cccaucccccccucccuuuu

SEQ ID NO: 5280 - RNA, 20 nt, Artificial Sequence
  targeting sequence with ATCN PAM
ucucccaucccccccucccu

SEQ ID NO: 5281 - RNA, 20 nt, Artificial Sequence
  targeting sequence with ATCN PAM
caucaucucccauccccccc

SEQ ID NO: 5282 - RNA, 20 nt, Artificial Sequence
  targeting sequence with ATCN PAM
uauuuugcauucuguagcag

SEQ ID NO: 5283 - RNA, 20 nt, Artificial Sequence
  targeting sequence with ATCN PAM
agaaagccauaaauuagcug

SEQ ID NO: 5284 - RNA, 20 nt, Artificial Sequence
  targeting sequence with ATCN PAM
ggaacaaaacuuuagugagu

SEQ ID NO: 5285 - RNA, 20 nt, Artificial Sequence
  targeting sequence with ATCN PAM
caggcaugaaagaauaugga

SEQ ID NO: 5286 - RNA, 20 nt, Artificial Sequence
  targeting sequence with ATCN PAM
cuucauaacagaggagcaua

SEQ ID NO: 5287 - RNA, 20 nt, Artificial Sequence
  targeting sequence with ATCN PAM
cugucucccuguuuaugcuc

SEQ ID NO: 5288 - RNA, 20 nt, Artificial Sequence
  targeting sequence with ATCN PAM
agccaucccacuauggccug

SEQ ID NO: 5289 - RNA, 20 nt, Artificial Sequence
  targeting sequence with ATCN PAM
cacuauggccuguuacccuu

SEQ ID NO: 5290 - RNA, 20 nt, Artificial Sequence
  targeting sequence with ATCN PAM
ggaaaaggguaacaggccau

SEQ ID NO: 5291 - RNA, 20 nt, Artificial Sequence
  targeting sequence with ATCN PAM
uucccuuugggagaaccaag

SEQ ID NO: 5292 - RNA, 20 nt, Artificial Sequence
  targeting sequence with ATCN PAM
aauaagggcaaggguuucuu

SEQ ID NO: 5293 - RNA, 20 nt, Artificial Sequence
  targeting sequence with ATCN PAM
augacugucuuggccucugg

SEQ ID NO: 5294 - RNA, 20 nt, Artificial Sequence
  targeting sequence with ATCN PAM
ccuucuaaccaaauaugaaa

SEQ ID NO: 5295 - RNA, 20 nt, Artificial Sequence
  targeting sequence with ATCN PAM
gaguaacauuguauuaugug

SEQ ID NO: 5296 - RNA, 20 nt, Artificial Sequence
  targeting sequence with ATCN PAM
caccauuccucaugaguuug

SEQ ID NO: 5297 - RNA, 20 nt, Artificial Sequence
  targeting sequence with ATCN PAM
ccuaucaguguguaucaacu

SEQ ID NO: 5298 - RNA, 20 nt, Artificial Sequence
  targeting sequence with ATCN PAM
guguguaucaacucaucucu

SEQ ID NO: 5299 - RNA, 20 nt, Artificial Sequence
  targeting sequence with ATCN PAM
acucaucucuucuugcacug

SEQ ID NO: 5300 - RNA, 20 nt, Artificial Sequence
  targeting sequence with ATCN PAM
cuucuugcacugggcuauuu

SEQ ID NO: 5301 - RNA, 20 nt, Artificial Sequence
  targeting sequence with ATCN PAM
aaauagcccagugcaagaag

SEQ ID NO: 5302 - RNA, 20 nt, Artificial Sequence
  targeting sequence with ATCN PAM
ugagaagaugggagggugug

SEQ ID NO: 5303 - RNA, 20 nt, Artificial Sequence
  targeting sequence with ATCN PAM
ucucaggaucuaaauagccc

SEQ ID NO: 5304 - RNA, 20 nt, Artificial Sequence
  targeting sequence with ATCN PAM
guuguauuagcuaauaaugu

SEQ ID NO: 5305 - RNA, 20 nt, Artificial Sequence
  targeting sequence with ATCN PAM
caugagauuaaaagacagca

SEQ ID NO: 5306 - RNA, 20 nt, Artificial Sequence
  targeting sequence with ATCN PAM
caugggauaaacauauuuua

SEQ ID NO: 5307 - RNA, 20 nt, Artificial Sequence
  targeting sequence with ATCN PAM
uuccuuuauucuugcugucu

SEQ ID NO: 5308 - RNA, 20 nt, Artificial Sequence
  targeting sequence with ATCN PAM
ucagcuaaccuugacaucau

SEQ ID NO: 5309 - RNA, 20 nt, Artificial Sequence
  targeting sequence with ATCN PAM
uucuacuugucucauaugca

SEQ ID NO: 5310 - RNA, 20 nt, Artificial Sequence
  targeting sequence with ATCN PAM
acuuauuugggcacuauuau

SEQ ID NO: 5311 - RNA, 20 nt, Artificial Sequence
  targeting sequence with ATCN PAM
acuggucaucugguugcugc

SEQ ID NO: 5312 - RNA, 20 nt, Artificial Sequence
  targeting sequence with ATCN PAM
gguugcugccuauuuaaaaa

SEQ ID NO: 5313 - RNA, 20 nt, Artificial Sequence
  targeting sequence with ATCN PAM
gauuuucaaaggcaaaacuu

SEQ ID NO: 5314 - RNA, 20 nt, Artificial Sequence
  targeting sequence with ATCN PAM
gauaauuuauuacuguuuug

SEQ ID NO: 5315 - RNA, 20 nt, Artificial Sequence
  targeting sequence with ATCN PAM
uaccagcacauagccucacu

SEQ ID NO: 5316 - RNA, 20 nt, Artificial Sequence
  targeting sequence with ATCN PAM
aguuuuaagguaauaauuuu

SEQ ID NO: 5317 - RNA, 20 nt, Artificial Sequence
  targeting sequence with ATCN PAM
acuguacugauuauaaaacg

SEQ ID NO: 5318 - RNA, 20 nt, Artificial Sequence
  targeting sequence with ATCN PAM
guacaguagauuguuuuuca

SEQ ID NO: 5319 - RNA, 20 nt, Artificial Sequence
  targeting sequence with ATCN PAM
ucugcauaauagcagcacua

SEQ ID NO: 5320 - RNA, 20 nt, Artificial Sequence
  targeting sequence with ATCN PAM
gcauaauagcagcacuaaga

SEQ ID NO: 5321 - RNA, 20 nt, Artificial Sequence
  targeting sequence with ATCN PAM
uuaaggccaccaaagucaaa

SEQ ID NO: 5322 - RNA, 20 nt, Artificial Sequence
  targeting sequence with ATCN PAM
cuauuguugguauuuuugcc

SEQ ID NO: 5323 - RNA, 20 nt, Artificial Sequence
  targeting sequence with ATCN PAM
cagcucacugcaaccucugc

SEQ ID NO: 5324 - RNA, 20 nt, Artificial Sequence
  targeting sequence with ATCN PAM
cagcuacuugagaggcagag

SEQ ID NO: 5325 - RNA, 20 nt, Artificial Sequence
  targeting sequence with ATCN PAM
cuugaggucaggaguucgag

SEQ ID NO: 5326 - RNA, 20 nt, Artificial Sequence
  targeting sequence with ATCN PAM
acccuccucagccucccaaa

SEQ ID NO: 5327 - RNA, 20 nt, Artificial Sequence
  targeting sequence with ATCN PAM
uagcacuuugggaggcugag

SEQ ID NO: 5328 - RNA, 20 nt, Artificial Sequence
  targeting sequence with ATCN PAM
aaaauuaguuaguugggugg

SEQ ID NO: 5329 - RNA, 20 nt, Artificial Sequence
  targeting sequence with ATCN PAM
cugguuuaacacaaacgagu

SEQ ID NO: 5330 - RNA, 20 nt, Artificial Sequence
  targeting sequence with ATCN PAM
aaugcuuuuugguaagaagg

SEQ ID NO: 5331 - RNA, 20 nt, Artificial Sequence
  targeting sequence with ATCN PAM
gaaauaagugaaaaaauuau

SEQ ID NO: 5332 - RNA, 20 nt, Artificial Sequence
  targeting sequence with ATCN PAM
aucaaccauuuaggagggua

SEQ ID NO: 5333 - RNA, 20 nt, Artificial Sequence
  targeting sequence with ATCN PAM
accauuuaggaggguauucc

SEQ ID NO: 5334 - RNA, 20 nt, Artificial Sequence
  targeting sequence with ATCN PAM
cagcaaauuauauacaaauu

SEQ ID NO: 5335 - RNA, 20 nt, Artificial Sequence
  targeting sequence with ATCN PAM
aaaaacuaaaaaauuggaaa

SEQ ID NO: 5336 - RNA, 20 nt, Artificial Sequence
  targeting sequence with ATCN PAM
aacucuuuguagucagugaa

SEQ ID NO: 5337 - RNA, 20 nt, Artificial Sequence
  targeting sequence with ATCN PAM
cucuuccuuaagcacuucua

SEQ ID NO: 5338 - RNA, 20 nt, Artificial Sequence
  targeting sequence with ATCN PAM
uuuuaggaaaagcugaaaag

SEQ ID NO: 5339 - RNA, 20 nt, Artificial Sequence
  targeting sequence with ATCN PAM
aaguuucucaccuuguaauu

SEQ ID NO: 5340 - RNA, 20 nt, Artificial Sequence
  targeting sequence with ATCN PAM
guaaaagguaaguuucccca

SEQ ID NO: 5341 - RNA, 20 nt, Artificial Sequence
  targeting sequence with ATCN PAM
aacaaaauguuaauagcccu

SEQ ID NO: 5342 - RNA, 20 nt, Artificial Sequence
  targeting sequence with ATCN PAM
cucacugguagaaguagggu

SEQ ID NO: 5343 - RNA, 20 nt, Artificial Sequence
  targeting sequence with ATCN PAM
agaauaauuauaaucaagaa

SEQ ID NO: 5344 - RNA, 20 nt, Artificial Sequence
  targeting sequence with ATCN PAM
guaucugccauucucuauuc

SEQ ID NO: 5345 - RNA, 20 nt, Artificial Sequence
  targeting sequence with ATCN PAM
gccauucucuauucaaaggc

SEQ ID NO: 5346 - RNA, 20 nt, Artificial Sequence
  targeting sequence with ATCN PAM
uaucuuaggccaggcaugau

SEQ ID NO: 5347 - RNA, 20 nt, Artificial Sequence
  targeting sequence with ATCN PAM
uaggccaggcaugauggcuc

SEQ ID NO: 5348 - RNA, 20 nt, Artificial Sequence
  targeting sequence with ATCN PAM
ugccuggccuaagauaggau

SEQ ID NO: 5349 - RNA, 20 nt, Artificial Sequence
  targeting sequence with ATCN PAM
cagcacuccgaggcaggaag

SEQ ID NO: 5350 - RNA, 20 nt, Artificial Sequence
  targeting sequence with ATCN PAM
uccugccucggagugcuggg

SEQ ID NO: 5351 - RNA, 20 nt, Artificial Sequence
  targeting sequence with ATCN PAM
ucugagcccaggaauuugag

SEQ ID NO: 5352 - RNA, 20 nt, Artificial Sequence
  targeting sequence with ATCN PAM
gagcccaggaauuugagauc

SEQ ID NO: 5353 - RNA, 20 nt, Artificial Sequence
  targeting sequence with ATCN PAM
caaauuccugggcucagaug

SEQ ID NO: 5354 - RNA, 20 nt, Artificial Sequence
  targeting sequence with ATCN PAM
gccugggcaacagugacacc

SEQ ID NO: 5355 - RNA, 20 nt, Artificial Sequence
  targeting sequence with ATCN PAM
cuaaaacaauuuuuaaagau

SEQ ID NO: 5356 - RNA, 20 nt, Artificial Sequence
  targeting sequence with ATCN PAM
uuaaaaauuguuuuagagau

SEQ ID NO: 5357 - RNA, 20 nt, Artificial Sequence
  targeting sequence with ATCN PAM
aggacagaaaauaagauguc

SEQ ID NO: 5358 - RNA, 20 nt, Artificial Sequence
  targeting sequence with ATCN PAM
uauuuucuguccuagauuaa

SEQ ID NO: 5359 - RNA, 20 nt, Artificial Sequence
  targeting sequence with ATCN PAM
uccugacuuuuaaugguaau

SEQ ID NO: 5360 - RNA, 20 nt, Artificial Sequence
  targeting sequence with ATCN PAM
guuagaauuggauuuguuug

SEQ ID NO: 5361 - RNA, 20 nt, Artificial Sequence
  targeting sequence with ATCN PAM
aauucuaacugaucuuccug

SEQ ID NO: 5362 - RNA, 20 nt, Artificial Sequence
  targeting sequence with ATCN PAM
ggcuuucccaaacaaaucca

SEQ ID NO: 5363 - RNA, 20 nt, Artificial Sequence
  targeting sequence with ATCN PAM
uucagagcucaguaaaagcu

SEQ ID NO: 5364 - RNA, 20 nt, Artificial Sequence
  targeting sequence with ATCN PAM
auugucucauccuucagagc

SEQ ID NO: 5365 - RNA, 20 nt, Artificial Sequence
  targeting sequence with ATCN PAM
uucugcuuauuuauccauug

SEQ ID NO: 5366 - RNA, 20 nt, Artificial Sequence
  targeting sequence with ATCN PAM
uuaggccuaaaacaugucuu

SEQ ID NO: 5367 - RNA, 20 nt, Artificial Sequence
  targeting sequence with ATCN PAM
uguaagaugcaugagaggag

SEQ ID NO: 5368 - RNA, 20 nt, Artificial Sequence
  targeting sequence with ATCN PAM
uacaugaucauuaggccuaa

SEQ ID NO: 5369 - RNA, 20 nt, Artificial Sequence
  targeting sequence with ATCN PAM
uucccuccucucaugcaucu

SEQ ID NO: 5370 - RNA, 20 nt, Artificial Sequence
  targeting sequence with ATCN PAM
ucuuucccuccucucaugca

SEQ ID NO: 5371 - RNA, 20 nt, Artificial Sequence
  targeting sequence with ATCN PAM
gagaaauuagguaaggaacu

SEQ ID NO: 5372 - RNA, 20 nt, Artificial Sequence
  targeting sequence with ATCN PAM
uuuucuaaauuauaaguucc

SEQ ID NO: 5373 - RNA, 20 nt, Artificial Sequence
  targeting sequence with ATCN PAM
gucgcaaugguaugaggaau

SEQ ID NO: 5374 - RNA, 20 nt, Artificial Sequence
  targeting sequence with ATCN PAM
gauaaaaugaguauuuauag

SEQ ID NO: 5375 - RNA, 20 nt, Artificial Sequence
  targeting sequence with ATCN PAM
gaugcuuuuuuagcaucugu

SEQ ID NO: 5376 - RNA, 20 nt, Artificial Sequence
  targeting sequence with ATCN PAM
uccaauucauccuccugcau

SEQ ID NO: 5377 - RNA, 20 nt, Artificial Sequence
  targeting sequence with ATCN PAM
aauucauccuccugcaucuu

SEQ ID NO: 5378 - RNA, 20 nt, Artificial Sequence
  targeting sequence with ATCN PAM
uccugcaucuuauuucaaca

SEQ ID NO: 5379 - RNA, 20 nt, Artificial Sequence
  targeting sequence with ATCN PAM
uauuucaacaauuaaauguc

SEQ ID NO: 5380 - RNA, 20 nt, Artificial Sequence
  targeting sequence with ATCN PAM
auacuucauuuagccccaaa

SEQ ID NO: 5381 - RNA, 20 nt, Artificial Sequence
  targeting sequence with ATCN PAM
auuucuuuggggcuaaauga

SEQ ID NO: 5382 - RNA, 20 nt, Artificial Sequence
  targeting sequence with ATCN PAM
uaugggcucccucuagacgg

SEQ ID NO: 5383 - RNA, 20 nt, Artificial Sequence
  targeting sequence with ATCN PAM
agccuugguaagaugucucu

SEQ ID NO: 5384 - RNA, 20 nt, Artificial Sequence
  targeting sequence with ATCN PAM
uaccaaggcuggaugcaagg

SEQ ID NO: 5385 - RNA, 20 nt, Artificial Sequence
  targeting sequence with ATCN PAM
aauaauugcaaaauauacuc

SEQ ID NO: 5386 - RNA, 20 nt, Artificial Sequence
  targeting sequence with ATCN PAM
cuuucugcuugaaagaguau

SEQ ID NO: 5387 - RNA, 20 nt, Artificial Sequence
  targeting sequence with ATCN PAM
uuuacaaaaauugaccauau

SEQ ID NO: 5388 - RNA, 20 nt, Artificial Sequence
  targeting sequence with ATCN PAM
acauuguggucagagaauau

SEQ ID NO: 5389 - RNA, 20 nt, Artificial Sequence
  targeting sequence with ATCN PAM
cuuuuuccuuuuuuguuuac

SEQ ID NO: 5390 - RNA, 20 nt, Artificial Sequence
  targeting sequence with ATCN PAM
cagccuccaggcaauacaac

SEQ ID NO: 5391 - RNA, 20 nt, Artificial Sequence
  targeting sequence with ATCN PAM
cagugcagauaggaagauua

SEQ ID NO: 5392 - RNA, 20 nt, Artificial Sequence
  targeting sequence with ATCN PAM
gcacugggauucuuccaugc

SEQ ID NO: 5393 - RNA, 20 nt, Artificial Sequence
  targeting sequence with ATCN PAM
uccuaucugcacugggauuc

SEQ ID NO: 5394 - RNA, 20 nt, Artificial Sequence
  targeting sequence with ATCN PAM
gagugugaaguccucgaggg

SEQ ID NO: 5395 - RNA, 20 nt, Artificial Sequence
  targeting sequence with ATCN PAM
uaggagaguucccauccucu

SEQ ID NO: 5396 - RNA, 20 nt, Artificial Sequence
  targeting sequence with ATCN PAM
ucuugugggcuuuuccucca

SEQ ID NO: 5397 - RNA, 20 nt, Artificial Sequence
  targeting sequence with ATCN PAM
ccacccccguggagcuaaug

SEQ ID NO: 5398 - RNA, 20 nt, Artificial Sequence
  targeting sequence with ATCN PAM
cccuguggaacaaaaggcuu

SEQ ID NO: 5399 - RNA, 20 nt, Artificial Sequence
  targeting sequence with ATCN PAM
gcaaggagcaauuucuggug

SEQ ID NO: 5400 - RNA, 20 nt, Artificial Sequence
  targeting sequence with ATCN PAM
cacuacagcuggaggaagga

SEQ ID NO: 5401 - RNA, 20 nt, Artificial Sequence
  targeting sequence with ATCN PAM
aucuucacuguuucucuaaa

SEQ ID NO: 5402 - RNA, 20 nt, Artificial Sequence
  targeting sequence with ATCN PAM
ucacuguuucucuaaaacag

SEQ ID NO: 5403 - RNA, 20 nt, Artificial Sequence
  targeting sequence with ATCN PAM
ucaagcuaagguuuuuuuca

SEQ ID NO: 5404 - RNA, 20 nt, Artificial Sequence
  targeting sequence with ATCN PAM
ccauagcaguugggaaaaag

SEQ ID NO: 5405 - RNA, 20 nt, Artificial Sequence
  targeting sequence with ATCN PAM
gcauaaaucugaggcuuaac

SEQ ID NO: 5406 - RNA, 20 nt, Artificial Sequence
  targeting sequence with ATCN PAM
gaggcuuaaccagaacauca

SEQ ID NO: 5407 - RNA, 20 nt, Artificial Sequence
  targeting sequence with ATCN PAM
cagaacuccccucacccucc

SEQ ID NO: 5408 - RNA, 20 nt, Artificial Sequence
  targeting sequence with ATCN PAM
aacacagcccaaugccugaa

SEQ ID NO: 5409 - RNA, 20 nt, Artificial Sequence
  targeting sequence with ATCN PAM
guucaggcauugggcugugu

SEQ ID NO: 5410 - RNA, 20 nt, Artificial Sequence
  targeting sequence with ATCN PAM
ccacccuaaaggacuugcag

SEQ ID NO: 5411 - RNA, 20 nt, Artificial Sequence
  targeting sequence with ATCN PAM
agcauauaccucaguaucuc

SEQ ID NO: 5412 - RNA, 20 nt, Artificial Sequence
  targeting sequence with ATCN PAM
ccugucauauacagcacauu

SEQ ID NO: 5413 - RNA, 20 nt, Artificial Sequence
  targeting sequence with ATCN PAM
gagccagacccacguaugac

SEQ ID NO: 5414 - RNA, 20 nt, Artificial Sequence
  targeting sequence with ATCN PAM
cguucuaauuuacugucuug

SEQ ID NO: 5415 - RNA, 20 nt, Artificial Sequence
  targeting sequence with ATCN PAM
cauauguugucuaccucuuu

SEQ ID NO: 5416 - RNA, 20 nt, Artificial Sequence
  targeting sequence with ATCN PAM
gacagguaauuucagagaua

SEQ ID NO: 5417 - RNA, 20 nt, Artificial Sequence
  targeting sequence with ATCN PAM
cugaaauuaccugucugauc

SEQ ID NO: 5418 - RNA, 20 nt, Artificial Sequence
  targeting sequence with ATCN PAM
aguggaaaccaaauuagaaa

SEQ ID NO: 5419 - RNA, 20 nt, Artificial Sequence
  targeting sequence with ATCN PAM
aguagacuugaaacagcuga

SEQ ID NO: 5420 - RNA, 20 nt, Artificial Sequence
  targeting sequence with ATCN PAM
guaaacuugaaaauaggcua

SEQ ID NO: 5421 - RNA, 20 nt, Artificial Sequence
  targeting sequence with ATCN PAM
cuuuucucuuuauauuucag

SEQ ID NO: 5422 - RNA, 20 nt, Artificial Sequence
  targeting sequence with ATCN PAM
cuaauuucgguaaguucuug

SEQ ID NO: 5423 - RNA, 20 nt, Artificial Sequence
  targeting sequence with ATCN PAM
cagcacuuuggaaggcugag

SEQ ID NO: 5424 - RNA, 20 nt, Artificial Sequence
  targeting sequence with ATCN PAM
ucccgccucagccuuccaaa

SEQ ID NO: 5425 - RNA, 20 nt, Artificial Sequence
  targeting sequence with ATCN PAM
cuaaaaauaaacaaaaaaau

SEQ ID NO: 5426 - RNA, 20 nt, Artificial Sequence
  targeting sequence with ATCN PAM
gccgggaaugauggcacaug

SEQ ID NO: 5427 - RNA, 20 nt, Artificial Sequence
  targeting sequence with ATCN PAM
uucccggcugauuuuuuugu

SEQ ID NO: 5428 - RNA, 20 nt, Artificial Sequence
  targeting sequence with ATCN PAM
aggcuggaaugcagugggac

SEQ ID NO: 5429 - RNA, 20 nt, Artificial Sequence
  targeting sequence with ATCN PAM
cugcacuucaaccugggcaa

SEQ ID NO: 5430 - RNA, 20 nt, Artificial Sequence
  targeting sequence with ATCN PAM
aacaucaugugacauaugug

SEQ ID NO: 5431 - RNA, 20 nt, Artificial Sequence
  targeting sequence with ATCN PAM
ugugacauaugugggggcaa

SEQ ID NO: 5432 - RNA, 20 nt, Artificial Sequence
  targeting sequence with ATCN PAM
cagcacuuugggaggccaag

SEQ ID NO: 5433 - RNA, 20 nt, Artificial Sequence
  targeting sequence with ATCN PAM
gccugccuuggccucccaaa

SEQ ID NO: 5434 - RNA, 20 nt, Artificial Sequence
  targeting sequence with ATCN PAM
cuuuagcugggcauaguggc

SEQ ID NO: 5435 - RNA, 20 nt, Artificial Sequence
  targeting sequence with ATCN PAM
ucccaccucagccuccugag

SEQ ID NO: 5436 - RNA, 20 nt, Artificial Sequence
  targeting sequence with ATCN PAM
acugaacccaagagauagag

SEQ ID NO: 5437 - RNA, 20 nt, Artificial Sequence
  targeting sequence with ATCN PAM
cuuggguucaguggauccuc

SEQ ID NO: 5438 - RNA, 20 nt, Artificial Sequence
  targeting sequence with ATCN PAM
cacuacuuauagaagugaaa

SEQ ID NO: 5439 - RNA, 20 nt, Artificial Sequence
  targeting sequence with ATCN PAM
gaaaaacauggcuaagguuu

SEQ ID NO: 5440 - RNA, 20 nt, Artificial Sequence
  targeting sequence with ATCN PAM
cccauuuaugcuuucuccuu

SEQ ID NO: 5441 - RNA, 20 nt, Artificial Sequence
  targeting sequence with ATCN PAM
caaauucccuuaguaggugg

SEQ ID NO: 5442 - RNA, 20 nt, Artificial Sequence
  targeting sequence with ATCN PAM
uuuaccaaccagucauucac

SEQ ID NO: 5443 - RNA, 20 nt, Artificial Sequence
  targeting sequence with ATCN PAM
uucucuugaccuccugguuu

SEQ ID NO: 5444 - RNA, 20 nt, Artificial Sequence
  targeting sequence with ATCN PAM
aaaaauaacuuuuccugucc

SEQ ID NO: 5445 - RNA, 20 nt, Artificial Sequence
  targeting sequence with ATCN PAM
uggaguuaggugaaacaggu

SEQ ID NO: 5446 - RNA, 20 nt, Artificial Sequence
  targeting sequence with ATCN PAM
ugauccuuccaacuguccuc

SEQ ID NO: 5447 - RNA, 20 nt, Artificial Sequence
  targeting sequence with ATCN PAM
ugaugucguaaucuuggagu

SEQ ID NO: 5448 - RNA, 20 nt, Artificial Sequence
  targeting sequence with ATCN PAM
uuccaacuguccucaccuac

SEQ ID NO: 5449 - RNA, 20 nt, Artificial Sequence
  targeting sequence with ATCN PAM
uuguccaauucauccuaccu

SEQ ID NO: 5450 - RNA, 20 nt, Artificial Sequence
  targeting sequence with ATCN PAM
uaccuaugaguuaaaaaaaa

SEQ ID NO: 5451 - RNA, 20 nt, Artificial Sequence
  targeting sequence with ATCN PAM
uaaaaugaccuuacucaaaa

SEQ ID NO: 5452 - RNA, 20 nt, Artificial Sequence
  targeting sequence with ATCN PAM
uacauuuguguuucuguguu

SEQ ID NO: 5453 - RNA, 20 nt, Artificial Sequence
  targeting sequence with ATCN PAM
ccaugcuuucauccauguua

SEQ ID NO: 5454 - RNA, 20 nt, Artificial Sequence
  targeting sequence with ATCN PAM
auguuauuuuucauacuugc

SEQ ID NO: 5455 - RNA, 20 nt, Artificial Sequence
  targeting sequence with ATCN PAM
uugcaaguaugaaaaauaac

SEQ ID NO: 5456 - RNA, 20 nt, Artificial Sequence
  targeting sequence with ATCN PAM
guguucucuauuuguaaugu

SEQ ID NO: 5457 - RNA, 20 nt, Artificial Sequence
  targeting sequence with ATCN PAM
aauccuccuguaaucgcuuc

SEQ ID NO: 5458 - RNA, 20 nt, Artificial Sequence
  targeting sequence with ATCN PAM
uccuguaaucgcuucaacag

SEQ ID NO: 5459 - RNA, 20 nt, Artificial Sequence
  targeting sequence with ATCN PAM
cuucaacagucaccuauucu

SEQ ID NO: 5460 - RNA, 20 nt, Artificial Sequence
  targeting sequence with ATCN PAM
aaucuaaauuccuuaacaau

SEQ ID NO: 5461 - RNA, 20 nt, Artificial Sequence
  targeting sequence with ATCN PAM
aaauuccuuaacaauaccau

SEQ ID NO: 5462 - RNA, 20 nt, Artificial Sequence
  targeting sequence with ATCN PAM
cugaauuagcauuuauugaa

SEQ ID NO: 5463 - RNA, 20 nt, Artificial Sequence
  targeting sequence with ATCN PAM
gucucuaaauuaaaaaauua

SEQ ID NO: 5464 - RNA, 20 nt, Artificial Sequence
  targeting sequence with ATCN PAM
aguccuaaccuggugugggu

SEQ ID NO: 5465 - RNA, 20 nt, Artificial Sequence
  targeting sequence with ATCN PAM
aauguaacucuaccagagua

SEQ ID NO: 5466 - RNA, 20 nt, Artificial Sequence
  targeting sequence with ATCN PAM
uaucuggugacugcauuggc

SEQ ID NO: 5467 - RNA, 20 nt, Artificial Sequence
  targeting sequence with ATCN PAM
ggugacugcauuggcuuauu

SEQ ID NO: 5468 - RNA, 20 nt, Artificial Sequence
  targeting sequence with ATCN PAM
cuugucuuguagcucugacu

SEQ ID NO: 5469 - RNA, 20 nt, Artificial Sequence
  targeting sequence with ATCN PAM
uuagaaucacuugucuugua

SEQ ID NO: 5470 - RNA, 20 nt, Artificial Sequence
  targeting sequence with ATCN PAM
gucgucaucuuuagaaucac

SEQ ID NO: 5471 - RNA, 20 nt, Artificial Sequence
  targeting sequence with ATCN PAM
gugugaccuagagucuucau

SEQ ID NO: 5472 - RNA, 20 nt, Artificial Sequence
  targeting sequence with ATCN PAM
agauacuucccauagauguu

SEQ ID NO: 5473 - RNA, 20 nt, Artificial Sequence
  targeting sequence with ATCN PAM
ugauguacaagaauggguac

SEQ ID NO: 5474 - RNA, 20 nt, Artificial Sequence
  targeting sequence with ATCN PAM
augggaaguaucuugaugua

SEQ ID NO: 5475 - RNA, 20 nt, Artificial Sequence
  targeting sequence with ATCN PAM
cuguguuacaagaagacaac

SEQ ID NO: 5476 - RNA, 20 nt, Artificial Sequence
  targeting sequence with ATCN PAM
cuaacaaauacauuaaaaca

SEQ ID NO: 5477 - RNA, 20 nt, Artificial Sequence
  targeting sequence with ATCN PAM
cuuuauugguaaacaauagu

SEQ ID NO: 5478 - RNA, 20 nt, Artificial Sequence
  targeting sequence with ATCN PAM
guuuuugucacaucacaugc

SEQ ID NO: 5479 - RNA, 20 nt, Artificial Sequence
  targeting sequence with ATCN PAM
caugcagagccaucugagaa

SEQ ID NO: 5480 - RNA, 20 nt, Artificial Sequence
  targeting sequence with ATCN PAM
gagaauaaaugucuaagcaa

SEQ ID NO: 5481 - RNA, 20 nt, Artificial Sequence
  targeting sequence with ATCN PAM
aauuccaguauuguuucuuu

SEQ ID NO: 5482 - RNA, 20 nt, Artificial Sequence
  targeting sequence with ATCN PAM
ugcccagcuaauuuuuguau

SEQ ID NO: 5483 - RNA, 20 nt, Artificial Sequence
  targeting sequence with ATCN PAM
cuugaggucaggaguccgag

SEQ ID NO: 5484 - RNA, 20 nt, Artificial Sequence
  targeting sequence with ATCN PAM
acccaccuuggccuuccaaa

SEQ ID NO: 5485 - RNA, 20 nt, Artificial Sequence
  targeting sequence with ATCN PAM
uagcacuuuggaaggccaag

SEQ ID NO: 5486 - RNA, 20 nt, Artificial Sequence
  targeting sequence with ATCN PAM
aaggaucucaaaacaaaugu

SEQ ID NO: 5487 - RNA, 20 nt, Artificial Sequence
  targeting sequence with ATCN PAM
uuugaugaaagguuccauug

SEQ ID NO: 5488 - RNA, 20 nt, Artificial Sequence
  targeting sequence with ATCN PAM
caaaacaaauguuacugaca

SEQ ID NO: 5489 - RNA, 20 nt, Artificial Sequence
  targeting sequence with ATCN PAM
aauuggugacccuauggcua

SEQ ID NO: 5490 - RNA, 20 nt, Artificial Sequence
  targeting sequence with ATCN PAM
augaccuaaggaauucaaua

SEQ ID NO: 5491 - RNA, 20 nt, Artificial Sequence
  targeting sequence with ATCN PAM
guauugaauuccuuagguca

SEQ ID NO: 5492 - RNA, 20 nt, Artificial Sequence
  targeting sequence with ATCN PAM
aguuuuauguauaguagugu

SEQ ID NO: 5493 - RNA, 20 nt, Artificial Sequence
  targeting sequence with ATCN PAM
aggacaaagaccaaauaugu

SEQ ID NO: 5494 - RNA, 20 nt, Artificial Sequence
  targeting sequence with ATCN PAM
agaggcccaccaagagucac

SEQ ID NO: 5495 - RNA, 20 nt, Artificial Sequence
  targeting sequence with ATCN PAM
ugaagcuaucuagaggccca

SEQ ID NO: 5496 - RNA, 20 nt, Artificial Sequence
  targeting sequence with ATCN PAM
cuugguugguuccccuggca

SEQ ID NO: 5497 - RNA, 20 nt, Artificial Sequence
  targeting sequence with ATCN PAM
uuuagucaguccccaguucc

SEQ ID NO: 5498 - RNA, 20 nt, Artificial Sequence
  targeting sequence with ATCN PAM
uuccaaaccccaucauuuag

SEQ ID NO: 5499 - RNA, 20 nt, Artificial Sequence
  targeting sequence with ATCN PAM
auuuauuauaaaggguacaa

SEQ ID NO: 5500 - RNA, 20 nt, Artificial Sequence
  targeting sequence with ATCN PAM
caagcagcagcagucuuuug

SEQ ID NO: 5501 - RNA, 20 nt, Artificial Sequence
  targeting sequence with ATCN PAM
caaguuaaagggcucagucc

SEQ ID NO: 5502 - RNA, 20 nt, Artificial Sequence
  targeting sequence with ATCN PAM
gacacuaacuccagguagac

SEQ ID NO: 5503 - RNA, 20 nt, Artificial Sequence
  targeting sequence with ATCN PAM
caagaauuacuaccuauggg

SEQ ID NO: 5504 - RNA, 20 nt, Artificial Sequence
  targeting sequence with ATCN PAM
agcuuuacaaauauauccca

SEQ ID NO: 5505 - RNA, 20 nt, Artificial Sequence
  targeting sequence with ATCN PAM
ucaagcuuuacaaauauauc

SEQ ID NO: 5506 - RNA, 20 nt, Artificial Sequence
  targeting sequence with ATCN PAM
acaaauacauuuguaucauc

SEQ ID NO: 5507 - RNA, 20 nt, Artificial Sequence
  targeting sequence with ATCN PAM
agguaaguugggagguuaua

SEQ ID NO: 5508 - RNA, 20 nt, Artificial Sequence
  targeting sequence with ATCN PAM
cggcucacugcaaccucuac

SEQ ID NO: 5509 - RNA, 20 nt, Artificial Sequence
  targeting sequence with ATCN PAM
cuugaacuugggagguagag

SEQ ID NO: 5510 - RNA, 20 nt, Artificial Sequence
  targeting sequence with ATCN PAM
cagcuacuugggaggcugag

SEQ ID NO: 5511 - RNA, 20 nt, Artificial Sequence
  targeting sequence with ATCN PAM
cuacuaaaaaaaaaaguaaa

SEQ ID NO: 5512 - RNA, 20 nt, Artificial Sequence
  targeting sequence with ATCN PAM
ccugaggucaggaguucaag

SEQ ID NO: 5513 - RNA, 20 nt, Artificial Sequence
  targeting sequence with ATCN PAM
gcccgccucggccucccaaa

SEQ ID NO: 5514 - RNA, 20 nt, Artificial Sequence
  targeting sequence with ATCN PAM
cagugcuuugggaggccgag

SEQ ID NO: 5515 - RNA, 20 nt, Artificial Sequence
  targeting sequence with ATCN PAM
cuaagucuuaauaggcaugu

SEQ ID NO: 5516 - RNA, 20 nt, Artificial Sequence
  targeting sequence with ATCN PAM
caauaaaugacaacugcauu

SEQ ID NO: 5517 - RNA, 20 nt, Artificial Sequence
  targeting sequence with ATCN PAM
aaucuaucagcaaaaccugc

SEQ ID NO: 5518 - RNA, 20 nt, Artificial Sequence
  targeting sequence with ATCN PAM
aucagcaaaaccugcugacu

SEQ ID NO: 5519 - RNA, 20 nt, Artificial Sequence
  targeting sequence with ATCN PAM
gcaaaaccugcugacucuac

SEQ ID NO: 5520 - RNA, 20 nt, Artificial Sequence
  targeting sequence with ATCN PAM
agaaucagaucauguuacca

SEQ ID NO: 5521 - RNA, 20 nt, Artificial Sequence
  targeting sequence with ATCN PAM
gaucauguuaccacagucac

SEQ ID NO: 5522 - RNA, 20 nt, Artificial Sequence
  targeting sequence with ATCN PAM
gauucuggauauauuuuuca

SEQ ID NO: 5523 - RNA, 20 nt, Artificial Sequence
  targeting sequence with ATCN PAM
uguuaccacagucacugcua

SEQ ID NO: 5524 - RNA, 20 nt, Artificial Sequence
  targeting sequence with ATCN PAM
aggugagagaaaaugugguu

SEQ ID NO: 5525 - RNA, 20 nt, Artificial Sequence
  targeting sequence with ATCN PAM
accacuaucuacucagcagc

SEQ ID NO: 5526 - RNA, 20 nt, Artificial Sequence
  targeting sequence with ATCN PAM
acucagcagccaaagaaaug

SEQ ID NO: 5527 - RNA, 20 nt, Artificial Sequence
  targeting sequence with ATCN PAM
gaucaugucacccugcccaa

SEQ ID NO: 5528 - RNA, 20 nt, Artificial Sequence
  targeting sequence with ATCN PAM
gauuuauauuuugacauuuu

SEQ ID NO: 5529 - RNA, 20 nt, Artificial Sequence
  targeting sequence with ATCN PAM
ugucacccugcccaaacgcu

SEQ ID NO: 5530 - RNA, 20 nt, Artificial Sequence
  targeting sequence with ATCN PAM
caguguacauguccugagac

SEQ ID NO: 5531 - RNA, 20 nt, Artificial Sequence
  targeting sequence with ATCN PAM
guacaggaaguaaauuacag

SEQ ID NO: 5532 - RNA, 20 nt, Artificial Sequence
  targeting sequence with ATCN PAM
ccccaaacaaaaacucugaa

SEQ ID NO: 5533 - RNA, 20 nt, Artificial Sequence
  targeting sequence with ATCN PAM
cuacucuauauuuccauaau

SEQ ID NO: 5534 - RNA, 20 nt, Artificial Sequence
  targeting sequence with ATCN PAM
acaaugucauauagucauca

SEQ ID NO: 5535 - RNA, 20 nt, Artificial Sequence
  targeting sequence with ATCN PAM
cugcuuuuguucuuuuguug

SEQ ID NO: 5536 - RNA, 20 nt, Artificial Sequence
  targeting sequence with ATCN PAM
ucuugggucaaaauacccuc

SEQ ID NO: 5537 - RNA, 20 nt, Artificial Sequence
  targeting sequence with ATCN PAM
cgggcuaccacuucauuuac

SEQ ID NO: 5538 - RNA, 20 nt, Artificial Sequence
  targeting sequence with ATCN PAM
gucaggugguuuuugcaacc

SEQ ID NO: 5539 - RNA, 20 nt, Artificial Sequence
  targeting sequence with ATCN PAM
gaggcuagggugaaguuaca

SEQ ID NO: 5540 - RNA, 20 nt, Artificial Sequence
  targeting sequence with ATCN PAM
gucugauugguuguggacag

SEQ ID NO: 5541 - RNA, 20 nt, Artificial Sequence
  targeting sequence with ATCN PAM
gacugauugcagcugagucu

SEQ ID NO: 5542 - RNA, 20 nt, Artificial Sequence
  targeting sequence with ATCN PAM
gucugauugguuguggacag

SEQ ID NO: 5543 - RNA, 20 nt, Artificial Sequence
  targeting sequence with ATCN PAM
gacugauugccuguugaguc

SEQ ID NO: 5544 - RNA, 20 nt, Artificial Sequence
  targeting sequence with ATCN PAM
gcuguccagaaaaggcuggg

SEQ ID NO: 5545 - RNA, 20 nt, Artificial Sequence
  targeting sequence with ATCN PAM
uaacuuuccaugccuaagua

SEQ ID NO: 5546 - RNA, 20 nt, Artificial Sequence
  targeting sequence with ATCN PAM
cggcucacugcaaccuccgc

SEQ ID NO: 5547 - RNA, 20 nt, Artificial Sequence
  targeting sequence with ATCN PAM
cuugaaccugggaagcggag

SEQ ID NO: 5548 - RNA, 20 nt, Artificial Sequence
  targeting sequence with ATCN PAM
gggccucacucaccggacgg

SEQ ID NO: 5549 - RNA, 20 nt, Artificial Sequence
  targeting sequence with ATCN PAM
acacaguccgccugcucccc

SEQ ID NO: 5550 - RNA, 20 nt, Artificial Sequence
  targeting sequence with ATCN PAM
ccacccuggcaccccagccc

SEQ ID NO: 5551 - RNA, 20 nt, Artificial Sequence
  targeting sequence with ATCN PAM
agcaggggaggggcuggggu

SEQ ID NO: 5552 - RNA, 20 nt, Artificial Sequence
  targeting sequence with ATCN PAM
gcuuauugucuugucuccuu

SEQ ID NO: 5553 - RNA, 20 nt, Artificial Sequence
  targeting sequence with ATCN PAM
cugccuuccuaaagcucaaa

SEQ ID NO: 5554 - RNA, 20 nt, Artificial Sequence
  targeting sequence with ATCN PAM
uugucccuguccaguucacu

SEQ ID NO: 5555 - RNA, 20 nt, Artificial Sequence
  targeting sequence with GTCN PAM
cgguuuuuuuuuuuuuuuaa

SEQ ID NO: 5556 - RNA, 20 nt, Artificial Sequence
  targeting sequence with GTCN PAM
gaagauggucggcaucagug

SEQ ID NO: 5557 - RNA, 20 nt, Artificial Sequence
  targeting sequence with GTCN PAM
gcaucaguguucguuuccua

SEQ ID NO: 5558 - RNA, 20 nt, Artificial Sequence
  targeting sequence with GTCN PAM
ugcauggccaccgugcaguu

SEQ ID NO: 5559 - RNA, 20 nt, Artificial Sequence
  targeting sequence with GTCN PAM
cuaauggucguaaagcacuu

SEQ ID NO: 5560 - RNA, 20 nt, Artificial Sequence
  targeting sequence with GTCN PAM
uaaagcacuugaaaaucauc

SEQ ID NO: 5561 - RNA, 20 nt, Artificial Sequence
  targeting sequence with GTCN PAM
caucacccugaugauuuuca

SEQ ID NO: 5562 - RNA, 20 nt, Artificial Sequence
  targeting sequence with GTCN PAM
aaaaagagguuucccucacu

SEQ ID NO: 5563 - RNA, 20 nt, Artificial Sequence
  targeting sequence with GTCN PAM
ccuuuugcagaaacuucagg

SEQ ID NO: 5564 - RNA, 20 nt, Artificial Sequence
  targeting sequence with GTCN PAM
gaccuggggccugcaccagc

SEQ ID NO: 5565 - RNA, 20 nt, Artificial Sequence
  targeting sequence with GTCN PAM
gacugugcugcuugccucua

SEQ ID NO: 5566 - RNA, 20 nt, Artificial Sequence
  targeting sequence with GTCN PAM
uuggccggcgcuggugcagg

SEQ ID NO: 5567 - RNA, 20 nt, Artificial Sequence
  targeting sequence with GTCN PAM
cacagguggcagcacucgcc

SEQ ID NO: 5568 - RNA, 20 nt, Artificial Sequence
  targeting sequence with GTCN PAM
aggguucacuggcugcacgg

SEQ ID NO: 5569 - RNA, 20 nt, Artificial Sequence
  targeting sequence with GTCN PAM
cgaaaaaagaaaaagaaaag

SEQ ID NO: 5570 - RNA, 20 nt, Artificial Sequence
  targeting sequence with GTCN PAM
uguucugucgcccaggcugg

SEQ ID NO: 5571 - RNA, 20 nt, Artificial Sequence
  targeting sequence with GTCN PAM
cccaggcuggagugcagugc

SEQ ID NO: 5572 - RNA, 20 nt, Artificial Sequence
  targeting sequence with GTCN PAM
cagcuacucaggaggcugag

SEQ ID NO: 5573 - RNA, 20 nt, Artificial Sequence
  targeting sequence with GTCN PAM
gcccucucccucuguacuuu

SEQ ID NO: 5574 - RNA, 20 nt, Artificial Sequence
  targeting sequence with GTCN PAM
aucuagugagugcggggugc

SEQ ID NO: 5575 - RNA, 20 nt, Artificial Sequence
  targeting sequence with GTCN PAM
caccagauuccuuccccugg

SEQ ID NO: 5576 - RNA, 20 nt, Artificial Sequence
  targeting sequence with GTCN PAM
acacccaaaagucaaaccaa

SEQ ID NO: 5577 - RNA, 20 nt, Artificial Sequence
  targeting sequence with GTCN PAM
aaccaaaaucuuuuguguau

SEQ ID NO: 5578 - RNA, 20 nt, Artificial Sequence
  targeting sequence with GTCN PAM
uucucaaagcaccagaucuu

SEQ ID NO: 5579 - RNA, 20 nt, Artificial Sequence
  targeting sequence with GTCN PAM
uaccuggaguggaguccccu

SEQ ID NO: 5580 - RNA, 20 nt, Artificial Sequence
  targeting sequence with GTCN PAM
ccuaccucccgucuucaucc

SEQ ID NO: 5581 - RNA, 20 nt, Artificial Sequence
  targeting sequence with GTCN PAM
ucauccucacugcugcgugc

SEQ ID NO: 5582 - RNA, 20 nt, Artificial Sequence
  targeting sequence with GTCN PAM
aggggccacaaacaucagca

SEQ ID NO: 5583 - RNA, 20 nt, Artificial Sequence
  targeting sequence with GTCN PAM
cucucuggaauacccuucuu

SEQ ID NO: 5584 - RNA, 20 nt, Artificial Sequence
  targeting sequence with GTCN PAM
cauuagaugacacaagauca

SEQ ID NO: 5585 - RNA, 20 nt, Artificial Sequence
  targeting sequence with GTCN PAM
ucuaaugugaccucaaugga

SEQ ID NO: 5586 - RNA, 20 nt, Artificial Sequence
  targeting sequence with GTCN PAM
ucugggcucucuuacccucc

SEQ ID NO: 5587 - RNA, 20 nt, Artificial Sequence
  targeting sequence with GTCN PAM
cgaacuccauagagcccagg

SEQ ID NO: 5588 - RNA, 20 nt, Artificial Sequence
  targeting sequence with GTCN PAM
gcaacgccucauugaugguc

SEQ ID NO: 5589 - RNA, 20 nt, Artificial Sequence
  targeting sequence with GTCN PAM
ccuuuccuccucucacuucc

SEQ ID NO: 5590 - RNA, 20 nt, Artificial Sequence
  targeting sequence with GTCN PAM
guagcgagagcuguaacauu

SEQ ID NO: 5591 - RNA, 20 nt, Artificial Sequence
  targeting sequence with GTCN PAM
guugaaugagcucaucuacc

SEQ ID NO: 5592 - RNA, 20 nt, Artificial Sequence
  targeting sequence with GTCN PAM
guggcaaauaacuccuaggg

SEQ ID NO: 5593 - RNA, 20 nt, Artificial Sequence
  targeting sequence with GTCN PAM
cuaggaguuauuugccacug

SEQ ID NO: 5594 - RNA, 20 nt, Artificial Sequence
  targeting sequence with GTCN PAM
cuaccgggaggugcuccuua

SEQ ID NO: 5595 - RNA, 20 nt, Artificial Sequence
  targeting sequence with GTCN PAM
ucuucaucuuuauaucucug

SEQ ID NO: 5596 - RNA, 20 nt, Artificial Sequence
  targeting sequence with GTCN PAM
gcucugauccaaucauccau

SEQ ID NO: 5597 - RNA, 20 nt, Artificial Sequence
  targeting sequence with GTCN PAM
uccccguugcagcaucccca

SEQ ID NO: 5598 - RNA, 20 nt, Artificial Sequence
  targeting sequence with GTCN PAM
aggguucccagcaggggcug

SEQ ID NO: 5599 - RNA, 20 nt, Artificial Sequence
  targeting sequence with GTCN PAM
gugcuuuucaccucugugua

SEQ ID NO: 5600 - RNA, 20 nt, Artificial Sequence
  targeting sequence with GTCN PAM
agacaggaucagagcagcag

SEQ ID NO: 5601 - RNA, 20 nt, Artificial Sequence
  targeting sequence with GTCN PAM
ggacaggguuugcugguccg

SEQ ID NO: 5602 - RNA, 20 nt, Artificial Sequence
  targeting sequence with GTCN PAM
cugcugcucugauccugucu

SEQ ID NO: 5603 - RNA, 20 nt, Artificial Sequence
  targeting sequence with GTCN PAM
ccauccccucugucccugcu

SEQ ID NO: 5604 - RNA, 20 nt, Artificial Sequence
  targeting sequence with GTCN PAM
ucaggagcccacgcucaucu

SEQ ID NO: 5605 - RNA, 20 nt, Artificial Sequence
  targeting sequence with GTCN PAM
gaggagaugagcgugggcuc

SEQ ID NO: 5606 - RNA, 20 nt, Artificial Sequence
  targeting sequence with GTCN PAM
agccuguugggccccacacu

SEQ ID NO: 5607 - RNA, 20 nt, Artificial Sequence
  targeting sequence with GTCN PAM
uucccuaugucuccucccca

SEQ ID NO: 5608 - RNA, 20 nt, Artificial Sequence
  targeting sequence with GTCN PAM
ccuccccaggacuccugccc

SEQ ID NO: 5609 - RNA, 20 nt, Artificial Sequence
  targeting sequence with GTCN PAM
uggggaggagacauagggaa

SEQ ID NO: 5610 - RNA, 20 nt, Artificial Sequence
  targeting sequence with GTCN PAM
ggagccuggagucugagcuc

SEQ ID NO: 5611 - RNA, 20 nt, Artificial Sequence
  targeting sequence with GTCN PAM
gagcucuggucaccauccuu

SEQ ID NO: 5612 - RNA, 20 nt, Artificial Sequence
  targeting sequence with GTCN PAM
ccauccuuccuggccaugug

SEQ ID NO: 5613 - RNA, 20 nt, Artificial Sequence
  targeting sequence with GTCN PAM
ucaaagaaacagaaauuggc

SEQ ID NO: 5614 - RNA, 20 nt, Artificial Sequence
  targeting sequence with GTCN PAM
cacucuuccaucugcagcag

SEQ ID NO: 5615 - RNA, 20 nt, Artificial Sequence
  targeting sequence with GTCN PAM
caagaaauuaucauuucuaa

SEQ ID NO: 5616 - RNA, 20 nt, Artificial Sequence
  targeting sequence with GTCN PAM
ucauuucuaaguuagaaaug

SEQ ID NO: 5617 - RNA, 20 nt, Artificial Sequence
  targeting sequence with GTCN PAM
ggaacucuuggccucaagca

SEQ ID NO: 5618 - RNA, 20 nt, Artificial Sequence
  targeting sequence with GTCN PAM
cacuauguugccuaggccag

SEQ ID NO: 5619 - RNA, 20 nt, Artificial Sequence
  targeting sequence with GTCN PAM
accaaaaauuuuaaaaauua

SEQ ID NO: 5620 - RNA, 20 nt, Artificial Sequence
  targeting sequence with GTCN PAM
guaugucuguguggugugug

SEQ ID NO: 5621 - RNA, 20 nt, Artificial Sequence
  targeting sequence with GTCN PAM
gugugguguguguguaugug

SEQ ID NO: 5622 - RNA, 20 nt, Artificial Sequence
  targeting sequence with GTCN PAM
ugguggcuuugccuggagua

SEQ ID NO: 5623 - RNA, 20 nt, Artificial Sequence
  targeting sequence with GTCN PAM
cugggcagcuucgguugacu

SEQ ID NO: 5624 - RNA, 20 nt, Artificial Sequence
  targeting sequence with GTCN PAM
accgaagcugcccagggaca

SEQ ID NO: 5625 - RNA, 20 nt, Artificial Sequence
  targeting sequence with GTCN PAM
ucgugggcgagcaguuuccu

SEQ ID NO: 5626 - RNA, 20 nt, Artificial Sequence
  targeting sequence with GTCN PAM
ccccaggccauggggcagga

SEQ ID NO: 5627 - RNA, 20 nt, Artificial Sequence
  targeting sequence with GTCN PAM
ugugcagcagcuggccccau

SEQ ID NO: 5628 - RNA, 20 nt, Artificial Sequence
  targeting sequence with GTCN PAM
caggacuggccuuggccggu

SEQ ID NO: 5629 - RNA, 20 nt, Artificial Sequence
  targeting sequence with GTCN PAM
ugcgacccuccuucagugua

SEQ ID NO: 5630 - RNA, 20 nt, Artificial Sequence
  targeting sequence with GTCN PAM
cuggugaugcucagagcugg

SEQ ID NO: 5631 - RNA, 20 nt, Artificial Sequence
  targeting sequence with GTCN PAM
cccaguggcacaaucacggc

SEQ ID NO: 5632 - RNA, 20 nt, Artificial Sequence
  targeting sequence with GTCN PAM
aaaacacagugaucuggagc

SEQ ID NO: 5633 - RNA, 20 nt, Artificial Sequence
  targeting sequence with GTCN PAM
agguucuugguguuuugaac

SEQ ID NO: 5634 - RNA, 20 nt, Artificial Sequence
  targeting sequence with GTCN PAM
aguuuuuuguucaaaacacc

SEQ ID NO: 5635 - RNA, 20 nt, Artificial Sequence
  targeting sequence with GTCN PAM
cacccuguggcguaccuucu

SEQ ID NO: 5636 - RNA, 20 nt, Artificial Sequence
  targeting sequence with GTCN PAM
guggcuaaguaaacacugag

SEQ ID NO: 5637 - RNA, 20 nt, Artificial Sequence
  targeting sequence with GTCN PAM
cugcuuggccuguggccacu

SEQ ID NO: 5638 - RNA, 20 nt, Artificial Sequence
  targeting sequence with GTCN PAM
aagccaugguggaaggggga

SEQ ID NO: 5639 - RNA, 20 nt, Artificial Sequence
  targeting sequence with GTCN PAM
aagguuacucuuucuacaac

SEQ ID NO: 5640 - RNA, 20 nt, Artificial Sequence
  targeting sequence with GTCN PAM
ggaggcaggggcccuaaggc

SEQ ID NO: 5641 - RNA, 20 nt, Artificial Sequence
  targeting sequence with GTCN PAM
gcacaaauuggccucagauu

SEQ ID NO: 5642 - RNA, 20 nt, Artificial Sequence
  targeting sequence with GTCN PAM
ggggggaagcagggaaucug

SEQ ID NO: 5643 - RNA, 20 nt, Artificial Sequence
  targeting sequence with GTCN PAM
ggaggcaaggaacuuaaggc

SEQ ID NO: 5644 - RNA, 20 nt, Artificial Sequence
  targeting sequence with GTCN PAM
guuuugucagucuugagacc

SEQ ID NO: 5645 - RNA, 20 nt, Artificial Sequence
  targeting sequence with GTCN PAM
gucuugagaccccaguuuuc

SEQ ID NO: 5646 - RNA, 20 nt, Artificial Sequence
  targeting sequence with GTCN PAM
ugagaccccaguuuucuugu

SEQ ID NO: 5647 - RNA, 20 nt, Artificial Sequence
  targeting sequence with GTCN PAM
caagacugacaaaacagacu

SEQ ID NO: 5648 - RNA, 20 nt, Artificial Sequence
  targeting sequence with GTCN PAM
auugugucuaaacucuaaag

SEQ ID NO: 5649 - RNA, 20 nt, Artificial Sequence
  targeting sequence with GTCN PAM
aaacucuaaagggaggaggg

SEQ ID NO: 5650 - RNA, 20 nt, Artificial Sequence
  targeting sequence with GTCN PAM
gaccccuuaugcccaugaug

SEQ ID NO: 5651 - RNA, 20 nt, Artificial Sequence
  targeting sequence with GTCN PAM
gacuugccucauuuuacccu

SEQ ID NO: 5652 - RNA, 20 nt, Artificial Sequence
  targeting sequence with GTCN PAM
caucuuuuaguuuuaguauu

SEQ ID NO: 5653 - RNA, 20 nt, Artificial Sequence
  targeting sequence with GTCN PAM
uuaucuuugaaauuuccagu

SEQ ID NO: 5654 - RNA, 20 nt, Artificial Sequence
  targeting sequence with GTCN PAM
caggugacugcucuuuccug

SEQ ID NO: 5655 - RNA, 20 nt, Artificial Sequence
  targeting sequence with GTCN PAM
ccugggaccucugugcuaau

SEQ ID NO: 5656 - RNA, 20 nt, Artificial Sequence
  targeting sequence with GTCN PAM
cggccaaacucagacucguu

SEQ ID NO: 5657 - RNA, 20 nt, Artificial Sequence
  targeting sequence with GTCN PAM
gaguuuggccgggacaucuu

SEQ ID NO: 5658 - RNA, 20 nt, Artificial Sequence
  targeting sequence with GTCN PAM
ugcgggaacaagaacgaguc

SEQ ID NO: 5659 - RNA, 20 nt, Artificial Sequence
  targeting sequence with GTCN PAM
ggagggagggaaccuaaggc

SEQ ID NO: 5660 - RNA, 20 nt, Artificial Sequence
  targeting sequence with GTCN PAM
gcaugaaucggccuuagguu

SEQ ID NO: 5661 - RNA, 20 nt, Artificial Sequence
  targeting sequence with GTCN PAM
ccuccugcaaccaaucacaa

SEQ ID NO: 5662 - RNA, 20 nt, Artificial Sequence
  targeting sequence with GTCN PAM
acaaccauugugauugguug

SEQ ID NO: 5663 - RNA, 20 nt, Artificial Sequence
  targeting sequence with GTCN PAM
cucuguggaguguacuuugg

SEQ ID NO: 5664 - RNA, 20 nt, Artificial Sequence
  targeting sequence with GTCN PAM
cacgcaucuggaggcaggcu

SEQ ID NO: 5665 - RNA, 20 nt, Artificial Sequence
  targeting sequence with GTCN PAM
uuuuuucccuugaugaaauc

SEQ ID NO: 5666 - RNA, 20 nt, Artificial Sequence
  targeting sequence with GTCN PAM
gcucccauguaccaguaccu

SEQ ID NO: 5667 - RNA, 20 nt, Artificial Sequence
  targeting sequence with GTCN PAM
cagacacugauuggcgugca

SEQ ID NO: 5668 - RNA, 20 nt, Artificial Sequence
  targeting sequence with GTCN PAM
gugacacccaagcaagcaau

SEQ ID NO: 5669 - RNA, 20 nt, Artificial Sequence
  targeting sequence with GTCN PAM
uuguggggucccuuaagaag

SEQ ID NO: 5670 - RNA, 20 nt, Artificial Sequence
  targeting sequence with GTCN PAM
cuuaagaaggcagaugggga

SEQ ID NO: 5671 - RNA, 20 nt, Artificial Sequence
  targeting sequence with GTCN PAM
ccaucugccuucuuaaggga

SEQ ID NO: 5672 - RNA, 20 nt, Artificial Sequence
  targeting sequence with GTCN PAM
auggccucuccgugccaccu

SEQ ID NO: 5673 - RNA, 20 nt, Artificial Sequence
  targeting sequence with GTCN PAM
cuggaguuaggcugaccugg

SEQ ID NO: 5674 - RNA, 20 nt, Artificial Sequence
  targeting sequence with GTCN PAM
gccuaacuccagagacugcu

SEQ ID NO: 5675 - RNA, 20 nt, Artificial Sequence
  targeting sequence with GTCN PAM
ccuacccaggcccacaguga

SEQ ID NO: 5676 - RNA, 20 nt, Artificial Sequence
  targeting sequence with GTCN PAM
auagagaagcaaucuuagaa

SEQ ID NO: 5677 - RNA, 20 nt, Artificial Sequence
  targeting sequence with GTCN PAM
ucacccuacgucuauagaga

SEQ ID NO: 5678 - RNA, 20 nt, Artificial Sequence
  targeting sequence with GTCN PAM
ggcuuuacaggcauccuccc

SEQ ID NO: 5679 - RNA, 20 nt, Artificial Sequence
  targeting sequence with GTCN PAM
gauucuggcugucacucuua

SEQ ID NO: 5680 - RNA, 20 nt, Artificial Sequence
  targeting sequence with GTCN PAM
cucuuauuagcuguucucua

SEQ ID NO: 5681 - RNA, 20 nt, Artificial Sequence
  targeting sequence with GTCN PAM
ggugcuucccauagagaaca

SEQ ID NO: 5682 - RNA, 20 nt, Artificial Sequence
  targeting sequence with GTCN PAM
cuggccaugaugcugcacac

SEQ ID NO: 5683 - RNA, 20 nt, Artificial Sequence
  targeting sequence with GTCN PAM
aggucucugauucugacagc

SEQ ID NO: 5684 - RNA, 20 nt, Artificial Sequence
  targeting sequence with GTCN PAM
cugauucugacagcaaugug

SEQ ID NO: 5685 - RNA, 20 nt, Artificial Sequence
  targeting sequence with GTCN PAM
gaaucagagaccuugaccau

SEQ ID NO: 5686 - RNA, 20 nt, Artificial Sequence
  targeting sequence with GTCN PAM
augaaucccgccaugaaggu

SEQ ID NO: 5687 - RNA, 20 nt, Artificial Sequence
  targeting sequence with GTCN PAM
uuuccuggccuagucuauga

SEQ ID NO: 5688 - RNA, 20 nt, Artificial Sequence
  targeting sequence with GTCN PAM
augaaagcuagagagauggc

SEQ ID NO: 5689 - RNA, 20 nt, Artificial Sequence
  targeting sequence with GTCN PAM
gauguuuucagccaucucuc

SEQ ID NO: 5690 - RNA, 20 nt, Artificial Sequence
  targeting sequence with GTCN PAM
auuaaggagcugcucauuuu

SEQ ID NO: 5691 - RNA, 20 nt, Artificial Sequence
  targeting sequence with GTCN PAM
auauuccugggcugacauug

SEQ ID NO: 5692 - RNA, 20 nt, Artificial Sequence
  targeting sequence with GTCN PAM
gcccaggaauauggacaaaa

SEQ ID NO: 5693 - RNA, 20 nt, Artificial Sequence
  targeting sequence with GTCN PAM
cucuuugccacuccuucaau

SEQ ID NO: 5694 - RNA, 20 nt, Artificial Sequence
  targeting sequence with GTCN PAM
ugaucuaacccaaggcgggc

SEQ ID NO: 5695 - RNA, 20 nt, Artificial Sequence
  targeting sequence with GTCN PAM
ccucucuucaugccuacaag

SEQ ID NO: 5696 - RNA, 20 nt, Artificial Sequence
  targeting sequence with GTCN PAM
agucuccucucuucaugccu

SEQ ID NO: 5697 - RNA, 20 nt, Artificial Sequence
  targeting sequence with GTCN PAM
gguccagucuccucucuuca

SEQ ID NO: 5698 - RNA, 20 nt, Artificial Sequence
  targeting sequence with GTCN PAM
uggucugguccagucuccuc

SEQ ID NO: 5699 - RNA, 20 nt, Artificial Sequence
  targeting sequence with GTCN PAM
cguaaggggcucugggaccu

SEQ ID NO: 5700 - RNA, 20 nt, Artificial Sequence
  targeting sequence with GTCN PAM
cagagccccuuacgugacac

SEQ ID NO: 5701 - RNA, 20 nt, Artificial Sequence
  targeting sequence with GTCN PAM
ucccaguucugaaauggggg

SEQ ID NO: 5702 - RNA, 20 nt, Artificial Sequence
  targeting sequence with GTCN PAM
caaggcuuaacugagauguu

SEQ ID NO: 5703 - RNA, 20 nt, Artificial Sequence
  targeting sequence with GTCN PAM
ccaguguaggaaaguggaga

SEQ ID NO: 5704 - RNA, 20 nt, Artificial Sequence
  targeting sequence with GTCN PAM
ucuuccucccugcuggcauu

SEQ ID NO: 5705 - RNA, 20 nt, Artificial Sequence
  targeting sequence with GTCN PAM
ccuccuuacacccaggaacc

SEQ ID NO: 5706 - RNA, 20 nt, Artificial Sequence
  targeting sequence with GTCN PAM
aaggcacugugcuaggcagu

SEQ ID NO: 5707 - RNA, 20 nt, Artificial Sequence
  targeting sequence with GTCN PAM
cauguuguacuuaauagaua

SEQ ID NO: 5708 - RNA, 20 nt, Artificial Sequence
  targeting sequence with GTCN PAM
cggccucccaaagaacuggg

SEQ ID NO: 5709 - RNA, 20 nt, Artificial Sequence
  targeting sequence with GTCN PAM
uaaacuccuggccucaacug

SEQ ID NO: 5710 - RNA, 20 nt, Artificial Sequence
  targeting sequence with GTCN PAM
ggguuuuacuuuggccaggc

SEQ ID NO: 5711 - RNA, 20 nt, Artificial Sequence
  targeting sequence with GTCN PAM
cagcuacuugggaggcuggg

SEQ ID NO: 5712 - RNA, 20 nt, Artificial Sequence
  targeting sequence with GTCN PAM
cccugguucaagcaauucug

SEQ ID NO: 5713 - RNA, 20 nt, Artificial Sequence
  targeting sequence with GTCN PAM
ccaaggcuggaaugcagugg

SEQ ID NO: 5714 - RNA, 20 nt, Artificial Sequence
  targeting sequence with GTCN PAM
ugcugugucaccaaggcugg

SEQ ID NO: 5715 - RNA, 20 nt, Artificial Sequence
  targeting sequence with GTCN PAM
aaaacacaaaaaaaucagua

SEQ ID NO: 5716 - RNA, 20 nt, Artificial Sequence
  targeting sequence with GTCN PAM
aaaucauccagcuuuuucaa

SEQ ID NO: 5717 - RNA, 20 nt, Artificial Sequence
  targeting sequence with GTCN PAM
cagagggaaagaaagggggg

SEQ ID NO: 5718 - RNA, 20 nt, Artificial Sequence
  targeting sequence with GTCN PAM
ccagugaugguaugccaucc

SEQ ID NO: 5719 - RNA, 20 nt, Artificial Sequence
  targeting sequence with GTCN PAM
gaaggccccugaaugagcuc

SEQ ID NO: 5720 - RNA, 20 nt, Artificial Sequence
  targeting sequence with GTCN PAM
aggauuugcccacugagaaa

SEQ ID NO: 5721 - RNA, 20 nt, Artificial Sequence
  targeting sequence with GTCN PAM
gcugugcuggagucuaggau

SEQ ID NO: 5722 - RNA, 20 nt, Artificial Sequence
  targeting sequence with GTCN PAM
uuccagcucuaggucggcug

SEQ ID NO: 5723 - RNA, 20 nt, Artificial Sequence
  targeting sequence with GTCN PAM
cuagcagcccccuuuccaca

SEQ ID NO: 5724 - RNA, 20 nt, Artificial Sequence
  targeting sequence with GTCN PAM
ucgcucugagccuacuucuc

SEQ ID NO: 5725 - RNA, 20 nt, Artificial Sequence
  targeting sequence with GTCN PAM
caguccucgcucugagccua

SEQ ID NO: 5726 - RNA, 20 nt, Artificial Sequence
  targeting sequence with GTCN PAM
ucucaagguguuuuaaggaa

SEQ ID NO: 5727 - RNA, 20 nt, Artificial Sequence
  targeting sequence with GTCN PAM
gaaccuagcaaacaaguguu

SEQ ID NO: 5728 - RNA, 20 nt, Artificial Sequence
  targeting sequence with GTCN PAM
gagcaugagcagggguggga

SEQ ID NO: 5729 - RNA, 20 nt, Artificial Sequence
  targeting sequence with GTCN PAM
gagagcucuuagcucuagga

SEQ ID NO: 5730 - RNA, 20 nt, Artificial Sequence
  targeting sequence with GTCN PAM
uuaucuguuuaauuggucag

SEQ ID NO: 5731 - RNA, 20 nt, Artificial Sequence
  targeting sequence with GTCN PAM
gccuccccuguuagaaugug

SEQ ID NO: 5732 - RNA, 20 nt, Artificial Sequence
  targeting sequence with GTCN PAM
cccuccacaauucagaggcc

SEQ ID NO: 5733 - RNA, 20 nt, Artificial Sequence
  targeting sequence with GTCN PAM
cggccccugucccccuccac

SEQ ID NO: 5734 - RNA, 20 nt, Artificial Sequence
  targeting sequence with GTCN PAM
ucagucucugacaggaagcc

SEQ ID NO: 5735 - RNA, 20 nt, Artificial Sequence
  targeting sequence with GTCN PAM
cugacaggaagccugguccu

SEQ ID NO: 5736 - RNA, 20 nt, Artificial Sequence
  targeting sequence with GTCN PAM
gagacugaggacccaggaag

SEQ ID NO: 5737 - RNA, 20 nt, Artificial Sequence
  targeting sequence with GTCN PAM
ugugggaugaaaagaugaag

SEQ ID NO: 5738 - RNA, 20 nt, Artificial Sequence
  targeting sequence with GTCN PAM
ccugcaaggcagccagaggc

SEQ ID NO: 5739 - RNA, 20 nt, Artificial Sequence
  targeting sequence with GTCN PAM
ccagccucuggcugccuugc

SEQ ID NO: 5740 - RNA, 20 nt, Artificial Sequence
  targeting sequence with GTCN PAM
uuucaggagggaggaugcca

SEQ ID NO: 5741 - RNA, 20 nt, Artificial Sequence
  targeting sequence with GTCN PAM
ggauugcucugcguguucgg

SEQ ID NO: 5742 - RNA, 20 nt, Artificial Sequence
  targeting sequence with GTCN PAM
gcccauuuugaauggggcga

SEQ ID NO: 5743 - RNA, 20 nt, Artificial Sequence
  targeting sequence with GTCN PAM
ccauuuaucgccccauucaa

SEQ ID NO: 5744 - RNA, 20 nt, Artificial Sequence
  targeting sequence with GTCN PAM
ggcugcuuucagguggcuuu

SEQ ID NO: 5745 - RNA, 20 nt, Artificial Sequence
  targeting sequence with GTCN PAM
gcuuguuccucagaaacuuc

SEQ ID NO: 5746 - RNA, 20 nt, Artificial Sequence
  targeting sequence with GTCN PAM
augaguuaaagucucuggcu

SEQ ID NO: 5747 - RNA, 20 nt, Artificial Sequence
  targeting sequence with GTCN PAM
cuggcuuuacugugaguuca

SEQ ID NO: 5748 - RNA, 20 nt, Artificial Sequence
  targeting sequence with GTCN PAM
guggaaggcaaacucuuaua

SEQ ID NO: 5749 - RNA, 20 nt, Artificial Sequence
  targeting sequence with GTCN PAM
ccugugucuguggcacgacu

SEQ ID NO: 5750 - RNA, 20 nt, Artificial Sequence
  targeting sequence with GTCN PAM
guggcacgacuggguaggca

SEQ ID NO: 5751 - RNA, 20 nt, Artificial Sequence
  targeting sequence with GTCN PAM
ugccacagacacaggggacc

SEQ ID NO: 5752 - RNA, 20 nt, Artificial Sequence
  targeting sequence with GTCN PAM
ccugcauucuacccaugucg

SEQ ID NO: 5753 - RNA, 20 nt, Artificial Sequence
  targeting sequence with GTCN PAM
ccaagauguauaggcagucu

SEQ ID NO: 5754 - RNA, 20 nt, Artificial Sequence
  targeting sequence with GTCN PAM
cucaucaguccaugcaucuc

SEQ ID NO: 5755 - RNA, 20 nt, Artificial Sequence
  targeting sequence with GTCN PAM
augcaucucucucucucuug

SEQ ID NO: 5756 - RNA, 20 nt, Artificial Sequence
  targeting sequence with GTCN PAM
aacuggcuucuucuuuggcu

SEQ ID NO: 5757 - RNA, 20 nt, Artificial Sequence
  targeting sequence with GTCN PAM
cccaaggaggcaccgccaca

SEQ ID NO: 5758 - RNA, 20 nt, Artificial Sequence
  targeting sequence with GTCN PAM
guggcggugccuccuuggga

SEQ ID NO: 5759 - RNA, 20 nt, Artificial Sequence
  targeting sequence with GTCN PAM
uuuugggaucagguaaaaca

SEQ ID NO: 5760 - RNA, 20 nt, Artificial Sequence
  targeting sequence with GTCN PAM
uugcuguucuuugcaugauc

SEQ ID NO: 5761 - RNA, 20 nt, Artificial Sequence
  targeting sequence with GTCN PAM
aggugagcuugacuucccac

SEQ ID NO: 5762 - RNA, 20 nt, Artificial Sequence
  targeting sequence with GTCN PAM
agcucaccuagacagugagc

SEQ ID NO: 5763 - RNA, 20 nt, Artificial Sequence
  targeting sequence with GTCN PAM
cccacuuuugaagccaagaa

SEQ ID NO: 5764 - RNA, 20 nt, Artificial Sequence
  targeting sequence with GTCN PAM
uguacucugaugaaagccug

SEQ ID NO: 5765 - RNA, 20 nt, Artificial Sequence
  targeting sequence with GTCN PAM
agaaaguggacuugggguuc

SEQ ID NO: 5766 - RNA, 20 nt, Artificial Sequence
  targeting sequence with GTCN PAM
acuuucuugacaaguaagaa

SEQ ID NO: 5767 - RNA, 20 nt, Artificial Sequence
  targeting sequence with GTCN PAM
cacguacaucuuuuccagca

SEQ ID NO: 5768 - RNA, 20 nt, Artificial Sequence
  targeting sequence with GTCN PAM
aauuagacuugcaguuccac

SEQ ID NO: 5769 - RNA, 20 nt, Artificial Sequence
  targeting sequence with GTCN PAM
aauuagaccucuuucuuuug

SEQ ID NO: 5770 - RNA, 20 nt, Artificial Sequence
  targeting sequence with GTCN PAM
cagcuuauauggauggcagc

SEQ ID NO: 5771 - RNA, 20 nt, Artificial Sequence
  targeting sequence with GTCN PAM
cacgagaucugaugguuuua

SEQ ID NO: 5772 - RNA, 20 nt, Artificial Sequence
  targeting sequence with GTCN PAM
uucccaugcuguucucauga

SEQ ID NO: 5773 - RNA, 20 nt, Artificial Sequence
  targeting sequence with GTCN PAM
cucccacaacacaugggaau

SEQ ID NO: 5774 - RNA, 20 nt, Artificial Sequence
  targeting sequence with GTCN PAM
ccacccagaucucaucuuga

SEQ ID NO: 5775 - RNA, 20 nt, Artificial Sequence
  targeting sequence with GTCN PAM
ucagggcuuuugccugcuga

SEQ ID NO: 5776 - RNA, 20 nt, Artificial Sequence
  targeting sequence with GTCN PAM
gggcaucugggccacagccu

SEQ ID NO: 5777 - RNA, 20 nt, Artificial Sequence
  targeting sequence with GTCN PAM
ccuacuguguggccacucug

SEQ ID NO: 5778 - RNA, 20 nt, Artificial Sequence
  targeting sequence with GTCN PAM
cgugguaacugacugaggca

SEQ ID NO: 5779 - RNA, 20 nt, Artificial Sequence
  targeting sequence with GTCN PAM
guuaccacgugacagcucac

SEQ ID NO: 5780 - RNA, 20 nt, Artificial Sequence
  targeting sequence with GTCN PAM
gugaaaagggauuggaccua

SEQ ID NO: 5781 - RNA, 20 nt, Artificial Sequence
  targeting sequence with GTCN PAM
aaucccuuuucacagacaag

SEQ ID NO: 5782 - RNA, 20 nt, Artificial Sequence
  targeting sequence with GTCN PAM
caggcugcugugaggauuca

SEQ ID NO: 5783 - RNA, 20 nt, Artificial Sequence
  targeting sequence with GTCN PAM
ccauccucucagacuccagu

SEQ ID NO: 5784 - RNA, 20 nt, Artificial Sequence
  targeting sequence with GTCN PAM
gagaggauggugaccagcua

SEQ ID NO: 5785 - RNA, 20 nt, Artificial Sequence
  targeting sequence with GTCN PAM
auuucuggggaauggagcuc

SEQ ID NO: 5786 - RNA, 20 nt, Artificial Sequence
  targeting sequence with GTCN PAM
gaacugagcgccccagaguu

SEQ ID NO: 5787 - RNA, 20 nt, Artificial Sequence
  targeting sequence with GTCN PAM
uccaacccaauaggccugca

SEQ ID NO: 5788 - RNA, 20 nt, Artificial Sequence
  targeting sequence with GTCN PAM
accaccacccagcgcccagu

SEQ ID NO: 5789 - RNA, 20 nt, Artificial Sequence
  targeting sequence with GTCN PAM
ugggauggaaaugggugugg

SEQ ID NO: 5790 - RNA, 20 nt, Artificial Sequence
  targeting sequence with GTCN PAM
aaaucaaggugugugguccu

SEQ ID NO: 5791 - RNA, 20 nt, Artificial Sequence
  targeting sequence with GTCN PAM
gacuggugccggaugaauuu

SEQ ID NO: 5792 - RNA, 20 nt, Artificial Sequence
  targeting sequence with GTCN PAM
gaccgauaugucaaaaucaa

SEQ ID NO: 5793 - RNA, 20 nt, Artificial Sequence
  targeting sequence with GTCN PAM
aaaagagaaccaagaaauuc

SEQ ID NO: 5794 - RNA, 20 nt, Artificial Sequence
  targeting sequence with GTCN PAM
cugggcgggaaagccuccuu

SEQ ID NO: 5795 - RNA, 20 nt, Artificial Sequence
  targeting sequence with GTCN PAM
cagagugucuuccaaucacc

SEQ ID NO: 5796 - RNA, 20 nt, Artificial Sequence
  targeting sequence with GTCN PAM
uccaaucaccagcuacggag

SEQ ID NO: 5797 - RNA, 20 nt, Artificial Sequence
  targeting sequence with GTCN PAM
ccagaugcgaucccaggagg

SEQ ID NO: 5798 - RNA, 20 nt, Artificial Sequence
  targeting sequence with GTCN PAM
agggucaccucacccacuca

SEQ ID NO: 5799 - RNA, 20 nt, Artificial Sequence
  targeting sequence with GTCN PAM
ccucacccacucagagccca

SEQ ID NO: 5800 - RNA, 20 nt, Artificial Sequence
  targeting sequence with GTCN PAM
guuuugauuugcucagcugu

SEQ ID NO: 5801 - RNA, 20 nt, Artificial Sequence
  targeting sequence with GTCN PAM
uggggucaguuuugauuugc

SEQ ID NO: 5802 - RNA, 20 nt, Artificial Sequence
  targeting sequence with GTCN PAM
gaacccccagaugguccuuc

SEQ ID NO: 5803 - RNA, 20 nt, Artificial Sequence
  targeting sequence with GTCN PAM
uuccgguaguacuggccuug

SEQ ID NO: 5804 - RNA, 20 nt, Artificial Sequence
  targeting sequence with GTCN PAM
aggccaguacuaccggaagg

SEQ ID NO: 5805 - RNA, 20 nt, Artificial Sequence
  targeting sequence with GTCN PAM
caguuuccucaccuguaaaa

SEQ ID NO: 5806 - RNA, 20 nt, Artificial Sequence
  targeting sequence with GTCN PAM
ccauuuuacaggugaggaaa

SEQ ID NO: 5807 - RNA, 20 nt, Artificial Sequence
  targeting sequence with GTCN PAM
ucuccauuuuacaggugagg

SEQ ID NO: 5808 - RNA, 20 nt, Artificial Sequence
  targeting sequence with GTCN PAM
caggguaaauguucaauaaa

SEQ ID NO: 5809 - RNA, 20 nt, Artificial Sequence
  targeting sequence with GTCN PAM
ucugagccauucauuuauuu

SEQ ID NO: 5810 - RNA, 20 nt, Artificial Sequence
  targeting sequence with GTCN PAM
ggagcucugggaauauaaag

SEQ ID NO: 5811 - RNA, 20 nt, Artificial Sequence
  targeting sequence with GTCN PAM
gcucacucaguuguuaacag

SEQ ID NO: 5812 - RNA, 20 nt, Artificial Sequence
  targeting sequence with GTCN PAM
caccacagcagcccuagggu

SEQ ID NO: 5813 - RNA, 20 nt, Artificial Sequence
  targeting sequence with GTCN PAM
caggcuagaaggaaaggaac

SEQ ID NO: 5814 - RNA, 20 nt, Artificial Sequence
  targeting sequence with GTCN PAM
uggcaaugaaugaaugcacg

SEQ ID NO: 5815 - RNA, 20 nt, Artificial Sequence
  targeting sequence with GTCN PAM
auucaguuggguggggggcu

SEQ ID NO: 5816 - RNA, 20 nt, Artificial Sequence
  targeting sequence with GTCN PAM
aacuugccucauuaugcccu

SEQ ID NO: 5817 - RNA, 20 nt, Artificial Sequence
  targeting sequence with GTCN PAM
gcugugccugaauuccauag

SEQ ID NO: 5818 - RNA, 20 nt, Artificial Sequence
  targeting sequence with GTCN PAM
ugggaucucuuuuaaugcua

SEQ ID NO: 5819 - RNA, 20 nt, Artificial Sequence
  targeting sequence with GTCN PAM
gucuugggaucucuuuuaau

SEQ ID NO: 5820 - RNA, 20 nt, Artificial Sequence
  targeting sequence with GTCN PAM
guuuugucagucuugggauc

SEQ ID NO: 5821 - RNA, 20 nt, Artificial Sequence
  targeting sequence with GTCN PAM
uauugcuacaaagucuguuu

SEQ ID NO: 5822 - RNA, 20 nt, Artificial Sequence
  targeting sequence with GTCN PAM
gguugaaauuuggugucuua

SEQ ID NO: 5823 - RNA, 20 nt, Artificial Sequence
  targeting sequence with GTCN PAM
ugugaugcuauacuagaguc

SEQ ID NO: 5824 - RNA, 20 nt, Artificial Sequence
  targeting sequence with GTCN PAM
aagaaauauauuuuugggua

SEQ ID NO: 5825 - RNA, 20 nt, Artificial Sequence
  targeting sequence with GTCN PAM
gaauaugucaaagaaauaua

SEQ ID NO: 5826 - RNA, 20 nt, Artificial Sequence
  targeting sequence with GTCN PAM
cuuguggggacaaucuacgu

SEQ ID NO: 5827 - RNA, 20 nt, Artificial Sequence
  targeting sequence with GTCN PAM
ccacaagagacagcuuuaca

SEQ ID NO: 5828 - RNA, 20 nt, Artificial Sequence
  targeting sequence with GTCN PAM
uguagugaaucccccucccu

SEQ ID NO: 5829 - RNA, 20 nt, Artificial Sequence
  targeting sequence with GTCN PAM
ucucccugagccaggagagg

SEQ ID NO: 5830 - RNA, 20 nt, Artificial Sequence
  targeting sequence with GTCN PAM
uaguggagccucuccuggcu

SEQ ID NO: 5831 - RNA, 20 nt, Artificial Sequence
  targeting sequence with GTCN PAM
ccacaaccucuuaucugaac

SEQ ID NO: 5832 - RNA, 20 nt, Artificial Sequence
  targeting sequence with GTCN PAM
uuagacaaacucaaccaauu

SEQ ID NO: 5833 - RNA, 20 nt, Artificial Sequence
  targeting sequence with GTCN PAM
aaagacuuggaaucaacaaa

SEQ ID NO: 5834 - RNA, 20 nt, Artificial Sequence
  targeting sequence with GTCN PAM
aaucuaccaacagcccggac

SEQ ID NO: 5835 - RNA, 20 nt, Artificial Sequence
  targeting sequence with GTCN PAM
gggcuguugguagauuugac

SEQ ID NO: 5836 - RNA, 20 nt, Artificial Sequence
  targeting sequence with GTCN PAM
ugagaacaugugcccaaggu

SEQ ID NO: 5837 - RNA, 20 nt, Artificial Sequence
  targeting sequence with GTCN PAM
cgggccguggucacucauac

SEQ ID NO: 5838 - RNA, 20 nt, Artificial Sequence
  targeting sequence with GTCN PAM
cucauacuggacucagaaua

SEQ ID NO: 5839 - RNA, 20 nt, Artificial Sequence
  targeting sequence with GTCN PAM
aguaugagugaccacggccc

SEQ ID NO: 5840 - RNA, 20 nt, Artificial Sequence
  targeting sequence with GTCN PAM
uuucaaauacuuuacacagu

SEQ ID NO: 5841 - RNA, 20 nt, Artificial Sequence
  targeting sequence with GTCN PAM
aacuguguaaaguauuugaa

SEQ ID NO: 5842 - RNA, 20 nt, Artificial Sequence
  targeting sequence with GTCN PAM
auagacgcaaagcccaacca

SEQ ID NO: 5843 - RNA, 20 nt, Artificial Sequence
  targeting sequence with GTCN PAM
auugacgaaaagagucaaac

SEQ ID NO: 5844 - RNA, 20 nt, Artificial Sequence
  targeting sequence with GTCN PAM
gcuugcuggagcgcguacac

SEQ ID NO: 5845 - RNA, 20 nt, Artificial Sequence
  targeting sequence with GTCN PAM
guggguauugucggcuugcu

SEQ ID NO: 5846 - RNA, 20 nt, Artificial Sequence
  targeting sequence with GTCN PAM
ccugguaaggaggccuuccc

SEQ ID NO: 5847 - RNA, 20 nt, Artificial Sequence
  targeting sequence with GTCN PAM
uaauccguggccaucugcgu

SEQ ID NO: 5848 - RNA, 20 nt, Artificial Sequence
  targeting sequence with GTCN PAM
gccucggccuuccaaaguuc

SEQ ID NO: 5849 - RNA, 20 nt, Artificial Sequence
  targeting sequence with GTCN PAM
ggcguuccagaccagccugg

SEQ ID NO: 5850 - RNA, 20 nt, Artificial Sequence
  targeting sequence with GTCN PAM
ggaacgccugaccucaagug

SEQ ID NO: 5851 - RNA, 20 nt, Artificial Sequence
  targeting sequence with GTCN PAM
cagcuacuuggcaggcugag

SEQ ID NO: 5852 - RNA, 20 nt, Artificial Sequence
  targeting sequence with GTCN PAM
cacuuugcuucccaggcugg

SEQ ID NO: 5853 - RNA, 20 nt, Artificial Sequence
  targeting sequence with GTCN PAM
caaaaacaaacaaacaaaca

SEQ ID NO: 5854 - RNA, 20 nt, Artificial Sequence
  targeting sequence with GTCN PAM
ugacagggaaaaggcaagca

SEQ ID NO: 5855 - RNA, 20 nt, Artificial Sequence
  targeting sequence with GTCN PAM
ggacccagagguuaccuccc

SEQ ID NO: 5856 - RNA, 20 nt, Artificial Sequence
  targeting sequence with GTCN PAM
uuaaaaaaaagacaugucaa

SEQ ID NO: 5857 - RNA, 20 nt, Artificial Sequence
  targeting sequence with GTCN PAM
uuuuuuuaaggacccggagc

SEQ ID NO: 5858 - RNA, 20 nt, Artificial Sequence
  targeting sequence with GTCN PAM
aagaaagagugcugcagaaa

SEQ ID NO: 5859 - RNA, 20 nt, Artificial Sequence
  targeting sequence with GTCN PAM
caacucagaaagaauuccaa

SEQ ID NO: 5860 - RNA, 20 nt, Artificial Sequence
  targeting sequence with GTCN PAM
ggagagaucaagaccgacuu

SEQ ID NO: 5861 - RNA, 20 nt, Artificial Sequence
  targeting sequence with GTCN PAM
ugaucucuccugaccgcuag

SEQ ID NO: 5862 - RNA, 20 nt, Artificial Sequence
  targeting sequence with GTCN PAM
gucuugaucucuccugaccg

SEQ ID NO: 5863 - RNA, 20 nt, Artificial Sequence
  targeting sequence with GTCN PAM
caucacuauuuacuauguaa

SEQ ID NO: 5864 - RNA, 20 nt, Artificial Sequence
  targeting sequence with GTCN PAM
cuauuuugcauauguggaag

SEQ ID NO: 5865 - RNA, 20 nt, Artificial Sequence
  targeting sequence with GTCN PAM
aaacuaccuugcuuuguuuu

SEQ ID NO: 5866 - RNA, 20 nt, Artificial Sequence
  targeting sequence with GTCN PAM
uaagcgaucucucgccucag

SEQ ID NO: 5867 - RNA, 20 nt, Artificial Sequence
  targeting sequence with GTCN PAM
aauuuuuaagcuuguucuug

SEQ ID NO: 5868 - RNA, 20 nt, Artificial Sequence
  targeting sequence with GTCN PAM
cacucuguugcacaggcugg

SEQ ID NO: 5869 - RNA, 20 nt, Artificial Sequence
  targeting sequence with GTCN PAM
cuugaaccugggaggcagaa

SEQ ID NO: 5870 - RNA, 20 nt, Artificial Sequence
  targeting sequence with GTCN PAM
agugugguggcgcacaccug

SEQ ID NO: 5871 - RNA, 20 nt, Artificial Sequence
  targeting sequence with GTCN PAM
cuacugaaaauuaaaaaaaa

SEQ ID NO: 5872 - RNA, 20 nt, Artificial Sequence
  targeting sequence with GTCN PAM
cacuauguuggucaaccugg

SEQ ID NO: 5873 - RNA, 20 nt, Artificial Sequence
  targeting sequence with GTCN PAM
accuggucucaaacuccuga

SEQ ID NO: 5874 - RNA, 20 nt, Artificial Sequence
  targeting sequence with GTCN PAM
caaacuccugaccucaggug

SEQ ID NO: 5875 - RNA, 20 nt, Artificial Sequence
  targeting sequence with GTCN PAM
ggaguuugagaccagguuga

SEQ ID NO: 5876 - RNA, 20 nt, Artificial Sequence
  targeting sequence with GTCN PAM
cugccucucaggccagggca

SEQ ID NO: 5877 - RNA, 20 nt, Artificial Sequence
  targeting sequence with GTCN PAM
caguugucucaggcgaagcu

SEQ ID NO: 5878 - RNA, 20 nt, Artificial Sequence
  targeting sequence with GTCN PAM
caggcgaagcugccccuccu

SEQ ID NO: 5879 - RNA, 20 nt, Artificial Sequence
  targeting sequence with GTCN PAM
guggcaaucaucuaacucca

SEQ ID NO: 5880 - RNA, 20 nt, Artificial Sequence
  targeting sequence with GTCN PAM
uagcaucuucauauguaaag

SEQ ID NO: 5881 - RNA, 20 nt, Artificial Sequence
  targeting sequence with GTCN PAM
auuuaaccgaaggccugucu

SEQ ID NO: 5882 - RNA, 20 nt, Artificial Sequence
  targeting sequence with GTCN PAM
gaucucuacagggcccugcu

SEQ ID NO: 5883 - RNA, 20 nt, Artificial Sequence
  targeting sequence with GTCN PAM
cacugcaggcauucuggcca

SEQ ID NO: 5884 - RNA, 20 nt, Artificial Sequence
  targeting sequence with GTCN PAM
agaagcaggggcagguccag

SEQ ID NO: 5885 - RNA, 20 nt, Artificial Sequence
  targeting sequence with GTCN PAM
aggccccucccaccucaugg

SEQ ID NO: 5886 - RNA, 20 nt, Artificial Sequence
  targeting sequence with GTCN PAM
cccacggaugcugcccacgg

SEQ ID NO: 5887 - RNA, 20 nt, Artificial Sequence
  targeting sequence with GTCN PAM
ccugcugcuugacucaaauc

SEQ ID NO: 5888 - RNA, 20 nt, Artificial Sequence
  targeting sequence with GTCN PAM
agcagcaggugacaacccgu

SEQ ID NO: 5889 - RNA, 20 nt, Artificial Sequence
  targeting sequence with GTCN PAM
ucucuaagaaaauggccucc

SEQ ID NO: 5890 - RNA, 20 nt, Artificial Sequence
  targeting sequence with GTCN PAM
cggggaaauguucuuuuauc

SEQ ID NO: 5891 - RNA, 20 nt, Artificial Sequence
  targeting sequence with GTCN PAM
uugcugauucugguuuuaga

SEQ ID NO: 5892 - RNA, 20 nt, Artificial Sequence
  targeting sequence with GTCN PAM
guggcugcuuuccugcugca

SEQ ID NO: 5893 - RNA, 20 nt, Artificial Sequence
  targeting sequence with GTCN PAM
caacuacucagcucuguguu

SEQ ID NO: 5894 - RNA, 20 nt, Artificial Sequence
  targeting sequence with GTCN PAM
gucgcaacuacucagcucug

SEQ ID NO: 5895 - RNA, 20 nt, Artificial Sequence
  targeting sequence with GTCN PAM
ugucugucgcaacuacucag

SEQ ID NO: 5896 - RNA, 20 nt, Artificial Sequence
  targeting sequence with GTCN PAM
ugcucugccauccagguuug

SEQ ID NO: 5897 - RNA, 20 nt, Artificial Sequence
  targeting sequence with GTCN PAM
ccuuauguugccuaggcugg

SEQ ID NO: 5898 - RNA, 20 nt, Artificial Sequence
  targeting sequence with GTCN PAM
ccuuauguuggauaugugua

SEQ ID NO: 5899 - RNA, 20 nt, Artificial Sequence
  targeting sequence with GTCN PAM
aucuaucuaucuaucuaucu

SEQ ID NO: 5900 - RNA, 20 nt, Artificial Sequence
  targeting sequence with GTCN PAM
gucuaucuaucuaucuaucu

SEQ ID NO: 5901 - RNA, 20 nt, Artificial Sequence
  targeting sequence with GTCN PAM
gucugucuaucuaucuaucu

SEQ ID NO: 5902 - RNA, 20 nt, Artificial Sequence
  targeting sequence with GTCN PAM
gucagucugucuaucuaucu

SEQ ID NO: 5903 - RNA, 20 nt, Artificial Sequence
  targeting sequence with GTCN PAM
gucggucagucugucuaucu

SEQ ID NO: 5904 - RNA, 20 nt, Artificial Sequence
  targeting sequence with GTCN PAM
aaaugcugugggaagccaag

SEQ ID NO: 5905 - RNA, 20 nt, Artificial Sequence
  targeting sequence with GTCN PAM
ucucccugggcuacaaggcc

SEQ ID NO: 5906 - RNA, 20 nt, Artificial Sequence
  targeting sequence with GTCN PAM
auggcauaccauucacccuu

SEQ ID NO: 5907 - RNA, 20 nt, Artificial Sequence
  targeting sequence with GTCN PAM
ggguggcuggguggaauggg

SEQ ID NO: 5908 - RNA, 20 nt, Artificial Sequence
  targeting sequence with GTCN PAM
cuugcaagcuauccuacccc

SEQ ID NO: 5909 - RNA, 20 nt, Artificial Sequence
  targeting sequence with GTCN PAM
ugggggaagcacaaucuagg

SEQ ID NO: 5910 - RNA, 20 nt, Artificial Sequence
  targeting sequence with GTCN PAM
aucacucagaugucagcucc

SEQ ID NO: 5911 - RNA, 20 nt, Artificial Sequence
  targeting sequence with GTCN PAM
gcuccaaugucugcuucuca

SEQ ID NO: 5912 - RNA, 20 nt, Artificial Sequence
  targeting sequence with GTCN PAM
gcuucucagagaggccgucc

SEQ ID NO: 5913 - RNA, 20 nt, Artificial Sequence
  targeting sequence with GTCN PAM
cugaccaccagcccuuuagg

SEQ ID NO: 5914 - RNA, 20 nt, Artificial Sequence
  targeting sequence with GTCN PAM
gggacggccucucugagaag

SEQ ID NO: 5915 - RNA, 20 nt, Artificial Sequence
  targeting sequence with GTCN PAM
cugcccugguucagaccuuc

SEQ ID NO: 5916 - RNA, 20 nt, Artificial Sequence
  targeting sequence with GTCN PAM
gaaccagggcagggacaaug

SEQ ID NO: 5917 - RNA, 20 nt, Artificial Sequence
  targeting sequence with GTCN PAM
caagcugaaauaauauccug

SEQ ID NO: 5918 - RNA, 20 nt, Artificial Sequence
  targeting sequence with GTCN PAM
ggauauuauuucagcuugag

SEQ ID NO: 5919 - RNA, 20 nt, Artificial Sequence
  targeting sequence with GTCN PAM
ggauugcuauuccugcuuua

SEQ ID NO: 5920 - RNA, 20 nt, Artificial Sequence
  targeting sequence with GTCN PAM
gcagaggucaggauugcuau

SEQ ID NO: 5921 - RNA, 20 nt, Artificial Sequence
  targeting sequence with GTCN PAM
uggcaggggugccuucuucc

SEQ ID NO: 5922 - RNA, 20 nt, Artificial Sequence
  targeting sequence with GTCN PAM
aaagaggcaagaguuugagc

SEQ ID NO: 5923 - RNA, 20 nt, Artificial Sequence
  targeting sequence with GTCN PAM
cucacuuugucuaaagaggc

SEQ ID NO: 5924 - RNA, 20 nt, Artificial Sequence
  targeting sequence with GTCN PAM
gggugucucucacuuugucu

SEQ ID NO: 5925 - RNA, 20 nt, Artificial Sequence
  targeting sequence with GTCN PAM
ucugggacaaacaccgccac

SEQ ID NO: 5926 - RNA, 20 nt, Artificial Sequence
  targeting sequence with GTCN PAM
cagaugacggugcuccugcu

SEQ ID NO: 5927 - RNA, 20 nt, Artificial Sequence
  targeting sequence with GTCN PAM
gcucuuucuggcugcuuaua

SEQ ID NO: 5928 - RNA, 20 nt, Artificial Sequence
  targeting sequence with GTCN PAM
guguuuuacugucugcucuu

SEQ ID NO: 5929 - RNA, 20 nt, Artificial Sequence
  targeting sequence with GTCN PAM
ugucuguguuuuacugucug

SEQ ID NO: 5930 - RNA, 20 nt, Artificial Sequence
  targeting sequence with GTCN PAM
ggggaaagucucuuggguga

SEQ ID NO: 5931 - RNA, 20 nt, Artificial Sequence
  targeting sequence with GTCN PAM
cuugggugacugccaaacuu

SEQ ID NO: 5932 - RNA, 20 nt, Artificial Sequence
  targeting sequence with GTCN PAM
cccaagagacuuucccccga

SEQ ID NO: 5933 - RNA, 20 nt, Artificial Sequence
  targeting sequence with GTCN PAM
gcuuuuagcuucccuaucuu

SEQ ID NO: 5934 - RNA, 20 nt, Artificial Sequence
  targeting sequence with GTCN PAM
guuuccauacaucuuucugc

SEQ ID NO: 5935 - RNA, 20 nt, Artificial Sequence
  targeting sequence with GTCN PAM
cuuuguuguguuuaucuggg

SEQ ID NO: 5936 - RNA, 20 nt, Artificial Sequence
  targeting sequence with GTCN PAM
aagccucugauaaacucuuc

SEQ ID NO: 5937 - RNA, 20 nt, Artificial Sequence
  targeting sequence with GTCN PAM
guaagagaauguggcucuga

SEQ ID NO: 5938 - RNA, 20 nt, Artificial Sequence
  targeting sequence with GTCN PAM
gagccacauucucuuacaga

SEQ ID NO: 5939 - RNA, 20 nt, Artificial Sequence
  targeting sequence with GTCN PAM
uugacuauugagccaccuuu

SEQ ID NO: 5940 - RNA, 20 nt, Artificial Sequence
  targeting sequence with GTCN PAM
aagacagguuuauuuuagag

SEQ ID NO: 5941 - RNA, 20 nt, Artificial Sequence
  targeting sequence with GTCN PAM
accuaucuuacccacuauug

SEQ ID NO: 5942 - RNA, 20 nt, Artificial Sequence
  targeting sequence with GTCN PAM
ucacugaguucuuuuucccu

SEQ ID NO: 5943 - RNA, 20 nt, Artificial Sequence
  targeting sequence with GTCN PAM
gcugcuuggcuuuguguuua

SEQ ID NO: 5944 - RNA, 20 nt, Artificial Sequence
  targeting sequence with GTCN PAM
uguuauuucccaguaaguaa

SEQ ID NO: 5945 - RNA, 20 nt, Artificial Sequence
  targeting sequence with GTCN PAM
uugaaaugacucacagccag

SEQ ID NO: 5946 - RNA, 20 nt, Artificial Sequence
  targeting sequence with GTCN PAM
uuucaaugaccacagugugc

SEQ ID NO: 5947 - RNA, 20 nt, Artificial Sequence
  targeting sequence with GTCN PAM
ccucaaguugggcugcuuuc

SEQ ID NO: 5948 - RNA, 20 nt, Artificial Sequence
  targeting sequence with GTCN PAM
agcacauuuuuaaggucacc

SEQ ID NO: 5949 - RNA, 20 nt, Artificial Sequence
  targeting sequence with GTCN PAM
ccaccccaacaguaguaauc

SEQ ID NO: 5950 - RNA, 20 nt, Artificial Sequence
  targeting sequence with GTCN PAM
cuccugcaugugucaccacc

SEQ ID NO: 5951 - RNA, 20 nt, Artificial Sequence
  targeting sequence with GTCN PAM
cugccucucucagagcucag

SEQ ID NO: 5952 - RNA, 20 nt, Artificial Sequence
  targeting sequence with GTCN PAM
caaccagcugcccugcagag

SEQ ID NO: 5953 - RNA, 20 nt, Artificial Sequence
  targeting sequence with GTCN PAM
agucucaaccagcugcccug

SEQ ID NO: 5954 - RNA, 20 nt, Artificial Sequence
  targeting sequence with GTCN PAM
uccaggagauuuucaauguc

SEQ ID NO: 5955 - RNA, 20 nt, Artificial Sequence
  targeting sequence with GTCN PAM
ccaaaugagccacuccagug

SEQ ID NO: 5956 - RNA, 20 nt, Artificial Sequence
  targeting sequence with GTCN PAM
caccaagaggaguuacucag

SEQ ID NO: 5957 - RNA, 20 nt, Artificial Sequence
  targeting sequence with GTCN PAM
cacaggagcccuggaggagg

SEQ ID NO: 5958 - RNA, 20 nt, Artificial Sequence
  targeting sequence with GTCN PAM
ucccugagucacacaggagc

SEQ ID NO: 5959 - RNA, 20 nt, Artificial Sequence
  targeting sequence with GTCN PAM
auuucuaauuugccucugug

SEQ ID NO: 5960 - RNA, 20 nt, Artificial Sequence
  targeting sequence with GTCN PAM
ggacagauguggccccacaa

SEQ ID NO: 5961 - RNA, 20 nt, Artificial Sequence
  targeting sequence with GTCN PAM
agacaaggcacagaggcaaa

SEQ ID NO: 5962 - RNA, 20 nt, Artificial Sequence
  targeting sequence with GTCN PAM
acaguuguaaagguuguaca

SEQ ID NO: 5963 - RNA, 20 nt, Artificial Sequence
  targeting sequence with GTCN PAM
aaggccuccucacuauuaau

SEQ ID NO: 5964 - RNA, 20 nt, Artificial Sequence
  targeting sequence with GTCN PAM
cuggaaaggcuugccauuug

SEQ ID NO: 5965 - RNA, 20 nt, Artificial Sequence
  targeting sequence with GTCN PAM
guucucagccucucaggugg

SEQ ID NO: 5966 - RNA, 20 nt, Artificial Sequence
  targeting sequence with GTCN PAM
cagcccuuguucuuagagga

SEQ ID NO: 5967 - RNA, 20 nt, Artificial Sequence
  targeting sequence with GTCN PAM
uugaauggacacagugguag

SEQ ID NO: 5968 - RNA, 20 nt, Artificial Sequence
  targeting sequence with GTCN PAM
auucaaagacaaaugagucc

SEQ ID NO: 5969 - RNA, 20 nt, Artificial Sequence
  targeting sequence with GTCN PAM
gccaaaacuggggaacacac

SEQ ID NO: 5970 - RNA, 20 nt, Artificial Sequence
  targeting sequence with GTCN PAM
ugggagcaagcauggugcag

SEQ ID NO: 5971 - RNA, 20 nt, Artificial Sequence
  targeting sequence with GTCN PAM
auggcucagcaaaggagcag

SEQ ID NO: 5972 - RNA, 20 nt, Artificial Sequence
  targeting sequence with GTCN PAM
cucugaagaaccaagaggug

SEQ ID NO: 5973 - RNA, 20 nt, Artificial Sequence
  targeting sequence with GTCN PAM
gagucccucugaagaaccaa

SEQ ID NO: 5974 - RNA, 20 nt, Artificial Sequence
  targeting sequence with GTCN PAM
ucucucuccucaggucggag

SEQ ID NO: 5975 - RNA, 20 nt, Artificial Sequence
  targeting sequence with GTCN PAM
uucgugguuuuaaauuauua

SEQ ID NO: 5976 - RNA, 20 nt, Artificial Sequence
  targeting sequence with GTCN PAM
acucccuaaaguuguuuaag

SEQ ID NO: 5977 - RNA, 20 nt, Artificial Sequence
  targeting sequence with GTCN PAM
uuguuuggguuucuuuuaag

SEQ ID NO: 5978 - RNA, 20 nt, Artificial Sequence
  targeting sequence with GTCN PAM
cccaggcuggaguguagugg

SEQ ID NO: 5979 - RNA, 20 nt, Artificial Sequence
  targeting sequence with GTCN PAM
gaugggaggaucacuugagc

SEQ ID NO: 5980 - RNA, 20 nt, Artificial Sequence
  targeting sequence with GTCN PAM
cagcuacaugggagggucag

SEQ ID NO: 5981 - RNA, 20 nt, Artificial Sequence
  targeting sequence with GTCN PAM
ucccagcuacaugggagggu

SEQ ID NO: 5982 - RNA, 20 nt, Artificial Sequence
  targeting sequence with GTCN PAM
cacuguguuacccaggcuga

SEQ ID NO: 5983 - RNA, 20 nt, Artificial Sequence
  targeting sequence with GTCN PAM
ucucacuuuggccuuccaaa

SEQ ID NO: 5984 - RNA, 20 nt, Artificial Sequence
  targeting sequence with GTCN PAM
agaugaauuacguuuuuaua

SEQ ID NO: 5985 - RNA, 20 nt, Artificial Sequence
  targeting sequence with GTCN PAM
gauaaggccaggcgcagugg

SEQ ID NO: 5986 - RNA, 20 nt, Artificial Sequence
  targeting sequence with GTCN PAM
agagaucaagaccauccugg

SEQ ID NO: 5987 - RNA, 20 nt, Artificial Sequence
  targeting sequence with GTCN PAM
ugaucucuugaccuugugau

SEQ ID NO: 5988 - RNA, 20 nt, Artificial Sequence
  targeting sequence with GTCN PAM
caacuacucgggagucugag

SEQ ID NO: 5989 - RNA, 20 nt, Artificial Sequence
  targeting sequence with GTCN PAM
gaggcaggaaaauugcuuga

SEQ ID NO: 5990 - RNA, 20 nt, Artificial Sequence
  targeting sequence with GTCN PAM
ccaggcuggagugcgguggu

SEQ ID NO: 5991 - RNA, 20 nt, Artificial Sequence
  targeting sequence with GTCN PAM
cacucugucaccaggcugga

SEQ ID NO: 5992 - RNA, 20 nt, Artificial Sequence
  targeting sequence with GTCN PAM
gugucauacugcucaacucu

SEQ ID NO: 5993 - RNA, 20 nt, Artificial Sequence
  targeting sequence with GTCN PAM
uacugcucaacucugccauu

SEQ ID NO: 5994 - RNA, 20 nt, Artificial Sequence
  targeting sequence with GTCN PAM
auggcugcuuucaugcuaca

SEQ ID NO: 5995 - RNA, 20 nt, Artificial Sequence
  targeting sequence with GTCN PAM
agccugcuuccuguuuuuua

SEQ ID NO: 5996 - RNA, 20 nt, Artificial Sequence
  targeting sequence with GTCN PAM
cuugagccacaguuugcaga

SEQ ID NO: 5997 - RNA, 20 nt, Artificial Sequence
  targeting sequence with GTCN PAM
gcaaacuguggcucaagaga

SEQ ID NO: 5998 - RNA, 20 nt, Artificial Sequence
  targeting sequence with GTCN PAM
aguagaggagcuacuugcca

SEQ ID NO: 5999 - RNA, 20 nt, Artificial Sequence
  targeting sequence with GTCN PAM
cauguggcaaguagcuccuc

SEQ ID NO: 6000 - RNA, 20 nt, Artificial Sequence
  targeting sequence with GTCN PAM
uucaaucacaccagccacau

SEQ ID NO: 6001 - RNA, 20 nt, Artificial Sequence
  targeting sequence with GTCN PAM
auagaccaguacuacaggca

SEQ ID NO: 6002 - RNA, 20 nt, Artificial Sequence
  targeting sequence with GTCN PAM
auggaccacacuuuuacuuu

SEQ ID NO: 6003 - RNA, 20 nt, Artificial Sequence
  targeting sequence with GTCN PAM
ucaaaagaugcuguauuucu

SEQ ID NO: 6004 - RNA, 20 nt, Artificial Sequence
  targeting sequence with GTCN PAM
gaagcugcauuucgacagga

SEQ ID NO: 6005 - RNA, 20 nt, Artificial Sequence
  targeting sequence with GTCN PAM
aaaugcagcuucugacccag

SEQ ID NO: 6006 - RNA, 20 nt, Artificial Sequence
  targeting sequence with GTCN PAM
ugucgaaaugcagcuucuga

SEQ ID NO: 6007 - RNA, 20 nt, Artificial Sequence
  targeting sequence with GTCN PAM
cuggcauauaaguuacaugg

SEQ ID NO: 6008 - RNA, 20 nt, Artificial Sequence
  targeting sequence with GTCN PAM
ccaacugucacuggcauaua

SEQ ID NO: 6009 - RNA, 20 nt, Artificial Sequence
  targeting sequence with GTCN PAM
gcugugcaagacagggauuc

SEQ ID NO: 6010 - RNA, 20 nt, Artificial Sequence
  targeting sequence with GTCN PAM
ugcacagcagaccccaaaac

SEQ ID NO: 6011 - RNA, 20 nt, Artificial Sequence
  targeting sequence with GTCN PAM
accucauaaccagccagcua

SEQ ID NO: 6012 - RNA, 20 nt, Artificial Sequence
  targeting sequence with GTCN PAM
guggaguccaccucauaacc

SEQ ID NO: 6013 - RNA, 20 nt, Artificial Sequence
  targeting sequence with GTCN PAM
gacuggugcggggcagauau

SEQ ID NO: 6014 - RNA, 20 nt, Artificial Sequence
  targeting sequence with GTCN PAM
gaccuugaaaacccccaccu

SEQ ID NO: 6015 - RNA, 20 nt, Artificial Sequence
  targeting sequence with GTCN PAM
gccuuauuacuuauuaaggc

SEQ ID NO: 6016 - RNA, 20 nt, Artificial Sequence
  targeting sequence with GTCN PAM
acuucucaguugaaccagaa

SEQ ID NO: 6017 - RNA, 20 nt, Artificial Sequence
  targeting sequence with GTCN PAM
uguacuccuaccugcauagc

SEQ ID NO: 6018 - RNA, 20 nt, Artificial Sequence
  targeting sequence with GTCN PAM
gucauguacuccuaccugca

SEQ ID NO: 6019 - RNA, 20 nt, Artificial Sequence
  targeting sequence with GTCN PAM
cgccagauggugccccagcu

SEQ ID NO: 6020 - RNA, 20 nt, Artificial Sequence
  targeting sequence with GTCN PAM
ccuuugaacucucuccucug

SEQ ID NO: 6021 - RNA, 20 nt, Artificial Sequence
  targeting sequence with GTCN PAM
ccagaguuagggacuaagga

SEQ ID NO: 6022 - RNA, 20 nt, Artificial Sequence
  targeting sequence with GTCN PAM
cuaacucuggggacugcauc

SEQ ID NO: 6023 - RNA, 20 nt, Artificial Sequence
  targeting sequence with GTCN PAM
ucuccuuagucccuaacucu

SEQ ID NO: 6024 - RNA, 20 nt, Artificial Sequence
  targeting sequence with GTCN PAM
cccaggcauuuuguggccaa

SEQ ID NO: 6025 - RNA, 20 nt, Artificial Sequence
  targeting sequence with GTCN PAM
aaccagucaguaugcguaau

SEQ ID NO: 6026 - RNA, 20 nt, Artificial Sequence
  targeting sequence with GTCN PAM
guaugcguaaucccacuggu

SEQ ID NO: 6027 - RNA, 20 nt, Artificial Sequence
  targeting sequence with GTCN PAM
ggucucucagugcaccaaaa

SEQ ID NO: 6028 - RNA, 20 nt, Artificial Sequence
  targeting sequence with GTCN PAM
cucagugcaccaaaaccuau

SEQ ID NO: 6029 - RNA, 20 nt, Artificial Sequence
  targeting sequence with GTCN PAM
gagcugagcgccuuucgcac

SEQ ID NO: 6030 - RNA, 20 nt, Artificial Sequence
  targeting sequence with GTCN PAM
guagccacggcaacagguug

SEQ ID NO: 6031 - RNA, 20 nt, Artificial Sequence
  targeting sequence with GTCN PAM
cguguuaagagcgagcccgc

SEQ ID NO: 6032 - RNA, 20 nt, Artificial Sequence
  targeting sequence with GTCN PAM
aauaauaauuuauuuuaaaa

SEQ ID NO: 6033 - RNA, 20 nt, Artificial Sequence
  targeting sequence with GTCN PAM
aucuuaaacucugcagcuuu

SEQ ID NO: 6034 - RNA, 20 nt, Artificial Sequence
  targeting sequence with GTCN PAM
ugauauuuauuuaauuugug

SEQ ID NO: 6035 - RNA, 20 nt, Artificial Sequence
  targeting sequence with GTCN PAM
ucagggugcaccuggaagaa

SEQ ID NO: 6036 - RNA, 20 nt, Artificial Sequence
  targeting sequence with GTCN PAM
cugccucuguaucuuauguu

SEQ ID NO: 6037 - RNA, 20 nt, Artificial Sequence
  targeting sequence with GTCN PAM
ugcuucagcccuguugaaua

SEQ ID NO: 6038 - RNA, 20 nt, Artificial Sequence
  targeting sequence with GTCN PAM
ccacaaacguagucugagac

SEQ ID NO: 6039 - RNA, 20 nt, Artificial Sequence
  targeting sequence with GTCN PAM
gagaccacuaagagaaaccc

SEQ ID NO: 6040 - RNA, 20 nt, Artificial Sequence
  targeting sequence with GTCN PAM
cagacuacguuuguggugac

SEQ ID NO: 6041 - RNA, 20 nt, Artificial Sequence
  targeting sequence with GTCN PAM
aaaguacaccacuacaggaa

SEQ ID NO: 6042 - RNA, 20 nt, Artificial Sequence
  targeting sequence with GTCN PAM
ggcuuagagauagcacacaa

SEQ ID NO: 6043 - RNA, 20 nt, Artificial Sequence
  targeting sequence with GTCN PAM
uucccuauuugugugcuauc

SEQ ID NO: 6044 - RNA, 20 nt, Artificial Sequence
  targeting sequence with GTCN PAM
ccucuggcccuguuccuguc

SEQ ID NO: 6045 - RNA, 20 nt, Artificial Sequence
  targeting sequence with GTCN PAM
gaggccacgccgcuggacug

SEQ ID NO: 6046 - RNA, 20 nt, Artificial Sequence
  targeting sequence with GTCN PAM
agcggcguggccucugacuc

SEQ ID NO: 6047 - RNA, 20 nt, Artificial Sequence
  targeting sequence with GTCN PAM
uuguggacuugggagcgccu

SEQ ID NO: 6048 - RNA, 20 nt, Artificial Sequence
  targeting sequence with GTCN PAM
cugaggcaaaauaaguccac

SEQ ID NO: 6049 - RNA, 20 nt, Artificial Sequence
  targeting sequence with GTCN PAM
augaguggaagcaggugagg

SEQ ID NO: 6050 - RNA, 20 nt, Artificial Sequence
  targeting sequence with GTCN PAM
uugccauauuuaccaauccc

SEQ ID NO: 6051 - RNA, 20 nt, Artificial Sequence
  targeting sequence with GTCN PAM
gguauucaucugaagaauac

SEQ ID NO: 6052 - RNA, 20 nt, Artificial Sequence
  targeting sequence with GTCN PAM
gcuucuaaagacacccuccc

SEQ ID NO: 6053 - RNA, 20 nt, Artificial Sequence
  targeting sequence with GTCN PAM
uuagaagcugaccugauaau

SEQ ID NO: 6054 - RNA, 20 nt, Artificial Sequence
  targeting sequence with GTCN PAM
gugggagacugugguuuggg

SEQ ID NO: 6055 - RNA, 20 nt, Artificial Sequence
  targeting sequence with GTCN PAM
cccacugaccuaaacaauaa

SEQ ID NO: 6056 - RNA, 20 nt, Artificial Sequence
  targeting sequence with GTCN PAM
acuuuccccaaaccacaguc

SEQ ID NO: 6057 - RNA, 20 nt, Artificial Sequence
  targeting sequence with GTCN PAM
aguucucagguauuuuccua

SEQ ID NO: 6058 - RNA, 20 nt, Artificial Sequence
  targeting sequence with GTCN PAM
cuacgaucuucgggcaaaaa

SEQ ID NO: 6059 - RNA, 20 nt, Artificial Sequence
  targeting sequence with GTCN PAM
gaacuucuuaaaccucuugg

SEQ ID NO: 6060 - RNA, 20 nt, Artificial Sequence
  targeting sequence with GTCN PAM
gcgguucuugcuaccucagc

SEQ ID NO: 6061 - RNA, 20 nt, Artificial Sequence
  targeting sequence with GTCN PAM
uguaaucauucaguuacuuu

SEQ ID NO: 6062 - RNA, 20 nt, Artificial Sequence
  targeting sequence with GTCN PAM
guuggaugucauccagucuc

SEQ ID NO: 6063 - RNA, 20 nt, Artificial Sequence
  targeting sequence with GTCN PAM
cuacuaagacaaagaugaua

SEQ ID NO: 6064 - RNA, 20 nt, Artificial Sequence
  targeting sequence with GTCN PAM
uaguagagacagugugguag

SEQ ID NO: 6065 - RNA, 20 nt, Artificial Sequence
  targeting sequence with GTCN PAM
gauugagaaauauaguagcg

SEQ ID NO: 6066 - RNA, 20 nt, Artificial Sequence
  targeting sequence with GTCN PAM
ccuuuuaaucucguucaaga

SEQ ID NO: 6067 - RNA, 20 nt, Artificial Sequence
  targeting sequence with GTCN PAM
auuucuuaaaggcuuuacgu

SEQ ID NO: 6068 - RNA, 20 nt, Artificial Sequence
  targeting sequence with GTCN PAM
uggggggcuaagagcuaaac

SEQ ID NO: 6069 - RNA, 20 nt, Artificial Sequence
  targeting sequence with GTCN PAM
augguuuagcuuaaagcaau

SEQ ID NO: 6070 - RNA, 20 nt, Artificial Sequence
  targeting sequence with GTCN PAM
uuaguuagauuaauugggua

SEQ ID NO: 6071 - RNA, 20 nt, Artificial Sequence
  targeting sequence with GTCN PAM
uuaucuguaaaguggagaua

SEQ ID NO: 6072 - RNA, 20 nt, Artificial Sequence
  targeting sequence with GTCN PAM
uuaaaguauuuuuuagacua

SEQ ID NO: 6073 - RNA, 20 nt, Artificial Sequence
  targeting sequence with GTCN PAM
aaaaaauacuuuaaugacca

SEQ ID NO: 6074 - RNA, 20 nt, Artificial Sequence
  targeting sequence with GTCN PAM
uguuuuucacaucaaaaaua

SEQ ID NO: 6075 - RNA, 20 nt, Artificial Sequence
  targeting sequence with GTCN PAM
ggaugguuaccucuauuuua

SEQ ID NO: 6076 - RNA, 20 nt, Artificial Sequence
  targeting sequence with GTCN PAM
aucccaguaucauuuuggga

SEQ ID NO: 6077 - RNA, 20 nt, Artificial Sequence
  targeting sequence with GTCN PAM
aguucucaacaugagaugaa

SEQ ID NO: 6078 - RNA, 20 nt, Artificial Sequence
  targeting sequence with GTCN PAM
cccuuuuaucucuuauucac

SEQ ID NO: 6079 - RNA, 20 nt, Artificial Sequence
  targeting sequence with GTCN PAM
uuauaauaccucagugaaua

SEQ ID NO: 6080 - RNA, 20 nt, Artificial Sequence
  targeting sequence with GTCN PAM
uuuuuaucuucuauuuuaau

SEQ ID NO: 6081 - RNA, 20 nt, Artificial Sequence
  targeting sequence with GTCN PAM
uuccugguuggugagcaguu

SEQ ID NO: 6082 - RNA, 20 nt, Artificial Sequence
  targeting sequence with GTCN PAM
auuucagagccacguuuuaa

SEQ ID NO: 6083 - RNA, 20 nt, Artificial Sequence
  targeting sequence with GTCN PAM
guaugcaaauguucuuuccu

SEQ ID NO: 6084 - RNA, 20 nt, Artificial Sequence
  targeting sequence with GTCN PAM
uuggcugaacaaaauuuguu

SEQ ID NO: 6085 - RNA, 20 nt, Artificial Sequence
  targeting sequence with GTCN PAM
ccuuuccuuugggcuuucua

SEQ ID NO: 6086 - RNA, 20 nt, Artificial Sequence
  targeting sequence with GTCN PAM
ugagguuccaguuugaauug

SEQ ID NO: 6087 - RNA, 20 nt, Artificial Sequence
  targeting sequence with GTCN PAM
gggcugccaugcugcagucu

SEQ ID NO: 6088 - RNA, 20 nt, Artificial Sequence
  targeting sequence with GTCN PAM
agauauaaagacugcagcau

SEQ ID NO: 6089 - RNA, 20 nt, Artificial Sequence
  targeting sequence with GTCN PAM
cuccauuuuugugaagauaa

SEQ ID NO: 6090 - RNA, 20 nt, Artificial Sequence
  targeting sequence with GTCN PAM
uugugggcuagaaaaugaua

SEQ ID NO: 6091 - RNA, 20 nt, Artificial Sequence
  targeting sequence with GTCN PAM
cuucuauuuacuagcaguaa

SEQ ID NO: 6092 - RNA, 20 nt, Artificial Sequence
  targeting sequence with GTCN PAM
aguucuuuuaaaagucccuu

SEQ ID NO: 6093 - RNA, 20 nt, Artificial Sequence
  targeting sequence with GTCN PAM
uuuaaaaaugaaaaagagug

SEQ ID NO: 6094 - RNA, 20 nt, Artificial Sequence
  targeting sequence with GTCN PAM
ucccaaauaaccuuugcuuc

SEQ ID NO: 6095 - RNA, 20 nt, Artificial Sequence
  targeting sequence with GTCN PAM
cauguggaugggaaagaguu

SEQ ID NO: 6096 - RNA, 20 nt, Artificial Sequence
  targeting sequence with GTCN PAM
gucccauguggaugggaaag

SEQ ID NO: 6097 - RNA, 20 nt, Artificial Sequence
  targeting sequence with GTCN PAM
aagugauuaacuuauuuaaa

SEQ ID NO: 6098 - RNA, 20 nt, Artificial Sequence
  targeting sequence with GTCN PAM
guguggaccagucuugugcu

SEQ ID NO: 6099 - RNA, 20 nt, Artificial Sequence
  targeting sequence with GTCN PAM
acacugacuuuaaucucccu

SEQ ID NO: 6100 - RNA, 20 nt, Artificial Sequence
  targeting sequence with GTCN PAM
ugugcuaugggaguauuuuc

SEQ ID NO: 6101 - RNA, 20 nt, Artificial Sequence
  targeting sequence with GTCN PAM
uccaaaagcuucccauaucc

SEQ ID NO: 6102 - RNA, 20 nt, Artificial Sequence
  targeting sequence with GTCN PAM
agcuagaaacuuuucggauu

SEQ ID NO: 6103 - RNA, 20 nt, Artificial Sequence
  targeting sequence with GTCN PAM
ucucugcaaauaaaugaggu

SEQ ID NO: 6104 - RNA, 20 nt, Artificial Sequence
  targeting sequence with GTCN PAM
cucaauuuuaucaauaaauu

SEQ ID NO: 6105 - RNA, 20 nt, Artificial Sequence
  targeting sequence with GTCN PAM
guucugcaaguaauuuaacc

SEQ ID NO: 6106 - RNA, 20 nt, Artificial Sequence
  targeting sequence with GTCN PAM
accaaaucuuggucuaauac

SEQ ID NO: 6107 - RNA, 20 nt, Artificial Sequence
  targeting sequence with GTCN PAM
aauacuucucccccauacug

SEQ ID NO: 6108 - RNA, 20 nt, Artificial Sequence
  targeting sequence with GTCN PAM
caaacucuugggaucaggug

SEQ ID NO: 6109 - RNA, 20 nt, Artificial Sequence
  targeting sequence with GTCN PAM
uugcaaaaaaugaaaaaaaa

SEQ ID NO: 6110 - RNA, 20 nt, Artificial Sequence
  targeting sequence with GTCN PAM
cagcuacuaaggaggccggg

SEQ ID NO: 6111 - RNA, 20 nt, Artificial Sequence
  targeting sequence with GTCN PAM
uccuaccccggccuccuuag

SEQ ID NO: 6112 - RNA, 20 nt, Artificial Sequence
  targeting sequence with GTCN PAM
ggcaggucaaggcuucaggg

SEQ ID NO: 6113 - RNA, 20 nt, Artificial Sequence
  targeting sequence with GTCN PAM
aggcuucagggagcuaugau

SEQ ID NO: 6114 - RNA, 20 nt, Artificial Sequence
  targeting sequence with GTCN PAM
cccaggcuggagugcagugg

SEQ ID NO: 6115 - RNA, 20 nt, Artificial Sequence
  targeting sequence with GTCN PAM
cgcucugucacccaggcugg

SEQ ID NO: 6116 - RNA, 20 nt, Artificial Sequence
  targeting sequence with GTCN PAM
ucuaugaugaaaacauacuu

SEQ ID NO: 6117 - RNA, 20 nt, Artificial Sequence
  targeting sequence with GTCN PAM
agagagaucauuuaacccaa

SEQ ID NO: 6118 - RNA, 20 nt, Artificial Sequence
  targeting sequence with GTCN PAM
cuuaagaguuugugcugauu

SEQ ID NO: 6119 - RNA, 20 nt, Artificial Sequence
  targeting sequence with GTCN PAM
cgguaaaagacucuguaaaa

SEQ ID NO: 6120 - RNA, 20 nt, Artificial Sequence
  targeting sequence with GTCN PAM
uuuaccgagacuuugagaug

SEQ ID NO: 6121 - RNA, 20 nt, Artificial Sequence
  targeting sequence with GTCN PAM
aaugacuuccuaggauccuc

SEQ ID NO: 6122 - RNA, 20 nt, Artificial Sequence
  targeting sequence with GTCN PAM
uuagacuacgugugugauag

SEQ ID NO: 6123 - RNA, 20 nt, Artificial Sequence
  targeting sequence with GTCN PAM
ccuugggguuggaggauccu

SEQ ID NO: 6124 - RNA, 20 nt, Artificial Sequence
  targeting sequence with GTCN PAM
cccuagucaucuuagaugag

SEQ ID NO: 6125 - RNA, 20 nt, Artificial Sequence
  targeting sequence with GTCN PAM
ucuuagaugaggaagucgag

SEQ ID NO: 6126 - RNA, 20 nt, Artificial Sequence
  targeting sequence with GTCN PAM
agcgcaccccagggcugauc

SEQ ID NO: 6127 - RNA, 20 nt, Artificial Sequence
  targeting sequence with GTCN PAM
ggagcccaggugcucuuccu

SEQ ID NO: 6128 - RNA, 20 nt, Artificial Sequence
  targeting sequence with GTCN PAM
gcagaaaccucgaagcccac

SEQ ID NO: 6129 - RNA, 20 nt, Artificial Sequence
  targeting sequence with GTCN PAM
aagguuagaaaggcccacac

SEQ ID NO: 6130 - RNA, 20 nt, Artificial Sequence
  targeting sequence with GTCN PAM
acucucccgauaccauuuua

SEQ ID NO: 6131 - RNA, 20 nt, Artificial Sequence
  targeting sequence with GTCN PAM
ccuuuugggccucaguuuca

SEQ ID NO: 6132 - RNA, 20 nt, Artificial Sequence
  targeting sequence with GTCN PAM
uucggcgggucugggacuag

SEQ ID NO: 6133 - RNA, 20 nt, Artificial Sequence
  targeting sequence with GTCN PAM
gggacuaggcgcucacuaga

SEQ ID NO: 6134 - RNA, 20 nt, Artificial Sequence
  targeting sequence with GTCN PAM
cagacccgccgaaugaccuc

SEQ ID NO: 6135 - RNA, 20 nt, Artificial Sequence
  targeting sequence with GTCN PAM
ccucuagugagcgccuaguc

SEQ ID NO: 6136 - RNA, 20 nt, Artificial Sequence
  targeting sequence with GTCN PAM
cccagacucagacucuccag

SEQ ID NO: 6137 - RNA, 20 nt, Artificial Sequence
  targeting sequence with GTCN PAM
gggggaccgcggagcugccc

SEQ ID NO: 6138 - RNA, 20 nt, Artificial Sequence
  targeting sequence with GTCN PAM
gagucugggggaccgcggag

SEQ ID NO: 6139 - RNA, 20 nt, Artificial Sequence
  targeting sequence with GTCN PAM
ugcccaucgagcaggguccg

SEQ ID NO: 6140 - RNA, 20 nt, Artificial Sequence
  targeting sequence with GTCN PAM
ggcugcagcaacgagcccag

SEQ ID NO: 6141 - RNA, 20 nt, Artificial Sequence
  targeting sequence with GTCN PAM
gaauguugcgaaagcgcccc

SEQ ID NO: 6142 - RNA, 20 nt, Artificial Sequence
  targeting sequence with GTCN PAM
ggggcgcuuucgcaacauuc

SEQ ID NO: 6143 - RNA, 20 nt, Artificial Sequence
  targeting sequence with GTCN PAM
uccucgagaauggauuugau

SEQ ID NO: 6144 - RNA, 20 nt, Artificial Sequence
  targeting sequence with GTCN PAM
gggcgugugggggcggugcg

SEQ ID NO: 6145 - RNA, 20 nt, Artificial Sequence
  targeting sequence with GTCN PAM
gaaagggaaagccagaaaag

SEQ ID NO: 6146 - RNA, 20 nt, Artificial Sequence
  targeting sequence with GTCN PAM
ccacuccacaagccacuuug

SEQ ID NO: 6147 - RNA, 20 nt, Artificial Sequence
  targeting sequence with GTCN PAM
cagcaaccgccucacuaacg

SEQ ID NO: 6148 - RNA, 20 nt, Artificial Sequence
  targeting sequence with GTCN PAM
gucucagcaaccgccucacu

SEQ ID NO: 6149 - RNA, 20 nt, Artificial Sequence
  targeting sequence with GTCN PAM
acacggcccucaucacggcu

SEQ ID NO: 6150 - RNA, 20 nt, Artificial Sequence
  targeting sequence with GTCN PAM
aguccucgcggggagugcgc

SEQ ID NO: 6151 - RNA, 20 nt, Artificial Sequence
  targeting sequence with GTCN PAM
ucgcggggagugcgcgagcc

SEQ ID NO: 6152 - RNA, 20 nt, Artificial Sequence
  targeting sequence with GTCN PAM
cccaggccgggguucagugc

SEQ ID NO: 6153 - RNA, 20 nt, Artificial Sequence
  targeting sequence with GTCN PAM
cccucccgccccuuggcggu

SEQ ID NO: 6154 - RNA, 20 nt, Artificial Sequence
  targeting sequence with GTCN PAM
ggcccugucgcugccuugga

SEQ ID NO: 6155 - RNA, 20 nt, Artificial Sequence
  targeting sequence with GTCN PAM
cugccuuggauucaucucac

SEQ ID NO: 6156 - RNA, 20 nt, Artificial Sequence
  targeting sequence with GTCN PAM
cgugggugugagaugaaucc

SEQ ID NO: 6157 - RNA, 20 nt, Artificial Sequence
  targeting sequence with GTCN PAM
agaaaacaagaguaugggua

SEQ ID NO: 6158 - RNA, 20 nt, Artificial Sequence
  targeting sequence with GTCN PAM
cauuuauuuuaauuaugauu

SEQ ID NO: 6159 - RNA, 20 nt, Artificial Sequence
  targeting sequence with GTCN PAM
cuugcucuaaauguuaagau

SEQ ID NO: 6160 - RNA, 20 nt, Artificial Sequence
  targeting sequence with GTCN PAM
cuugcucuaaguguaaaagu

SEQ ID NO: 6161 - RNA, 20 nt, Artificial Sequence
  targeting sequence with GTCN PAM
gaaaaagaacugaaggggaa

SEQ ID NO: 6162 - RNA, 20 nt, Artificial Sequence
  targeting sequence with GTCN PAM
uuccccuucaguucuuuuuc

SEQ ID NO: 6163 - RNA, 20 nt, Artificial Sequence
  targeting sequence with GTCN PAM
ccuuuugauucaguuauuua

SEQ ID NO: 6164 - RNA, 20 nt, Artificial Sequence
  targeting sequence with GTCN PAM
uauuccauuguuaucgccua

SEQ ID NO: 6165 - RNA, 20 nt, Artificial Sequence
  targeting sequence with GTCN PAM
guuuugucauauucuuacuu

SEQ ID NO: 6166 - RNA, 20 nt, Artificial Sequence
  targeting sequence with GTCN PAM
uauucuuacuuaugggauag

SEQ ID NO: 6167 - RNA, 20 nt, Artificial Sequence
  targeting sequence with GTCN PAM
uggccugacuuugaaaauca

SEQ ID NO: 6168 - RNA, 20 nt, Artificial Sequence
  targeting sequence with GTCN PAM
ggccaagaccuaucccauaa

SEQ ID NO: 6169 - RNA, 20 nt, Artificial Sequence
  targeting sequence with GTCN PAM
uugguucugucccuucugag

SEQ ID NO: 6170 - RNA, 20 nt, Artificial Sequence
  targeting sequence with GTCN PAM
cuucugagaucuuucucugu

SEQ ID NO: 6171 - RNA, 20 nt, Artificial Sequence
  targeting sequence with GTCN PAM
cuccucaucucacacggaaa

SEQ ID NO: 6172 - RNA, 20 nt, Artificial Sequence
  targeting sequence with GTCN PAM
ccaacgugagccuugaagga

SEQ ID NO: 6173 - RNA, 20 nt, Artificial Sequence
  targeting sequence with GTCN PAM
ucucuuuuguguucggcacu

SEQ ID NO: 6174 - RNA, 20 nt, Artificial Sequence
  targeting sequence with GTCN PAM
gcuaccacuagugccgaaca

SEQ ID NO: 6175 - RNA, 20 nt, Artificial Sequence
  targeting sequence with GTCN PAM
ucaccacucucuaagguagg

SEQ ID NO: 6176 - RNA, 20 nt, Artificial Sequence
  targeting sequence with GTCN PAM
cacagugagggguggaacca

SEQ ID NO: 6177 - RNA, 20 nt, Artificial Sequence
  targeting sequence with GTCN PAM
uccucacuccaacgucaacg

SEQ ID NO: 6178 - RNA, 20 nt, Artificial Sequence
  targeting sequence with GTCN PAM
acgcucucagccacuacauu

SEQ ID NO: 6179 - RNA, 20 nt, Artificial Sequence
  targeting sequence with GTCN PAM
guaacauaaggaaaaauuaa

SEQ ID NO: 6180 - RNA, 20 nt, Artificial Sequence
  targeting sequence with GTCN PAM
gcaggagacaggcagguaac

SEQ ID NO: 6181 - RNA, 20 nt, Artificial Sequence
  targeting sequence with GTCN PAM
ccugcagacauuugaguuug

SEQ ID NO: 6182 - RNA, 20 nt, Artificial Sequence
  targeting sequence with GTCN PAM
uguauucuguaccccauuuu

SEQ ID NO: 6183 - RNA, 20 nt, Artificial Sequence
  targeting sequence with GTCN PAM
gaguaauagaguguggcaaa

SEQ ID NO: 6184 - RNA, 20 nt, Artificial Sequence
  targeting sequence with GTCN PAM
guugagcauaagaguuaauu

SEQ ID NO: 6185 - RNA, 20 nt, Artificial Sequence
  targeting sequence with GTCN PAM
aauaaacccguuaaaggcaa

SEQ ID NO: 6186 - RNA, 20 nt, Artificial Sequence
  targeting sequence with GTCN PAM
uacucguuuccaaauuauuc

SEQ ID NO: 6187 - RNA, 20 nt, Artificial Sequence
  targeting sequence with GTCN PAM
cuagaauaauuuggaaacga

SEQ ID NO: 6188 - RNA, 20 nt, Artificial Sequence
  targeting sequence with GTCN PAM
gugguuguuguuacuaugga

SEQ ID NO: 6189 - RNA, 20 nt, Artificial Sequence
  targeting sequence with GTCN PAM
caaaucuguaaugggccaaa

SEQ ID NO: 6190 - RNA, 20 nt, Artificial Sequence
  targeting sequence with GTCN PAM
auagaaccccuacaucccuu

SEQ ID NO: 6191 - RNA, 20 nt, Artificial Sequence
  targeting sequence with GTCN PAM
uuuuuuuuuuuguuuaguuu

SEQ ID NO: 6192 - RNA, 20 nt, Artificial Sequence
  targeting sequence with GTCN PAM
aagauuaguccuccacaucc

SEQ ID NO: 6193 - RNA, 20 nt, Artificial Sequence
  targeting sequence with GTCN PAM
uccacauccaaaucagccau

SEQ ID NO: 6194 - RNA, 20 nt, Artificial Sequence
  targeting sequence with GTCN PAM
cccggucugcuccuuugcuu

SEQ ID NO: 6195 - RNA, 20 nt, Artificial Sequence
  targeting sequence with GTCN PAM
gcuccuuugcuucuauuuua

SEQ ID NO: 6196 - RNA, 20 nt, Artificial Sequence
  targeting sequence with GTCN PAM
uaaaaaaacagaguuccugc

SEQ ID NO: 6197 - RNA, 20 nt, Artificial Sequence
  targeting sequence with GTCN PAM
agucgugcauuuugcuagag

SEQ ID NO: 6198 - RNA, 20 nt, Artificial Sequence
  targeting sequence with GTCN PAM
ugcauuuugcuagagggucc

SEQ ID NO: 6199 - RNA, 20 nt, Artificial Sequence
  targeting sequence with GTCN PAM
uccugacccuccuccccauc

SEQ ID NO: 6200 - RNA, 20 nt, Artificial Sequence
  targeting sequence with GTCN PAM
ggaggacccucuagcaaaau

SEQ ID NO: 6201 - RNA, 20 nt, Artificial Sequence
  targeting sequence with GTCN PAM
uauuaggcuagcccacugua

SEQ ID NO: 6202 - RNA, 20 nt, Artificial Sequence
  targeting sequence with GTCN PAM
ccucauuaaaucucaauuuc

SEQ ID NO: 6203 - RNA, 20 nt, Artificial Sequence
  targeting sequence with GTCN PAM
cacagugccucuccaauucc

SEQ ID NO: 6204 - RNA, 20 nt, Artificial Sequence
  targeting sequence with GTCN PAM
gaggacaauuugcaggauuc

SEQ ID NO: 6205 - RNA, 20 nt, Artificial Sequence
  targeting sequence with GTCN PAM
ucugacaacccugcacccac

SEQ ID NO: 6206 - RNA, 20 nt, Artificial Sequence
  targeting sequence with GTCN PAM
agaguccuuuccaauucuga

SEQ ID NO: 6207 - RNA, 20 nt, Artificial Sequence
  targeting sequence with GTCN PAM
uuuccaauucugaguuucug

SEQ ID NO: 6208 - RNA, 20 nt, Artificial Sequence
  targeting sequence with GTCN PAM
aggacagugccaugcacugu

SEQ ID NO: 6209 - RNA, 20 nt, Artificial Sequence
  targeting sequence with GTCN PAM
uagacauguaauaaauauaa

SEQ ID NO: 6210 - RNA, 20 nt, Artificial Sequence
  targeting sequence with GTCN PAM
gauuugccccaaucuaaacu

SEQ ID NO: 6211 - RNA, 20 nt, Artificial Sequence
  targeting sequence with GTCN PAM
cauuugagccaagccugaac

SEQ ID NO: 6212 - RNA, 20 nt, Artificial Sequence
  targeting sequence with GTCN PAM
uuuuggguugaauuaucaca

SEQ ID NO: 6213 - RNA, 20 nt, Artificial Sequence
  targeting sequence with GTCN PAM
cacaggaaucacuuugauga

SEQ ID NO: 6214 - RNA, 20 nt, Artificial Sequence
  targeting sequence with GTCN PAM
uccuugguauguggcuuccu

SEQ ID NO: 6215 - RNA, 20 nt, Artificial Sequence
  targeting sequence with GTCN PAM
gcaccucucaucuaaaguca

SEQ ID NO: 6216 - RNA, 20 nt, Artificial Sequence
  targeting sequence with GTCN PAM
ggcgcuuuggauagacuggc

SEQ ID NO: 6217 - RNA, 20 nt, Artificial Sequence
  targeting sequence with GTCN PAM
auccaaagcgccugacacuu

SEQ ID NO: 6218 - RNA, 20 nt, Artificial Sequence
  targeting sequence with GTCN PAM
ccccuacuuuuuauuccgcc

SEQ ID NO: 6219 - RNA, 20 nt, Artificial Sequence
  targeting sequence with GTCN PAM
guuaccacauaauggugagg

SEQ ID NO: 6220 - RNA, 20 nt, Artificial Sequence
  targeting sequence with GTCN PAM
cagagcuggcugauaaagaa

SEQ ID NO: 6221 - RNA, 20 nt, Artificial Sequence
  targeting sequence with GTCN PAM
ugucuacuacauuauguuuu

SEQ ID NO: 6222 - RNA, 20 nt, Artificial Sequence
  targeting sequence with GTCN PAM
acuacauuauguuuucguaa

SEQ ID NO: 6223 - RNA, 20 nt, Artificial Sequence
  targeting sequence with GTCN PAM
caaaaaaaaaaaagagugua

SEQ ID NO: 6224 - RNA, 20 nt, Artificial Sequence
  targeting sequence with GTCN PAM
cgcucuguugccaggcugga

SEQ ID NO: 6225 - RNA, 20 nt, Artificial Sequence
  targeting sequence with GTCN PAM
caccuacucgggaggcugag

SEQ ID NO: 6226 - RNA, 20 nt, Artificial Sequence
  targeting sequence with GTCN PAM
ggucaacagagccauauuaa

SEQ ID NO: 6227 - RNA, 20 nt, Artificial Sequence
  targeting sequence with GTCN PAM
acagagccauauuaaaagcu

SEQ ID NO: 6228 - RNA, 20 nt, Artificial Sequence
  targeting sequence with GTCN PAM
aaucuguuauccuucauacu

SEQ ID NO: 6229 - RNA, 20 nt, Artificial Sequence
  targeting sequence with GTCN PAM
gugcuuguaauuaacgcgcu

SEQ ID NO: 6230 - RNA, 20 nt, Artificial Sequence
  targeting sequence with GTCN PAM
ggaauaagaguucgaaguac

SEQ ID NO: 6231 - RNA, 20 nt, Artificial Sequence
  targeting sequence with GTCN PAM
uugagaguguacuuccaagu

SEQ ID NO: 6232 - RNA, 20 nt, Artificial Sequence
  targeting sequence with GTCN PAM
guaacuuggaaguacacucu

SEQ ID NO: 6233 - RNA, 20 nt, Artificial Sequence
  targeting sequence with GTCN PAM
cucagguuaaauuuuaaaag

SEQ ID NO: 6234 - RNA, 20 nt, Artificial Sequence
  targeting sequence with GTCN PAM
aacaugccucaguauaccuc

SEQ ID NO: 6235 - RNA, 20 nt, Artificial Sequence
  targeting sequence with GTCN PAM
guguugauguuaaugccaga

SEQ ID NO: 6236 - RNA, 20 nt, Artificial Sequence
  targeting sequence with GTCN PAM
cagaaaaaaaaaaaacaaaa

SEQ ID NO: 6237 - RNA, 20 nt, Artificial Sequence
  targeting sequence with GTCN PAM
cacucugucgcccaggcugg

SEQ ID NO: 6238 - RNA, 20 nt, Artificial Sequence
  targeting sequence with GTCN PAM
cccaggcuggaguguagugg

SEQ ID NO: 6239 - RNA, 20 nt, Artificial Sequence
  targeting sequence with GTCN PAM
cagcuacacgggaggaugag

SEQ ID NO: 6240 - RNA, 20 nt, Artificial Sequence
  targeting sequence with GTCN PAM
cuacaaaaaauuagccaagc

SEQ ID NO: 6241 - RNA, 20 nt, Artificial Sequence
  targeting sequence with GTCN PAM
cagucuccugaccucaugau

SEQ ID NO: 6242 - RNA, 20 nt, Artificial Sequence
  targeting sequence with GTCN PAM
ccugaccucaugauccaccc

SEQ ID NO: 6243 - RNA, 20 nt, Artificial Sequence
  targeting sequence with GTCN PAM
ggagacugagaccauccugg

SEQ ID NO: 6244 - RNA, 20 nt, Artificial Sequence
  targeting sequence with GTCN PAM
gccgggcgcgguggcucaug

SEQ ID NO: 6245 - RNA, 20 nt, Artificial Sequence
  targeting sequence with GTCN PAM
uuagauaagcucaaccaauu

SEQ ID NO: 6246 - RNA, 20 nt, Artificial Sequence
  targeting sequence with GTCN PAM
gaaaaauuuuaaaucaaccu

SEQ ID NO: 6247 - RNA, 20 nt, Artificial Sequence
  targeting sequence with GTCN PAM
agaaagauggaacaacuuga

SEQ ID NO: 6248 - RNA, 20 nt, Artificial Sequence
  targeting sequence with GTCN PAM
cauguuucacuaaaaugugu

SEQ ID NO: 6249 - RNA, 20 nt, Artificial Sequence
  targeting sequence with GTCN PAM
aaccgagcugcacccugacc

SEQ ID NO: 6250 - RNA, 20 nt, Artificial Sequence
  targeting sequence with GTCN PAM
gggugcagcucgguuugaca

SEQ ID NO: 6251 - RNA, 20 nt, Artificial Sequence
  targeting sequence with GTCN PAM
ugagaacaugugcccaaggu

SEQ ID NO: 6252 - RNA, 20 nt, Artificial Sequence
  targeting sequence with GTCN PAM
ugggcuguggucacucauau

SEQ ID NO: 6253 - RNA, 20 nt, Artificial Sequence
  targeting sequence with GTCN PAM
cucauauuuggcucagaaua

SEQ ID NO: 6254 - RNA, 20 nt, Artificial Sequence
  targeting sequence with GTCN PAM
aauuaaauuauuuugauuac

SEQ ID NO: 6255 - RNA, 20 nt, Artificial Sequence
  targeting sequence with GTCN PAM
aacugcaaaauauuuuaaga

SEQ ID NO: 6256 - RNA, 20 nt, Artificial Sequence
  targeting sequence with GTCN PAM
cucauauuaggcucagaaua

SEQ ID NO: 6257 - RNA, 20 nt, Artificial Sequence
  targeting sequence with GTCN PAM
cuggcuguggucacucauau

SEQ ID NO: 6258 - RNA, 20 nt, Artificial Sequence
  targeting sequence with GTCN PAM
acagaacaugugcccacggu

SEQ ID NO: 6259 - RNA, 20 nt, Artificial Sequence
  targeting sequence with GTCN PAM
caugccuccccaaacugcac

SEQ ID NO: 6260 - RNA, 20 nt, Artificial Sequence
  targeting sequence with GTCN PAM
ugccuuucuggaucaaacca

SEQ ID NO: 6261 - RNA, 20 nt, Artificial Sequence
  targeting sequence with GTCN PAM
gccagaaaauguuuaaauuu

SEQ ID NO: 6262 - RNA, 20 nt, Artificial Sequence
  targeting sequence with GTCN PAM
uuaaacaaacucagccaauu

SEQ ID NO: 6263 - RNA, 20 nt, Artificial Sequence
  targeting sequence with GTCN PAM
ggguuaagauaaaggauugu

SEQ ID NO: 6264 - RNA, 20 nt, Artificial Sequence
  targeting sequence with GTCN PAM
ccacaauccuuuaucuuaac

SEQ ID NO: 6265 - RNA, 20 nt, Artificial Sequence
  targeting sequence with GTCN PAM
ugcugucacccaggcuggag

SEQ ID NO: 6266 - RNA, 20 nt, Artificial Sequence
  targeting sequence with GTCN PAM
cccaggcuggagugcagugg

SEQ ID NO: 6267 - RNA, 20 nt, Artificial Sequence
  targeting sequence with GTCN PAM
cccggguucaagcaauucuc

SEQ ID NO: 6268 - RNA, 20 nt, Artificial Sequence
  targeting sequence with GTCN PAM
caacuaaaaauacaaaaauu

SEQ ID NO: 6269 - RNA, 20 nt, Artificial Sequence
  targeting sequence with GTCN PAM
ggcuggccucaaacuccuga

SEQ ID NO: 6270 - RNA, 20 nt, Artificial Sequence
  targeting sequence with GTCN PAM
ggaguuugaggccagccuga

SEQ ID NO: 6271 - RNA, 20 nt, Artificial Sequence
  targeting sequence with GTCN PAM
guguugauauuaaugccgga

SEQ ID NO: 6272 - RNA, 20 nt, Artificial Sequence
  targeting sequence with GTCN PAM
gaggcccacuucccgucaug

SEQ ID NO: 6273 - RNA, 20 nt, Artificial Sequence
  targeting sequence with GTCN PAM
uggccugaaacagucucuca

SEQ ID NO: 6274 - RNA, 20 nt, Artificial Sequence
  targeting sequence with GTCN PAM
cucagguuaaauuuuaaaag

SEQ ID NO: 6275 - RNA, 20 nt, Artificial Sequence
  targeting sequence with GTCN PAM
auucagacgguugggggggc

SEQ ID NO: 6276 - RNA, 20 nt, Artificial Sequence
  targeting sequence with GTCN PAM
gaauggacuuccuccucaac

SEQ ID NO: 6277 - RNA, 20 nt, Artificial Sequence
  targeting sequence with GTCN PAM
uugcuuguuuuauuuucuuu

SEQ ID NO: 6278 - RNA, 20 nt, Artificial Sequence
  targeting sequence with GTCN PAM
uuuacccaguguccuccucc

SEQ ID NO: 6279 - RNA, 20 nt, Artificial Sequence
  targeting sequence with GTCN PAM
uccuccauguuucaaaagcc

SEQ ID NO: 6280 - RNA, 20 nt, Artificial Sequence
  targeting sequence with GTCN PAM
uugucugggguaaauauccg

SEQ ID NO: 6281 - RNA, 20 nt, Artificial Sequence
  targeting sequence with GTCN PAM
gggguaaauauccgagauuu

SEQ ID NO: 6282 - RNA, 20 nt, Artificial Sequence
  targeting sequence with GTCN PAM
caacagcaauggaaaacuag

SEQ ID NO: 6283 - RNA, 20 nt, Artificial Sequence
  targeting sequence with GTCN PAM
guauccuaguuuuccauugc

SEQ ID NO: 6284 - RNA, 20 nt, Artificial Sequence
  targeting sequence with GTCN PAM
gcugcagugagcucuucucu

SEQ ID NO: 6285 - RNA, 20 nt, Artificial Sequence
  targeting sequence with GTCN PAM
gauuuacauagggcacaaaa

SEQ ID NO: 6286 - RNA, 20 nt, Artificial Sequence
  targeting sequence with GTCN PAM
uuugcauugggugcgaaaag

SEQ ID NO: 6287 - RNA, 20 nt, Artificial Sequence
  targeting sequence with GTCN PAM
ccacguguacaguaaagaaa

SEQ ID NO: 6288 - RNA, 20 nt, Artificial Sequence
  targeting sequence with GTCN PAM
ucccuuuaauuugucaccac

SEQ ID NO: 6289 - RNA, 20 nt, Artificial Sequence
  targeting sequence with GTCN PAM
caaaaaaaaaaaauaaauaa

SEQ ID NO: 6290 - RNA, 20 nt, Artificial Sequence
  targeting sequence with GTCN PAM
uccuccgucgcccagacugg

SEQ ID NO: 6291 - RNA, 20 nt, Artificial Sequence
  targeting sequence with GTCN PAM
cccagacuggagugcagugg

SEQ ID NO: 6292 - RNA, 20 nt, Artificial Sequence
  targeting sequence with GTCN PAM
gggcgacggaggaagacucc

SEQ ID NO: 6293 - RNA, 20 nt, Artificial Sequence
  targeting sequence with GTCN PAM
cuaccaaaaauacaaaaauu

SEQ ID NO: 6294 - RNA, 20 nt, Artificial Sequence
  targeting sequence with GTCN PAM
cgaacuccugaccucaaguc

SEQ ID NO: 6295 - RNA, 20 nt, Artificial Sequence
  targeting sequence with GTCN PAM
ggaguucgagaccagccugg

SEQ ID NO: 6296 - RNA, 20 nt, Artificial Sequence
  targeting sequence with GTCN PAM
uccuccugccuuggccuccc

SEQ ID NO: 6297 - RNA, 20 nt, Artificial Sequence
  targeting sequence with GTCN PAM
ucggcagaacuucccuuuua

SEQ ID NO: 6298 - RNA, 20 nt, Artificial Sequence
  targeting sequence with GTCN PAM
uccuccuucgaauccuguuu

SEQ ID NO: 6299 - RNA, 20 nt, Artificial Sequence
  targeting sequence with GTCN PAM
cuuaaagccuuuaucagagu

SEQ ID NO: 6300 - RNA, 20 nt, Artificial Sequence
  targeting sequence with GTCN PAM
uugauuauaaaauaccauug

SEQ ID NO: 6301 - RNA, 20 nt, Artificial Sequence
  targeting sequence with GTCN PAM
uauaauugaugauguuucag

SEQ ID NO: 6302 - RNA, 20 nt, Artificial Sequence
  targeting sequence with GTCN PAM
ucaauucuaaagcuuacauu

SEQ ID NO: 6303 - RNA, 20 nt, Artificial Sequence
  targeting sequence with GTCN PAM
guuucacaccuucucacugg

SEQ ID NO: 6304 - RNA, 20 nt, Artificial Sequence
  targeting sequence with GTCN PAM
cucuuaggugccaggcacca

SEQ ID NO: 6305 - RNA, 20 nt, Artificial Sequence
  targeting sequence with GTCN PAM
agccuuuaugauauuauuag

SEQ ID NO: 6306 - RNA, 20 nt, Artificial Sequence
  targeting sequence with GTCN PAM
acuguugaggguauuaacuc

SEQ ID NO: 6307 - RNA, 20 nt, Artificial Sequence
  targeting sequence with GTCN PAM
ggcuucuggacaagaggaaa

SEQ ID NO: 6308 - RNA, 20 nt, Artificial Sequence
  targeting sequence with GTCN PAM
agaagccagacacaagaaau

SEQ ID NO: 6309 - RNA, 20 nt, Artificial Sequence
  targeting sequence with GTCN PAM
ugauuuccucuuguccagaa

SEQ ID NO: 6310 - RNA, 20 nt, Artificial Sequence
  targeting sequence with GTCN PAM
gcuaauggccaggaaaguaa

SEQ ID NO: 6311 - RNA, 20 nt, Artificial Sequence
  targeting sequence with GTCN PAM
uuuucccuugucuucuguuc

SEQ ID NO: 6312 - RNA, 20 nt, Artificial Sequence
  targeting sequence with GTCN PAM
ucuguucaguauaaaugaca

SEQ ID NO: 6313 - RNA, 20 nt, Artificial Sequence
  targeting sequence with GTCN PAM
uuuauacugaacagaagaca

SEQ ID NO: 6314 - RNA, 20 nt, Artificial Sequence
  targeting sequence with GTCN PAM
uaguuuccucuuaaagugcu

SEQ ID NO: 6315 - RNA, 20 nt, Artificial Sequence
  targeting sequence with GTCN PAM
aauuucagaguacucacaag

SEQ ID NO: 6316 - RNA, 20 nt, Artificial Sequence
  targeting sequence with GTCN PAM
uucaucuuucccuuuuuacu

SEQ ID NO: 6317 - RNA, 20 nt, Artificial Sequence
  targeting sequence with GTCN PAM
caaaguaaaaagggaaagau

SEQ ID NO: 6318 - RNA, 20 nt, Artificial Sequence
  targeting sequence with GTCN PAM
aguuucaaaggcauugugau

SEQ ID NO: 6319 - RNA, 20 nt, Artificial Sequence
  targeting sequence with GTCN PAM
guuuacauuuugucccccag

SEQ ID NO: 6320 - RNA, 20 nt, Artificial Sequence
  targeting sequence with GTCN PAM
cccagaaaaauucaagcaac

SEQ ID NO: 6321 - RNA, 20 nt, Artificial Sequence
  targeting sequence with GTCN PAM
uguugcuugaauuuuucugg

SEQ ID NO: 6322 - RNA, 20 nt, Artificial Sequence
  targeting sequence with GTCN PAM
guccuguugcuugaauuuuu

SEQ ID NO: 6323 - RNA, 20 nt, Artificial Sequence
  targeting sequence with GTCN PAM
augaaaagucagauagccug

SEQ ID NO: 6324 - RNA, 20 nt, Artificial Sequence
  targeting sequence with GTCN PAM
gauagccugaccccaacuuu

SEQ ID NO: 6325 - RNA, 20 nt, Artificial Sequence
  targeting sequence with GTCN PAM
ggcuaucugacuuuucaugg

SEQ ID NO: 6326 - RNA, 20 nt, Artificial Sequence
  targeting sequence with GTCN PAM
uauuuuucauauuuucaaau

SEQ ID NO: 6327 - RNA, 20 nt, Artificial Sequence
  targeting sequence with GTCN PAM
aacauaagggguucucugaa

SEQ ID NO: 6328 - RNA, 20 nt, Artificial Sequence
  targeting sequence with GTCN PAM
aagucuacuuccucuucucu

SEQ ID NO: 6329 - RNA, 20 nt, Artificial Sequence
  targeting sequence with GTCN PAM
acuuccucuucucuguuguc

SEQ ID NO: 6330 - RNA, 20 nt, Artificial Sequence
  targeting sequence with GTCN PAM
cuagauacgcagacugauua

SEQ ID NO: 6331 - RNA, 20 nt, Artificial Sequence
  targeting sequence with GTCN PAM
gcguaucuagagacaacaga

SEQ ID NO: 6332 - RNA, 20 nt, Artificial Sequence
  targeting sequence with GTCN PAM
gcagaacaauuuaaccaugu

SEQ ID NO: 6333 - RNA, 20 nt, Artificial Sequence
  targeting sequence with GTCN PAM
ccaaaaaaaaaaaaaaaaaa

SEQ ID NO: 6334 - RNA, 20 nt, Artificial Sequence
  targeting sequence with GTCN PAM
ggcucugucgcccaggcugg

SEQ ID NO: 6335 - RNA, 20 nt, Artificial Sequence
  targeting sequence with GTCN PAM
cccaggcuggagugcaguga

SEQ ID NO: 6336 - RNA, 20 nt, Artificial Sequence
  targeting sequence with GTCN PAM
cugcacuccagccugggcga

SEQ ID NO: 6337 - RNA, 20 nt, Artificial Sequence
  targeting sequence with GTCN PAM
cagcuacucaggaggcugag

SEQ ID NO: 6338 - RNA, 20 nt, Artificial Sequence
  targeting sequence with GTCN PAM
cuacuaaaaauacaaaaaau

SEQ ID NO: 6339 - RNA, 20 nt, Artificial Sequence
  targeting sequence with GTCN PAM
cgaucuccugaccucguaau

SEQ ID NO: 6340 - RNA, 20 nt, Artificial Sequence
  targeting sequence with GTCN PAM
ggagaucgagaccauccugg

SEQ ID NO: 6341 - RNA, 20 nt, Artificial Sequence
  targeting sequence with GTCN PAM
cauggcuaucaaauaccuaa

SEQ ID NO: 6342 - RNA, 20 nt, Artificial Sequence
  targeting sequence with GTCN PAM
cuaagaaauaaaauaaaacc

SEQ ID NO: 6343 - RNA, 20 nt, Artificial Sequence
  targeting sequence with GTCN PAM
uagaucacugcagccucaaa

SEQ ID NO: 6344 - RNA, 20 nt, Artificial Sequence
  targeting sequence with GTCN PAM
uagcuacucgggaggcugag

SEQ ID NO: 6345 - RNA, 20 nt, Artificial Sequence
  targeting sequence with GTCN PAM
acaguccuagcuacucggga

SEQ ID NO: 6346 - RNA, 20 nt, Artificial Sequence
  targeting sequence with GTCN PAM
accuaauuuuuauuuuuuuu

SEQ ID NO: 6347 - RNA, 20 nt, Artificial Sequence
  targeting sequence with GTCN PAM
cauaguacauagaccugggu

SEQ ID NO: 6348 - RNA, 20 nt, Artificial Sequence
  targeting sequence with GTCN PAM
auguacuaugugaccaggaa

SEQ ID NO: 6349 - RNA, 20 nt, Artificial Sequence
  targeting sequence with GTCN PAM
ucuacuucuugguuacccaa

SEQ ID NO: 6350 - RNA, 20 nt, Artificial Sequence
  targeting sequence with GTCN PAM
cguuguuuuugguuuugcag

SEQ ID NO: 6351 - RNA, 20 nt, Artificial Sequence
  targeting sequence with GTCN PAM
auauucuaaaucuguagcca

SEQ ID NO: 6352 - RNA, 20 nt, Artificial Sequence
  targeting sequence with GTCN PAM
gaauuccugcaggguugcua

SEQ ID NO: 6353 - RNA, 20 nt, Artificial Sequence
  targeting sequence with GTCN PAM
cuuuugccagguuuaugaca

SEQ ID NO: 6354 - RNA, 20 nt, Artificial Sequence
  targeting sequence with GTCN PAM
uaaaccuggcaaaagagaca

SEQ ID NO: 6355 - RNA, 20 nt, Artificial Sequence
  targeting sequence with GTCN PAM
cuugaggggcugaaguaagg

SEQ ID NO: 6356 - RNA, 20 nt, Artificial Sequence
  targeting sequence with GTCN PAM
uugugucccuugaggggcug

SEQ ID NO: 6357 - RNA, 20 nt, Artificial Sequence
  targeting sequence with GTCN PAM
ucaucucaaugagcccaccc

SEQ ID NO: 6358 - RNA, 20 nt, Artificial Sequence
  targeting sequence with GTCN PAM
uuuuccucaccuguccucau

SEQ ID NO: 6359 - RNA, 20 nt, Artificial Sequence
  targeting sequence with GTCN PAM
ggaggcaaugagauugugcc

SEQ ID NO: 6360 - RNA, 20 nt, Artificial Sequence
  targeting sequence with GTCN PAM
aaauggaacuacugaaaggu

SEQ ID NO: 6361 - RNA, 20 nt, Artificial Sequence
  targeting sequence with GTCN PAM
ucagcagaggagggaucuga

SEQ ID NO: 6362 - RNA, 20 nt, Artificial Sequence
  targeting sequence with GTCN PAM
cugccucagagaaugggaca

SEQ ID NO: 6363 - RNA, 20 nt, Artificial Sequence
  targeting sequence with GTCN PAM
cauucucugaggcagugacu

SEQ ID NO: 6364 - RNA, 20 nt, Artificial Sequence
  targeting sequence with GTCN PAM
cacagcauaggauuaguggg

SEQ ID NO: 6365 - RNA, 20 nt, Artificial Sequence
  targeting sequence with GTCN PAM
gagcugguuauugagucuga

SEQ ID NO: 6366 - RNA, 20 nt, Artificial Sequence
  targeting sequence with GTCN PAM
gagucacgauuucuucaugu

SEQ ID NO: 6367 - RNA, 20 nt, Artificial Sequence
  targeting sequence with GTCN PAM
cgauuucuucauguaucaaa

SEQ ID NO: 6368 - RNA, 20 nt, Artificial Sequence
  targeting sequence with GTCN PAM
aaagcuuccaucugauuauc

SEQ ID NO: 6369 - RNA, 20 nt, Artificial Sequence
  targeting sequence with GTCN PAM
gauuaguccagucucuucac

SEQ ID NO: 6370 - RNA, 20 nt, Artificial Sequence
  targeting sequence with GTCN PAM
agucucuucacuuuaguccu

SEQ ID NO: 6371 - RNA, 20 nt, Artificial Sequence
  targeting sequence with GTCN PAM
cuucacuuuaguccugcaua

SEQ ID NO: 6372 - RNA, 20 nt, Artificial Sequence
  targeting sequence with GTCN PAM
ugcauaaagacauaaacaau

SEQ ID NO: 6373 - RNA, 20 nt, Artificial Sequence
  targeting sequence with GTCN PAM
uuaugcaggacuaaagugaa

SEQ ID NO: 6374 - RNA, 20 nt, Artificial Sequence
  targeting sequence with GTCN PAM
caaacuccugccuuaagcaa

SEQ ID NO: 6375 - RNA, 20 nt, Artificial Sequence
  targeting sequence with GTCN PAM
cacuauguugcccaggcugg

SEQ ID NO: 6376 - RNA, 20 nt, Artificial Sequence
  targeting sequence with GTCN PAM
cccaggccagauuuuaggga

SEQ ID NO: 6377 - RNA, 20 nt, Artificial Sequence
  targeting sequence with GTCN PAM
agcucugucacccaggccag

SEQ ID NO: 6378 - RNA, 20 nt, Artificial Sequence
  targeting sequence with GTCN PAM
cuuaaaaaaaaaaaaaaaag

SEQ ID NO: 6379 - RNA, 20 nt, Artificial Sequence
  targeting sequence with GTCN PAM
uuuuuuuuuuuuuuuaagag

SEQ ID NO: 6380 - RNA, 20 nt, Artificial Sequence
  targeting sequence with GTCN PAM
ugugacuugccaaggccaug

SEQ ID NO: 6381 - RNA, 20 nt, Artificial Sequence
  targeting sequence with GTCN PAM
caugacuugucuuuuuuuuu

SEQ ID NO: 6382 - RNA, 20 nt, Artificial Sequence
  targeting sequence with GTCN PAM
uugggccaaucugcugcaug

SEQ ID NO: 6383 - RNA, 20 nt, Artificial Sequence
  targeting sequence with GTCN PAM
ggugugcuguaccaugguag

SEQ ID NO: 6384 - RNA, 20 nt, Artificial Sequence
  targeting sequence with GTCN PAM
uauuugugugugugugugug

SEQ ID NO: 6385 - RNA, 20 nt, Artificial Sequence
  targeting sequence with GTCN PAM
cccuaaaacauuauucugaa

SEQ ID NO: 6386 - RNA, 20 nt, Artificial Sequence
  targeting sequence with GTCN PAM
cauccuaguggcuguugagg

SEQ ID NO: 6387 - RNA, 20 nt, Artificial Sequence
  targeting sequence with GTCN PAM
guccagggcccaguauaagg

SEQ ID NO: 6388 - RNA, 20 nt, Artificial Sequence
  targeting sequence with GTCN PAM
agggcccaguauaaggccca

SEQ ID NO: 6389 - RNA, 20 nt, Artificial Sequence
  targeting sequence with GTCN PAM
aagagcccugcuaugcuuau

SEQ ID NO: 6390 - RNA, 20 nt, Artificial Sequence
  targeting sequence with GTCN PAM
gagugugacccaucaguagu

SEQ ID NO: 6391 - RNA, 20 nt, Artificial Sequence
  targeting sequence with GTCN PAM
cacucugacauccucaagug

SEQ ID NO: 6392 - RNA, 20 nt, Artificial Sequence
  targeting sequence with GTCN PAM
ugucacacacaucucacuug

SEQ ID NO: 6393 - RNA, 20 nt, Artificial Sequence
  targeting sequence with GTCN PAM
cacacaucucacuugaugcu

SEQ ID NO: 6394 - RNA, 20 nt, Artificial Sequence
  targeting sequence with GTCN PAM
ccuugcugccugcuucagag

SEQ ID NO: 6395 - RNA, 20 nt, Artificial Sequence
  targeting sequence with GTCN PAM
guuuucucaucuuugagcgg

SEQ ID NO: 6396 - RNA, 20 nt, Artificial Sequence
  targeting sequence with GTCN PAM
gagaaccuggguuaggccug

SEQ ID NO: 6397 - RNA, 20 nt, Artificial Sequence
  targeting sequence with GTCN PAM
uuguucuuucuaguguauca

SEQ ID NO: 6398 - RNA, 20 nt, Artificial Sequence
  targeting sequence with GTCN PAM
acaguaggcuauuaauagua

SEQ ID NO: 6399 - RNA, 20 nt, Artificial Sequence
  targeting sequence with GTCN PAM
ucaucuucauugucuucagg

SEQ ID NO: 6400 - RNA, 20 nt, Artificial Sequence
  targeting sequence with GTCN PAM
ucagguugaauaggcugagg

SEQ ID NO: 6401 - RNA, 20 nt, Artificial Sequence
  targeting sequence with GTCN PAM
cccuggcacagcaucaccaa

SEQ ID NO: 6402 - RNA, 20 nt, Artificial Sequence
  targeting sequence with GTCN PAM
acuuuuacaugugaauuuuc

SEQ ID NO: 6403 - RNA, 20 nt, Artificial Sequence
  targeting sequence with GTCN PAM
acuguauguacacauguaca

SEQ ID NO: 6404 - RNA, 20 nt, Artificial Sequence
  targeting sequence with GTCN PAM
ugcagcuggucagugagauc

SEQ ID NO: 6405 - RNA, 20 nt, Artificial Sequence
  targeting sequence with GTCN PAM
gaauuccuagagaucucacu

SEQ ID NO: 6406 - RNA, 20 nt, Artificial Sequence
  targeting sequence with GTCN PAM
cugggucagaauuccuagag

SEQ ID NO: 6407 - RNA, 20 nt, Artificial Sequence
  targeting sequence with GTCN PAM
cacucuguugcccaggcuau

SEQ ID NO: 6408 - RNA, 20 nt, Artificial Sequence
  targeting sequence with GTCN PAM
caaaaaaaagguacuuuaca

SEQ ID NO: 6409 - RNA, 20 nt, Artificial Sequence
  targeting sequence with GTCN PAM
acuaagauaguaucuguaaa

SEQ ID NO: 6410 - RNA, 20 nt, Artificial Sequence
  targeting sequence with GTCN PAM
uuuuaugggagucaacuaag

SEQ ID NO: 6411 - RNA, 20 nt, Artificial Sequence
  targeting sequence with GTCN PAM
cuguucucugagccucaaug

SEQ ID NO: 6412 - RNA, 20 nt, Artificial Sequence
  targeting sequence with GTCN PAM
ccuuccacuugcccugugaa

SEQ ID NO: 6413 - RNA, 20 nt, Artificial Sequence
  targeting sequence with GTCN PAM
aaaaguccuuaagauguaca

SEQ ID NO: 6414 - RNA, 20 nt, Artificial Sequence
  targeting sequence with GTCN PAM
uuaagauguacagaaugugg

SEQ ID NO: 6415 - RNA, 20 nt, Artificial Sequence
  targeting sequence with GTCN PAM
guuccuucauaaagcccaag

SEQ ID NO: 6416 - RNA, 20 nt, Artificial Sequence
  targeting sequence with GTCN PAM
cugaggucccaagagauccu

SEQ ID NO: 6417 - RNA, 20 nt, Artificial Sequence
  targeting sequence with GTCN PAM
gagggaaugagcggagucau

SEQ ID NO: 6418 - RNA, 20 nt, Artificial Sequence
  targeting sequence with GTCN PAM
gucuccucucuacaucuggc

SEQ ID NO: 6419 - RNA, 20 nt, Artificial Sequence
  targeting sequence with GTCN PAM
ccucucuacaucuggcuaag

SEQ ID NO: 6420 - RNA, 20 nt, Artificial Sequence
  targeting sequence with GTCN PAM
ccacugaaggaucucauccu

SEQ ID NO: 6421 - RNA, 20 nt, Artificial Sequence
  targeting sequence with GTCN PAM
cccaggagauguugaccaaa

SEQ ID NO: 6422 - RNA, 20 nt, Artificial Sequence
  targeting sequence with GTCN PAM
acaucuccugggggaccuaa

SEQ ID NO: 6423 - RNA, 20 nt, Artificial Sequence
  targeting sequence with GTCN PAM
gacaaaaggaguacauuuuu

SEQ ID NO: 6424 - RNA, 20 nt, Artificial Sequence
  targeting sequence with GTCN PAM
gacugaaacuacccuuuggu

SEQ ID NO: 6425 - RNA, 20 nt, Artificial Sequence
  targeting sequence with GTCN PAM
uaccauguuguauuuguguu

SEQ ID NO: 6426 - RNA, 20 nt, Artificial Sequence
  targeting sequence with GTCN PAM
uacauuuaucuuaaaccagc

SEQ ID NO: 6427 - RNA, 20 nt, Artificial Sequence
  targeting sequence with GTCN PAM
gcugauccagaagcaaagcg

SEQ ID NO: 6428 - RNA, 20 nt, Artificial Sequence
  targeting sequence with GTCN PAM
agauaauaacgcuuuuguca

SEQ ID NO: 6429 - RNA, 20 nt, Artificial Sequence
  targeting sequence with GTCN PAM
gaugaacugagaugagcuac

SEQ ID NO: 6430 - RNA, 20 nt, Artificial Sequence
  targeting sequence with GTCN PAM
acaaugucagaugaacugag

SEQ ID NO: 6431 - RNA, 20 nt, Artificial Sequence
  targeting sequence with GTCN PAM
ucuuccagugucccugucuc

SEQ ID NO: 6432 - RNA, 20 nt, Artificial Sequence
  targeting sequence with GTCN PAM
cugucucagagaauggccuu

SEQ ID NO: 6433 - RNA, 20 nt, Artificial Sequence
  targeting sequence with GTCN PAM
cagagaauggccuuauaucc

SEQ ID NO: 6434 - RNA, 20 nt, Artificial Sequence
  targeting sequence with GTCN PAM
aaugucagaaacuugggguc

SEQ ID NO: 6435 - RNA, 20 nt, Artificial Sequence
  targeting sequence with GTCN PAM
gaaacuuggggucagugugc

SEQ ID NO: 6436 - RNA, 20 nt, Artificial Sequence
  targeting sequence with GTCN PAM
caaaacaaaacaaaacaaaa

SEQ ID NO: 6437 - RNA, 20 nt, Artificial Sequence
  targeting sequence with GTCN PAM
ugcucuguugcccaggcugg

SEQ ID NO: 6438 - RNA, 20 nt, Artificial Sequence
  targeting sequence with GTCN PAM
ugcucugucucccaggcuac

SEQ ID NO: 6439 - RNA, 20 nt, Artificial Sequence
  targeting sequence with GTCN PAM
cccaggcuacagugcagugg

SEQ ID NO: 6440 - RNA, 20 nt, Artificial Sequence
  targeting sequence with GTCN PAM
cuaccaagaaaaaaaaaaau

SEQ ID NO: 6441 - RNA, 20 nt, Artificial Sequence
  targeting sequence with GTCN PAM
ugaacuccugggcucaagca

SEQ ID NO: 6442 - RNA, 20 nt, Artificial Sequence
  targeting sequence with GTCN PAM
ucucaaaguacugggauuac

SEQ ID NO: 6443 - RNA, 20 nt, Artificial Sequence
  targeting sequence with GTCN PAM
gaauuuacuuucuguguugu

SEQ ID NO: 6444 - RNA, 20 nt, Artificial Sequence
  targeting sequence with GTCN PAM
gaauuuacuuccuuuuuuuu

SEQ ID NO: 6445 - RNA, 20 nt, Artificial Sequence
  targeting sequence with GTCN PAM
ucauaaaaaaaaauaauaau

SEQ ID NO: 6446 - RNA, 20 nt, Artificial Sequence
  targeting sequence with GTCN PAM
cacuaugacuccugagcuca

SEQ ID NO: 6447 - RNA, 20 nt, Artificial Sequence
  targeting sequence with GTCN PAM
uagugagaccucgucuucau

SEQ ID NO: 6448 - RNA, 20 nt, Artificial Sequence
  targeting sequence with GTCN PAM
gaauauuauuccauuguaua

SEQ ID NO: 6449 - RNA, 20 nt, Artificial Sequence
  targeting sequence with GTCN PAM
auauauacaauggaauaaua

SEQ ID NO: 6450 - RNA, 20 nt, Artificial Sequence
  targeting sequence with GTCN PAM
aucaacagaugaauggauaa

SEQ ID NO: 6451 - RNA, 20 nt, Artificial Sequence
  targeting sequence with GTCN PAM
uucacuuguggguaauacuu

SEQ ID NO: 6452 - RNA, 20 nt, Artificial Sequence
  targeting sequence with GTCN PAM
caacccguuuuaguccuuca

SEQ ID NO: 6453 - RNA, 20 nt, Artificial Sequence
  targeting sequence with GTCN PAM
aaggauuugucauguuucca

SEQ ID NO: 6454 - RNA, 20 nt, Artificial Sequence
  targeting sequence with GTCN PAM
uguuuccagaucuuggucug

SEQ ID NO: 6455 - RNA, 20 nt, Artificial Sequence
  targeting sequence with GTCN PAM
gugaugucuucauugcaccu

SEQ ID NO: 6456 - RNA, 20 nt, Artificial Sequence
  targeting sequence with GTCN PAM
ucauugcaccuccaucuucc

SEQ ID NO: 6457 - RNA, 20 nt, Artificial Sequence
  targeting sequence with GTCN PAM
ccaucucuacaaauaagaaa

SEQ ID NO: 6458 - RNA, 20 nt, Artificial Sequence
  targeting sequence with GTCN PAM
cuugcagaagagcauguggu

SEQ ID NO: 6459 - RNA, 20 nt, Artificial Sequence
  targeting sequence with GTCN PAM
aaagucagaggcugugggcu

SEQ ID NO: 6460 - RNA, 20 nt, Artificial Sequence
  targeting sequence with GTCN PAM
gaggcugugggcucauuauu

SEQ ID NO: 6461 - RNA, 20 nt, Artificial Sequence
  targeting sequence with GTCN PAM
ccuacaauccuauuacucau

SEQ ID NO: 6462 - RNA, 20 nt, Artificial Sequence
  targeting sequence with GTCN PAM
cuggaggaacaagaugccag

SEQ ID NO: 6463 - RNA, 20 nt, Artificial Sequence
  targeting sequence with GTCN PAM
uguccuggaauaacugaaaa

SEQ ID NO: 6464 - RNA, 20 nt, Artificial Sequence
  targeting sequence with GTCN PAM
uggaauaacugaaaaucugg

SEQ ID NO: 6465 - RNA, 20 nt, Artificial Sequence
  targeting sequence with GTCN PAM
gccuccccucagccauugaa

SEQ ID NO: 6466 - RNA, 20 nt, Artificial Sequence
  targeting sequence with GTCN PAM
ugguuuccacacaauuuaaa

SEQ ID NO: 6467 - RNA, 20 nt, Artificial Sequence
  targeting sequence with GTCN PAM
ccauucacugucuugguuuc

SEQ ID NO: 6468 - RNA, 20 nt, Artificial Sequence
  targeting sequence with GTCN PAM
uaccagaguaaaggucacca

SEQ ID NO: 6469 - RNA, 20 nt, Artificial Sequence
  targeting sequence with GTCN PAM
cugaugucuuaccagaguaa

SEQ ID NO: 6470 - RNA, 20 nt, Artificial Sequence
  targeting sequence with GTCN PAM
gggaaggcuucccagaggca

SEQ ID NO: 6471 - RNA, 20 nt, Artificial Sequence
  targeting sequence with GTCN PAM
cugccagggugagucaggga

SEQ ID NO: 6472 - RNA, 20 nt, Artificial Sequence
  targeting sequence with GTCN PAM
ucaccuuuguauugacccac

SEQ ID NO: 6473 - RNA, 20 nt, Artificial Sequence
  targeting sequence with GTCN PAM
auacaaaggugaggacaacu

SEQ ID NO: 6474 - RNA, 20 nt, Artificial Sequence
  targeting sequence with GTCN PAM
ucauuacugguuuagguggc

SEQ ID NO: 6475 - RNA, 20 nt, Artificial Sequence
  targeting sequence with GTCN PAM
uuacugguuuagguggcugu

SEQ ID NO: 6476 - RNA, 20 nt, Artificial Sequence
  targeting sequence with GTCN PAM
ucccugaggggcugaacacc

SEQ ID NO: 6477 - RNA, 20 nt, Artificial Sequence
  targeting sequence with GTCN PAM
cgugccagcauuacagcacu

SEQ ID NO: 6478 - RNA, 20 nt, Artificial Sequence
  targeting sequence with GTCN PAM
guaaaaugucuguggaggga

SEQ ID NO: 6479 - RNA, 20 nt, Artificial Sequence
  targeting sequence with GTCN PAM
guggagggaggaagggagug

SEQ ID NO: 6480 - RNA, 20 nt, Artificial Sequence
  targeting sequence with GTCN PAM
guguucguugcuaguggaua

SEQ ID NO: 6481 - RNA, 20 nt, Artificial Sequence
  targeting sequence with GTCN PAM
cuagaugaggagucagaggc

SEQ ID NO: 6482 - RNA, 20 nt, Artificial Sequence
  targeting sequence with GTCN PAM
gaggccuaaucccucucagu

SEQ ID NO: 6483 - RNA, 20 nt, Artificial Sequence
  targeting sequence with GTCN PAM
cacugauacgguucugguuc

SEQ ID NO: 6484 - RNA, 20 nt, Artificial Sequence
  targeting sequence with GTCN PAM
uuuguuuaacauauuuuaua

SEQ ID NO: 6485 - RNA, 20 nt, Artificial Sequence
  targeting sequence with GTCN PAM
gugugcuuacacuggaauau

SEQ ID NO: 6486 - RNA, 20 nt, Artificial Sequence
  targeting sequence with GTCN PAM
uaggagaaggugggauuaaa

SEQ ID NO: 6487 - RNA, 20 nt, Artificial Sequence
  targeting sequence with GTCN PAM
uaaagcucaaauagaaauuc

SEQ ID NO: 6488 - RNA, 20 nt, Artificial Sequence
  targeting sequence with GTCN PAM
gguauuauucucauucccac

SEQ ID NO: 6489 - RNA, 20 nt, Artificial Sequence
  targeting sequence with GTCN PAM
cuuagcuaguaaguggagga

SEQ ID NO: 6490 - RNA, 20 nt, Artificial Sequence
  targeting sequence with GTCN PAM
aagcccugguuccuccacuu

SEQ ID NO: 6491 - RNA, 20 nt, Artificial Sequence
  targeting sequence with GTCN PAM
aaaguccaagcccugguucc

SEQ ID NO: 6492 - RNA, 20 nt, Artificial Sequence
  targeting sequence with GTCN PAM
aaauguuuggaggaagcguu

SEQ ID NO: 6493 - RNA, 20 nt, Artificial Sequence
  targeting sequence with GTCN PAM
agaacgcuuccuccaaacau

SEQ ID NO: 6494 - RNA, 20 nt, Artificial Sequence
  targeting sequence with GTCN PAM
agacauacacuugcuaugag

SEQ ID NO: 6495 - RNA, 20 nt, Artificial Sequence
  targeting sequence with GTCN PAM
agacaacauaagcaaauucu

SEQ ID NO: 6496 - RNA, 20 nt, Artificial Sequence
  targeting sequence with GTCN PAM
cagaugcccuggcucagugc

SEQ ID NO: 6497 - RNA, 20 nt, Artificial Sequence
  targeting sequence with GTCN PAM
ccuaaggcuugcuccccccu

SEQ ID NO: 6498 - RNA, 20 nt, Artificial Sequence
  targeting sequence with GTCN PAM
uguguugugauugagaccua

SEQ ID NO: 6499 - RNA, 20 nt, Artificial Sequence
  targeting sequence with GTCN PAM
caaucacaacacaugacucu

SEQ ID NO: 6500 - RNA, 20 nt, Artificial Sequence
  targeting sequence with GTCN PAM
aaguuauaaacaaugaaacu

SEQ ID NO: 6501 - RNA, 20 nt, Artificial Sequence
  targeting sequence with GTCN PAM
uuucuuugagagucaaaucc

SEQ ID NO: 6502 - RNA, 20 nt, Artificial Sequence
  targeting sequence with GTCN PAM
aaucccugaaaaguuggcua

SEQ ID NO: 6503 - RNA, 20 nt, Artificial Sequence
  targeting sequence with GTCN PAM
auguacuuuucauccaguuu

SEQ ID NO: 6504 - RNA, 20 nt, Artificial Sequence
  targeting sequence with GTCN PAM
ugauauuguauaauaguuac

SEQ ID NO: 6505 - RNA, 20 nt, Artificial Sequence
  targeting sequence with GTCN PAM
caguuuccuggucuugauau

SEQ ID NO: 6506 - RNA, 20 nt, Artificial Sequence
  targeting sequence with GTCN PAM
cgcugauggcaaucuacaca

SEQ ID NO: 6507 - RNA, 20 nt, Artificial Sequence
  targeting sequence with GTCN PAM
uaucuacucaccuuaccucc

SEQ ID NO: 6508 - RNA, 20 nt, Artificial Sequence
  targeting sequence with GTCN PAM
uucaagaauguuauauaaau

SEQ ID NO: 6509 - RNA, 20 nt, Artificial Sequence
  targeting sequence with GTCN PAM
uauacuguacgauuccauuu

SEQ ID NO: 6510 - RNA, 20 nt, Artificial Sequence
  targeting sequence with GTCN PAM
ccugaacagaagucugucuc

SEQ ID NO: 6511 - RNA, 20 nt, Artificial Sequence
  targeting sequence with GTCN PAM
gucuccaaacacaaaucaag

SEQ ID NO: 6512 - RNA, 20 nt, Artificial Sequence
  targeting sequence with GTCN PAM
ccaaacacaaaucaagcagc

SEQ ID NO: 6513 - RNA, 20 nt, Artificial Sequence
  targeting sequence with GTCN PAM
gagcugcacuuaccugcagc

SEQ ID NO: 6514 - RNA, 20 nt, Artificial Sequence
  targeting sequence with GTCN PAM
guguggaagaugaaggaaca

SEQ ID NO: 6515 - RNA, 20 nt, Artificial Sequence
  targeting sequence with GTCN PAM
uguguuagguaguugguuua

SEQ ID NO: 6516 - RNA, 20 nt, Artificial Sequence
  targeting sequence with GTCN PAM
ccucgaugggaaagacuugu

SEQ ID NO: 6517 - RNA, 20 nt, Artificial Sequence
  targeting sequence with GTCN PAM
uucccaucgaggagacgaag

SEQ ID NO: 6518 - RNA, 20 nt, Artificial Sequence
  targeting sequence with GTCN PAM
uuguccaggcagcaugugug

SEQ ID NO: 6519 - RNA, 20 nt, Artificial Sequence
  targeting sequence with GTCN PAM
aggcagcauguguggggaag

SEQ ID NO: 6520 - RNA, 20 nt, Artificial Sequence
  targeting sequence with GTCN PAM
agcaucaaagugugggaggg

SEQ ID NO: 6521 - RNA, 20 nt, Artificial Sequence
  targeting sequence with GTCN PAM
augagagauucuggauucua

SEQ ID NO: 6522 - RNA, 20 nt, Artificial Sequence
  targeting sequence with GTCN PAM
cauggccugucaaugagaga

SEQ ID NO: 6523 - RNA, 20 nt, Artificial Sequence
  targeting sequence with GTCN PAM
gaugaggaacguaaagcucc

SEQ ID NO: 6524 - RNA, 20 nt, Artificial Sequence
  targeting sequence with GTCN PAM
guauuuuuaucccuaucugu

SEQ ID NO: 6525 - RNA, 20 nt, Artificial Sequence
  targeting sequence with GTCN PAM
agucaguauuuuuaucccua

SEQ ID NO: 6526 - RNA, 20 nt, Artificial Sequence
  targeting sequence with GTCN PAM
ugcacgcuuuacacucauga

SEQ ID NO: 6527 - RNA, 20 nt, Artificial Sequence
  targeting sequence with GTCN PAM
acuguacaccagguacuguc

SEQ ID NO: 6528 - RNA, 20 nt, Artificial Sequence
  targeting sequence with GTCN PAM
uccaaccccuagaacagugc

SEQ ID NO: 6529 - RNA, 20 nt, Artificial Sequence
  targeting sequence with GTCN PAM
guucuuaaggugcucuuuaa

SEQ ID NO: 6530 - RNA, 20 nt, Artificial Sequence
  targeting sequence with GTCN PAM
uagagguauguacagagggc

SEQ ID NO: 6531 - RNA, 20 nt, Artificial Sequence
  targeting sequence with GTCN PAM
agcuguguacacaaccaaca

SEQ ID NO: 6532 - RNA, 20 nt, Artificial Sequence
  targeting sequence with GTCN PAM
guaccuggcgcuggggaugu

SEQ ID NO: 6533 - RNA, 20 nt, Artificial Sequence
  targeting sequence with GTCN PAM
aucugcuggaacccuucaag

SEQ ID NO: 6534 - RNA, 20 nt, Artificial Sequence
  targeting sequence with GTCN PAM
uccuucuagaacaaacacca

SEQ ID NO: 6535 - RNA, 20 nt, Artificial Sequence
  targeting sequence with GTCN PAM
cgcuaccugagaauguaugg

SEQ ID NO: 6536 - RNA, 20 nt, Artificial Sequence
  targeting sequence with GTCN PAM
aggauucauuccuaaacuca

SEQ ID NO: 6537 - RNA, 20 nt, Artificial Sequence
  targeting sequence with GTCN PAM
uaaauagcucaucugcuuug

SEQ ID NO: 6538 - RNA, 20 nt, Artificial Sequence
  targeting sequence with GTCN PAM
gcgcacaugugcaugcacac

SEQ ID NO: 6539 - RNA, 20 nt, Artificial Sequence
  targeting sequence with GTCN PAM
gaaagucaaaauuaagucua

SEQ ID NO: 6540 - RNA, 20 nt, Artificial Sequence
  targeting sequence with GTCN PAM
aaauuaagucuacagacguc

SEQ ID NO: 6541 - RNA, 20 nt, Artificial Sequence
  targeting sequence with GTCN PAM
acagacgucccuaaagccua

SEQ ID NO: 6542 - RNA, 20 nt, Artificial Sequence
  targeting sequence with GTCN PAM
guagacuuaauuuugacuuu

SEQ ID NO: 6543 - RNA, 20 nt, Artificial Sequence
  targeting sequence with GTCN PAM
cuaaagccuagagauacaca

SEQ ID NO: 6544 - RNA, 20 nt, Artificial Sequence
  targeting sequence with GTCN PAM
augugacuuugagaguaaac

SEQ ID NO: 6545 - RNA, 20 nt, Artificial Sequence
  targeting sequence with GTCN PAM
cauggacauagaaagcaaag

SEQ ID NO: 6546 - RNA, 20 nt, Artificial Sequence
  targeting sequence with GTCN PAM
ucugaggguaaacgaaaggu

SEQ ID NO: 6547 - RNA, 20 nt, Artificial Sequence
  targeting sequence with GTCN PAM
uacuuguuuaccagcucaau

SEQ ID NO: 6548 - RNA, 20 nt, Artificial Sequence
  targeting sequence with GTCN PAM
uuuuacagaugguugccuac

SEQ ID NO: 6549 - RNA, 20 nt, Artificial Sequence
  targeting sequence with GTCN PAM
aaugcugucaaaggccauua

SEQ ID NO: 6550 - RNA, 20 nt, Artificial Sequence
  targeting sequence with GTCN PAM
aaggccauuagccugcccca

SEQ ID NO: 6551 - RNA, 20 nt, Artificial Sequence
  targeting sequence with GTCN PAM
ucugcagccacaaaucaaac

SEQ ID NO: 6552 - RNA, 20 nt, Artificial Sequence
  targeting sequence with GTCN PAM
uccuccagguaggguucaga

SEQ ID NO: 6553 - RNA, 20 nt, Artificial Sequence
  targeting sequence with GTCN PAM
aauuuuuuguauuuuuggua

SEQ ID NO: 6554 - RNA, 20 nt, Artificial Sequence
  targeting sequence with GTCN PAM
cuaccaaaaauacaaaaaau

SEQ ID NO: 6555 - RNA, 20 nt, Artificial Sequence
  targeting sequence with GTCN PAM
ugaacuccugaucucgagcg

SEQ ID NO: 6556 - RNA, 20 nt, Artificial Sequence
  targeting sequence with GTCN PAM
cugcaccuggcccccagggg

SEQ ID NO: 6557 - RNA, 20 nt, Artificial Sequence
  targeting sequence with GTCN PAM
acagccgaugggagaguuuc

SEQ ID NO: 6558 - RNA, 20 nt, Artificial Sequence
  targeting sequence with GTCN PAM
uugucaacagauauauucag

SEQ ID NO: 6559 - RNA, 20 nt, Artificial Sequence
  targeting sequence with GTCN PAM
acagauauauucaggaaauc

SEQ ID NO: 6560 - RNA, 20 nt, Artificial Sequence
  targeting sequence with GTCN PAM
gcaguguacaguagucaggg

SEQ ID NO: 6561 - RNA, 20 nt, Artificial Sequence
  targeting sequence with GTCN PAM
ggguagugaggcagaggagg

SEQ ID NO: 6562 - RNA, 20 nt, Artificial Sequence
  targeting sequence with GTCN PAM
ucuuccucugguucuuccuc

SEQ ID NO: 6563 - RNA, 20 nt, Artificial Sequence
  targeting sequence with GTCN PAM
uccucuuccucugguucuuc

SEQ ID NO: 6564 - RNA, 20 nt, Artificial Sequence
  targeting sequence with GTCN PAM
cagggacgacaacuugugag

SEQ ID NO: 6565 - RNA, 20 nt, Artificial Sequence
  targeting sequence with GTCN PAM
cugggacugucguccucuuc

SEQ ID NO: 6566 - RNA, 20 nt, Artificial Sequence
  targeting sequence with GTCN PAM
ucccugggacugucguccuc

SEQ ID NO: 6567 - RNA, 20 nt, Artificial Sequence
  targeting sequence with GTCN PAM
cagugagugggaacccuucu

SEQ ID NO: 6568 - RNA, 20 nt, Artificial Sequence
  targeting sequence with GTCN PAM
uuucaguauuuccuauaguu

SEQ ID NO: 6569 - RNA, 20 nt, Artificial Sequence
  targeting sequence with GTCN PAM
uucuucucuucaguugagau

SEQ ID NO: 6570 - RNA, 20 nt, Artificial Sequence
  targeting sequence with GTCN PAM
caagcuagaucucuacugcc

SEQ ID NO: 6571 - RNA, 20 nt, Artificial Sequence
  targeting sequence with GTCN PAM
ugggggcugggaagugggga

SEQ ID NO: 6572 - RNA, 20 nt, Artificial Sequence
  targeting sequence with GTCN PAM
ccacuucccagcccccauga

SEQ ID NO: 6573 - RNA, 20 nt, Artificial Sequence
  targeting sequence with GTCN PAM
ccaucucagugccuuugauu

SEQ ID NO: 6574 - RNA, 20 nt, Artificial Sequence
  targeting sequence with GTCN PAM
cugugagauggaucagugau

SEQ ID NO: 6575 - RNA, 20 nt, Artificial Sequence
  targeting sequence with GTCN PAM
aaacacaauccaggagccca

SEQ ID NO: 6576 - RNA, 20 nt, Artificial Sequence
  targeting sequence with GTCN PAM
aaaguccaaacacaauccag

SEQ ID NO: 6577 - RNA, 20 nt, Artificial Sequence
  targeting sequence with GTCN PAM
cacaaaggucaucugcaggc

SEQ ID NO: 6578 - RNA, 20 nt, Artificial Sequence
  targeting sequence with GTCN PAM
ucugcaggcucccucauuaa

SEQ ID NO: 6579 - RNA, 20 nt, Artificial Sequence
  targeting sequence with GTCN PAM
uugucucuuuucccuuaguu

SEQ ID NO: 6580 - RNA, 20 nt, Artificial Sequence
  targeting sequence with GTCN PAM
cuuuucccuuaguuuugggu

SEQ ID NO: 6581 - RNA, 20 nt, Artificial Sequence
  targeting sequence with GTCN PAM
uaggcacuaacccaaaacua

SEQ ID NO: 6582 - RNA, 20 nt, Artificial Sequence
  targeting sequence with GTCN PAM
ugugguaaccugguagcacc

SEQ ID NO: 6583 - RNA, 20 nt, Artificial Sequence
  targeting sequence with GTCN PAM
uaauccaccuaauguugccu

SEQ ID NO: 6584 - RNA, 20 nt, Artificial Sequence
  targeting sequence with GTCN PAM
caaaaaaaaaaaagaaaagc

SEQ ID NO: 6585 - RNA, 20 nt, Artificial Sequence
  targeting sequence with GTCN PAM
ggcucugucaccugggcugg

SEQ ID NO: 6586 - RNA, 20 nt, Artificial Sequence
  targeting sequence with GTCN PAM
ccugggcuggagugcagugg

SEQ ID NO: 6587 - RNA, 20 nt, Artificial Sequence
  targeting sequence with GTCN PAM
guaaucccagcuauuccaga

SEQ ID NO: 6588 - RNA, 20 nt, Artificial Sequence
  targeting sequence with GTCN PAM
cgugucuguaaucccagcua

SEQ ID NO: 6589 - RNA, 20 nt, Artificial Sequence
  targeting sequence with GTCN PAM
agaacuccugaccucaggug

SEQ ID NO: 6590 - RNA, 20 nt, Artificial Sequence
  targeting sequence with GTCN PAM
ggaguucuagaccagccugg

SEQ ID NO: 6591 - RNA, 20 nt, Artificial Sequence
  targeting sequence with GTCN PAM
uacagucccagccccacagc

SEQ ID NO: 6592 - RNA, 20 nt, Artificial Sequence
  targeting sequence with GTCN PAM
cagccccacagcacugaucc

SEQ ID NO: 6593 - RNA, 20 nt, Artificial Sequence
  targeting sequence with GTCN PAM
uugaaacugagaaccuaugg

SEQ ID NO: 6594 - RNA, 20 nt, Artificial Sequence
  targeting sequence with GTCN PAM
gaaaccauuucaccugugca

SEQ ID NO: 6595 - RNA, 20 nt, Artificial Sequence
  targeting sequence with GTCN PAM
uugcacaggugaaaugguuu

SEQ ID NO: 6596 - RNA, 20 nt, Artificial Sequence
  targeting sequence with GTCN PAM
uugugcugcaagagauguuu

SEQ ID NO: 6597 - RNA, 20 nt, Artificial Sequence
  targeting sequence with GTCN PAM
caauauugcagccuugccua

SEQ ID NO: 6598 - RNA, 20 nt, Artificial Sequence
  targeting sequence with GTCN PAM
ccagcaccauaaggucauag

SEQ ID NO: 6599 - RNA, 20 nt, Artificial Sequence
  targeting sequence with GTCN PAM
uagcaggggacucagugaaa

SEQ ID NO: 6600 - RNA, 20 nt, Artificial Sequence
  targeting sequence with GTCN PAM
ccugcuaugaccuuauggug

SEQ ID NO: 6601 - RNA, 20 nt, Artificial Sequence
  targeting sequence with GTCN PAM
uacgggaugaagcagaguug

SEQ ID NO: 6602 - RNA, 20 nt, Artificial Sequence
  targeting sequence with GTCN PAM
uggccucagguugccaaaug

SEQ ID NO: 6603 - RNA, 20 nt, Artificial Sequence
  targeting sequence with GTCN PAM
uuacguuccucucuaaucaa

SEQ ID NO: 6604 - RNA, 20 nt, Artificial Sequence
  targeting sequence with GTCN PAM
gccacagccaggaugucauu

SEQ ID NO: 6605 - RNA, 20 nt, Artificial Sequence
  targeting sequence with GTCN PAM
ccagucagccacagccagga

SEQ ID NO: 6606 - RNA, 20 nt, Artificial Sequence
  targeting sequence with GTCN PAM
ugccuguuauauuuucauuu

SEQ ID NO: 6607 - RNA, 20 nt, Artificial Sequence
  targeting sequence with GTCN PAM
uuagccuaacucaaagaugg

SEQ ID NO: 6608 - RNA, 20 nt, Artificial Sequence
  targeting sequence with GTCN PAM
uauauuuucauuccuuccug

SEQ ID NO: 6609 - RNA, 20 nt, Artificial Sequence
  targeting sequence with GTCN PAM
cccuguacaacucaccauuc

SEQ ID NO: 6610 - RNA, 20 nt, Artificial Sequence
  targeting sequence with GTCN PAM
caaacucugagaugcaguca

SEQ ID NO: 6611 - RNA, 20 nt, Artificial Sequence
  targeting sequence with GTCN PAM
uuuauaaucacaucuccagc

SEQ ID NO: 6612 - RNA, 20 nt, Artificial Sequence
  targeting sequence with GTCN PAM
uccuacuaccaugcucucua

SEQ ID NO: 6613 - RNA, 20 nt, Artificial Sequence
  targeting sequence with GTCN PAM
uuucuuuuguauucgaguaa

SEQ ID NO: 6614 - RNA, 20 nt, Artificial Sequence
  targeting sequence with GTCN PAM
ucccuucccaaucuaggaag

SEQ ID NO: 6615 - RNA, 20 nt, Artificial Sequence
  targeting sequence with GTCN PAM
gagguauaauuuguguauuu

SEQ ID NO: 6616 - RNA, 20 nt, Artificial Sequence
  targeting sequence with GTCN PAM
uuugaaguguuaguaauacu

SEQ ID NO: 6617 - RNA, 20 nt, Artificial Sequence
  targeting sequence with GTCN PAM
acccugcugaaacccaggca

SEQ ID NO: 6618 - RNA, 20 nt, Artificial Sequence
  targeting sequence with GTCN PAM
aucagauuagucuugcaaug

SEQ ID NO: 6619 - RNA, 20 nt, Artificial Sequence
  targeting sequence with GTCN PAM
ugcaaugaccauucaaaagu

SEQ ID NO: 6620 - RNA, 20 nt, Artificial Sequence
  targeting sequence with GTCN PAM
uugcaagacuaaucugauag

SEQ ID NO: 6621 - RNA, 20 nt, Artificial Sequence
  targeting sequence with GTCN PAM
uucaccaaaugugaaaacau

SEQ ID NO: 6622 - RNA, 20 nt, Artificial Sequence
  targeting sequence with GTCN PAM
caguuuauaguucaaggguu

SEQ ID NO: 6623 - RNA, 20 nt, Artificial Sequence
  targeting sequence with GTCN PAM
cauuuaaaacuuaguuaaau

SEQ ID NO: 6624 - RNA, 20 nt, Artificial Sequence
  targeting sequence with GTCN PAM
aagucaauuggcuguucacu

SEQ ID NO: 6625 - RNA, 20 nt, Artificial Sequence
  targeting sequence with GTCN PAM
auuggcuguucacuuuaacu

SEQ ID NO: 6626 - RNA, 20 nt, Artificial Sequence
  targeting sequence with GTCN PAM
uuuuauucacaaaagacacc

SEQ ID NO: 6627 - RNA, 20 nt, Artificial Sequence
  targeting sequence with GTCN PAM
uuugugaauaaaaagacgau

SEQ ID NO: 6628 - RNA, 20 nt, Artificial Sequence
  targeting sequence with GTCN PAM
cagcuacuggggguggugag

SEQ ID NO: 6629 - RNA, 20 nt, Artificial Sequence
  targeting sequence with GTCN PAM
uaugaucauaacucaaugca

SEQ ID NO: 6630 - RNA, 20 nt, Artificial Sequence
  targeting sequence with GTCN PAM
cacucuguggcuuaggcugg

SEQ ID NO: 6631 - RNA, 20 nt, Artificial Sequence
  targeting sequence with GTCN PAM
uagcuccuggccuauauuuu

SEQ ID NO: 6632 - RNA, 20 nt, Artificial Sequence
  targeting sequence with GTCN PAM
caaacuccugagcucagaug

SEQ ID NO: 6633 - RNA, 20 nt, Artificial Sequence
  targeting sequence with GTCN PAM
cggcuagucucaaacuccug

SEQ ID NO: 6634 - RNA, 20 nt, Artificial Sequence
  targeting sequence with GTCN PAM
cugcaaaaaauacaaaaauu

SEQ ID NO: 6635 - RNA, 20 nt, Artificial Sequence
  targeting sequence with GTCN PAM
cagcuacuugggaggcugag

SEQ ID NO: 6636 - RNA, 20 nt, Artificial Sequence
  targeting sequence with GTCN PAM
aggaguugaaggcugcagug

SEQ ID NO: 6637 - RNA, 20 nt, Artificial Sequence
  targeting sequence with GTCN PAM
cccaggcuggagugcagugg

SEQ ID NO: 6638 - RNA, 20 nt, Artificial Sequence
  targeting sequence with GTCN PAM
cacucugucacccaggcugg

SEQ ID NO: 6639 - RNA, 20 nt, Artificial Sequence
  targeting sequence with GTCN PAM
uuuauucugcaacuacaccc

SEQ ID NO: 6640 - RNA, 20 nt, Artificial Sequence
  targeting sequence with GTCN PAM
uuaaacugaauaaacucagc

SEQ ID NO: 6641 - RNA, 20 nt, Artificial Sequence
  targeting sequence with GTCN PAM
aaguucagugcccgauccuu

SEQ ID NO: 6642 - RNA, 20 nt, Artificial Sequence
  targeting sequence with GTCN PAM
gaaccccccagcaaaaugua

SEQ ID NO: 6643 - RNA, 20 nt, Artificial Sequence
  targeting sequence with GTCN PAM
caagccgcacuccauccuug

SEQ ID NO: 6644 - RNA, 20 nt, Artificial Sequence
  targeting sequence with GTCN PAM
acacccaggaguucugcucc

SEQ ID NO: 6645 - RNA, 20 nt, Artificial Sequence
  targeting sequence with GTCN PAM
agcgaaaccggauuccaacu

SEQ ID NO: 6646 - RNA, 20 nt, Artificial Sequence
  targeting sequence with GTCN PAM
auucccagcucucuggagaa

SEQ ID NO: 6647 - RNA, 20 nt, Artificial Sequence
  targeting sequence with GTCN PAM
gcugccaggacggcaccauu

SEQ ID NO: 6648 - RNA, 20 nt, Artificial Sequence
  targeting sequence with GTCN PAM
uggcagccgaccaccugcgg

SEQ ID NO: 6649 - RNA, 20 nt, Artificial Sequence
  targeting sequence with GTCN PAM
augggcuuuacaaggaccgc

SEQ ID NO: 6650 - RNA, 20 nt, Artificial Sequence
  targeting sequence with GTCN PAM
uuguaaagcccauggacugu

SEQ ID NO: 6651 - RNA, 20 nt, Artificial Sequence
  targeting sequence with GTCN PAM
ugcuaucccuguaggcauag

SEQ ID NO: 6652 - RNA, 20 nt, Artificial Sequence
  targeting sequence with GTCN PAM
gucaugcuaucccuguaggc

SEQ ID NO: 6653 - RNA, 20 nt, Artificial Sequence
  targeting sequence with GTCN PAM
uugugcagcaccugaucacu

SEQ ID NO: 6654 - RNA, 20 nt, Artificial Sequence
  targeting sequence with GTCN PAM
agaccuugggaagagggaca

SEQ ID NO: 6655 - RNA, 20 nt, Artificial Sequence
  targeting sequence with GTCN PAM
ggaccugccucuuaccuuuc

SEQ ID NO: 6656 - RNA, 20 nt, Artificial Sequence
  targeting sequence with GTCN PAM
cucuucccaaggucuggacc

SEQ ID NO: 6657 - RNA, 20 nt, Artificial Sequence
  targeting sequence with GTCN PAM
cucccucuguccacuuaagu

SEQ ID NO: 6658 - RNA, 20 nt, Artificial Sequence
  targeting sequence with GTCN PAM
acuuaaguugcugugcuggu

SEQ ID NO: 6659 - RNA, 20 nt, Artificial Sequence
  targeting sequence with GTCN PAM
auuuaaccagcacagcaacu

SEQ ID NO: 6660 - RNA, 20 nt, Artificial Sequence
  targeting sequence with GTCN PAM
guuacuuaggcaggcuucug

SEQ ID NO: 6661 - RNA, 20 nt, Artificial Sequence
  targeting sequence with GTCN PAM
uauaggacacaaucuucaug

SEQ ID NO: 6662 - RNA, 20 nt, Artificial Sequence
  targeting sequence with GTCN PAM
aagaaaaaaauaucuaguuc

SEQ ID NO: 6663 - RNA, 20 nt, Artificial Sequence
  targeting sequence with GTCN PAM
agaagauugccaucuacaga

SEQ ID NO: 6664 - RNA, 20 nt, Artificial Sequence
  targeting sequence with GTCN PAM
ucugaauacaacucauagau

SEQ ID NO: 6665 - RNA, 20 nt, Artificial Sequence
  targeting sequence with GTCN PAM
gauaaguccucugaauacaa

SEQ ID NO: 6666 - RNA, 20 nt, Artificial Sequence
  targeting sequence with GTCN PAM
ugagccauaaacuggagaau

SEQ ID NO: 6667 - RNA, 20 nt, Artificial Sequence
  targeting sequence with GTCN PAM
caaacuccuggguucaagca

SEQ ID NO: 6668 - RNA, 20 nt, Artificial Sequence
  targeting sequence with GTCN PAM
agcuuccuaaaguacuggga

SEQ ID NO: 6669 - RNA, 20 nt, Artificial Sequence
  targeting sequence with GTCN PAM
agccaagaauaccuuguucu

SEQ ID NO: 6670 - RNA, 20 nt, Artificial Sequence
  targeting sequence with GTCN PAM
uuaaaguauaucuaauccca

SEQ ID NO: 6671 - RNA, 20 nt, Artificial Sequence
  targeting sequence with GTCN PAM
aggaaguuuuaauuccugaa

SEQ ID NO: 6672 - RNA, 20 nt, Artificial Sequence
  targeting sequence with GTCN PAM
aagucaaugccaagagaagu

SEQ ID NO: 6673 - RNA, 20 nt, Artificial Sequence
  targeting sequence with GTCN PAM
augccaagagaaguuuggaa

SEQ ID NO: 6674 - RNA, 20 nt, Artificial Sequence
  targeting sequence with GTCN PAM
uuccaaacuucucuuggcau

SEQ ID NO: 6675 - RNA, 20 nt, Artificial Sequence
  targeting sequence with GTCN PAM
uggauuaacgaugccaaucg

SEQ ID NO: 6676 - RNA, 20 nt, Artificial Sequence
  targeting sequence with GTCN PAM
acauuggguuagauagaugg

SEQ ID NO: 6677 - RNA, 20 nt, Artificial Sequence
  targeting sequence with GTCN PAM
cuaaggggagaaaauaccua

SEQ ID NO: 6678 - RNA, 20 nt, Artificial Sequence
  targeting sequence with GTCN PAM
gggggcacuuauucuguuga

SEQ ID NO: 6679 - RNA, 20 nt, Artificial Sequence
  targeting sequence with GTCN PAM
uucagcggagugaaggagcg

SEQ ID NO: 6680 - RNA, 20 nt, Artificial Sequence
  targeting sequence with GTCN PAM
cucauucguuacaucaaggu

SEQ ID NO: 6681 - RNA, 20 nt, Artificial Sequence
  targeting sequence with GTCN PAM
auucuucagccccacuaaga

SEQ ID NO: 6682 - RNA, 20 nt, Artificial Sequence
  targeting sequence with GTCN PAM
ccugucaggcugauaaucug

SEQ ID NO: 6683 - RNA, 20 nt, Artificial Sequence
  targeting sequence with GTCN PAM
ggcugauaaucugcaugcac

SEQ ID NO: 6684 - RNA, 20 nt, Artificial Sequence
  targeting sequence with GTCN PAM
cccacgugugcaugcagauu

SEQ ID NO: 6685 - RNA, 20 nt, Artificial Sequence
  targeting sequence with GTCN PAM
agcaaugacucugagcuggg

SEQ ID NO: 6686 - RNA, 20 nt, Artificial Sequence
  targeting sequence with GTCN PAM
uugcuagacgggucacccac

SEQ ID NO: 6687 - RNA, 20 nt, Artificial Sequence
  targeting sequence with GTCN PAM
ucaaaaaacugaacucaggc

SEQ ID NO: 6688 - RNA, 20 nt, Artificial Sequence
  targeting sequence with GTCN PAM
ccagaaggugggagauuugu

SEQ ID NO: 6689 - RNA, 20 nt, Artificial Sequence
  targeting sequence with GTCN PAM
gcuccugauuagggcagcga

SEQ ID NO: 6690 - RNA, 20 nt, Artificial Sequence
  targeting sequence with GTCN PAM
uaaagaaugcuggguccuca

SEQ ID NO: 6691 - RNA, 20 nt, Artificial Sequence
  targeting sequence with GTCN PAM
ucaagauacugauagauguc

SEQ ID NO: 6692 - RNA, 20 nt, Artificial Sequence
  targeting sequence with GTCN PAM
uaagcaaaaugggcccuuug

SEQ ID NO: 6693 - RNA, 20 nt, Artificial Sequence
  targeting sequence with GTCN PAM
cuuucaaaguuccauguagc

SEQ ID NO: 6694 - RNA, 20 nt, Artificial Sequence
  targeting sequence with GTCN PAM
ggcuaaugcagcuacauugu

SEQ ID NO: 6695 - RNA, 20 nt, Artificial Sequence
  targeting sequence with GTCN PAM
ggucuuugcuggggauggaa

SEQ ID NO: 6696 - RNA, 20 nt, Artificial Sequence
  targeting sequence with GTCN PAM
uugcuggggauggaagucac

SEQ ID NO: 6697 - RNA, 20 nt, Artificial Sequence
  targeting sequence with GTCN PAM
cagggcaugagagcaguggg

SEQ ID NO: 6698 - RNA, 20 nt, Artificial Sequence
  targeting sequence with GTCN PAM
agcagcaaugccaaggggag

SEQ ID NO: 6699 - RNA, 20 nt, Artificial Sequence
  targeting sequence with GTCN PAM
uccugggcaggucacuuuac

SEQ ID NO: 6700 - RNA, 20 nt, Artificial Sequence
  targeting sequence with GTCN PAM
cuuuaccucugugaggcugg

SEQ ID NO: 6701 - RNA, 20 nt, Artificial Sequence
  targeting sequence with GTCN PAM
ugcuauguugcccaggcuga

SEQ ID NO: 6702 - RNA, 20 nt, Artificial Sequence
  targeting sequence with GTCN PAM
ugucaguguucauaguagcu

SEQ ID NO: 6703 - RNA, 20 nt, Artificial Sequence
  targeting sequence with GTCN PAM
guguucauaguagcuuuuuc

SEQ ID NO: 6704 - RNA, 20 nt, Artificial Sequence
  targeting sequence with GTCN PAM
cgaacuaacacaggaaaaag

SEQ ID NO: 6705 - RNA, 20 nt, Artificial Sequence
  targeting sequence with GTCN PAM
ucaacaaauccccaguccga

SEQ ID NO: 6706 - RNA, 20 nt, Artificial Sequence
  targeting sequence with GTCN PAM
gaacagacacugaagugagc

SEQ ID NO: 6707 - RNA, 20 nt, Artificial Sequence
  targeting sequence with GTCN PAM
guucggacuggggauuuguu

SEQ ID NO: 6708 - RNA, 20 nt, Artificial Sequence
  targeting sequence with GTCN PAM
cagggcugucauuacuucug

SEQ ID NO: 6709 - RNA, 20 nt, Artificial Sequence
  targeting sequence with GTCN PAM
uuacuucugcagccucugau

SEQ ID NO: 6710 - RNA, 20 nt, Artificial Sequence
  targeting sequence with GTCN PAM
uuuucccugcacagagcuuc

SEQ ID NO: 6711 - RNA, 20 nt, Artificial Sequence
  targeting sequence with GTCN PAM
ccauggcaacaagauccugg

SEQ ID NO: 6712 - RNA, 20 nt, Artificial Sequence
  targeting sequence with GTCN PAM
gucaccauggcaacaagauc

SEQ ID NO: 6713 - RNA, 20 nt, Artificial Sequence
  targeting sequence with GTCN PAM
acgaagaucuucaggaucug

SEQ ID NO: 6714 - RNA, 20 nt, Artificial Sequence
  targeting sequence with GTCN PAM
ugcugaagcaggccacagcu

SEQ ID NO: 6715 - RNA, 20 nt, Artificial Sequence
  targeting sequence with GTCN PAM
aagcagcgcacagcuguggc

SEQ ID NO: 6716 - RNA, 20 nt, Artificial Sequence
  targeting sequence with GTCN PAM
uuuucaucuaccacggccag

SEQ ID NO: 6717 - RNA, 20 nt, Artificial Sequence
  targeting sequence with GTCN PAM
uacaccaggcaagugucauu

SEQ ID NO: 6718 - RNA, 20 nt, Artificial Sequence
  targeting sequence with GTCN PAM
augucauacaccaggcaagu

SEQ ID NO: 6719 - RNA, 20 nt, Artificial Sequence
  targeting sequence with GTCN PAM
cugagggggcccagggacau

SEQ ID NO: 6720 - RNA, 20 nt, Artificial Sequence
  targeting sequence with GTCN PAM
cugggcccccucagggacuu

SEQ ID NO: 6721 - RNA, 20 nt, Artificial Sequence
  targeting sequence with GTCN PAM
cuaaucaaaggaugaugucc

SEQ ID NO: 6722 - RNA, 20 nt, Artificial Sequence
  targeting sequence with GTCN PAM
cugcaggaggcucuccugcu

SEQ ID NO: 6723 - RNA, 20 nt, Artificial Sequence
  targeting sequence with GTCN PAM
cugggaggggcaggggccaa

SEQ ID NO: 6724 - RNA, 20 nt, Artificial Sequence
  targeting sequence with GTCN PAM
cagaggcccugggccacaac

SEQ ID NO: 6725 - RNA, 20 nt, Artificial Sequence
  targeting sequence with GTCN PAM
aggcccugcggcuugugccu

SEQ ID NO: 6726 - RNA, 20 nt, Artificial Sequence
  targeting sequence with GTCN PAM
uugccccauuucuuguucau

SEQ ID NO: 6727 - RNA, 20 nt, Artificial Sequence
  targeting sequence with GTCN PAM
caccccucucagagucauug

SEQ ID NO: 6728 - RNA, 20 nt, Artificial Sequence
  targeting sequence with GTCN PAM
gugucucaccugcugcaggc

SEQ ID NO: 6729 - RNA, 20 nt, Artificial Sequence
  targeting sequence with GTCN PAM
caccugcugcaggccugccu

SEQ ID NO: 6730 - RNA, 20 nt, Artificial Sequence
  targeting sequence with GTCN PAM
augcgcaccuacagcguggg

SEQ ID NO: 6731 - RNA, 20 nt, Artificial Sequence
  targeting sequence with GTCN PAM
ucugaaagggggaaggggau

SEQ ID NO: 6732 - RNA, 20 nt, Artificial Sequence
  targeting sequence with GTCN PAM
uccagcccuguggccugagg

SEQ ID NO: 6733 - RNA, 20 nt, Artificial Sequence
  targeting sequence with GTCN PAM
ccagagaagacagcccggca

SEQ ID NO: 6734 - RNA, 20 nt, Artificial Sequence
  targeting sequence with GTCN PAM
ucucuggugacacacuuccu

SEQ ID NO: 6735 - RNA, 20 nt, Artificial Sequence
  targeting sequence with GTCN PAM
uuguagguggucaggacugg

SEQ ID NO: 6736 - RNA, 20 nt, Artificial Sequence
  targeting sequence with GTCN PAM
ggacugguuuuccagaguga

SEQ ID NO: 6737 - RNA, 20 nt, Artificial Sequence
  targeting sequence with GTCN PAM
ugaccaccuacaaagaccua

SEQ ID NO: 6738 - RNA, 20 nt, Artificial Sequence
  targeting sequence with GTCN PAM
ggaggggcuccagcuuuggg

SEQ ID NO: 6739 - RNA, 20 nt, Artificial Sequence
  targeting sequence with GTCN PAM
ccuuaccaggcuccuccuug

SEQ ID NO: 6740 - RNA, 20 nt, Artificial Sequence
  targeting sequence with GTCN PAM
ggaguggggagcagccucag

SEQ ID NO: 6741 - RNA, 20 nt, Artificial Sequence
  targeting sequence with GTCN PAM
auuagaaggaguuaccuggc

SEQ ID NO: 6742 - RNA, 20 nt, Artificial Sequence
  targeting sequence with GTCN PAM
gucucaacucacucaugucc

SEQ ID NO: 6743 - RNA, 20 nt, Artificial Sequence
  targeting sequence with GTCN PAM
caacucacucauguccuuga

SEQ ID NO: 6744 - RNA, 20 nt, Artificial Sequence
  targeting sequence with GTCN PAM
uugagagaguagaaugguuu

SEQ ID NO: 6745 - RNA, 20 nt, Artificial Sequence
  targeting sequence with GTCN PAM
gcuugaaggcuaugcccucu

SEQ ID NO: 6746 - RNA, 20 nt, Artificial Sequence
  targeting sequence with GTCN PAM
ugccugcaucccuuacugug

SEQ ID NO: 6747 - RNA, 20 nt, Artificial Sequence
  targeting sequence with GTCN PAM
ccuggcagggcugagaauca

SEQ ID NO: 6748 - RNA, 20 nt, Artificial Sequence
  targeting sequence with GTCN PAM
cuguuccccaggaaccaaac

SEQ ID NO: 6749 - RNA, 20 nt, Artificial Sequence
  targeting sequence with GTCN PAM
ucacacuggguguuccaagc

SEQ ID NO: 6750 - RNA, 20 nt, Artificial Sequence
  targeting sequence with GTCN PAM
gcuacaauggcuccaagauc

SEQ ID NO: 6751 - RNA, 20 nt, Artificial Sequence
  targeting sequence with GTCN PAM
ucuccauuucugccguggag

SEQ ID NO: 6752 - RNA, 20 nt, Artificial Sequence
  targeting sequence with GTCN PAM
acucuuagcacuggcaaggc

SEQ ID NO: 6753 - RNA, 20 nt, Artificial Sequence
  targeting sequence with GTCN PAM
uguuuacaggccaggcucag

SEQ ID NO: 6754 - RNA, 20 nt, Artificial Sequence
  targeting sequence with GTCN PAM
augaagugcuggcuguacac

SEQ ID NO: 6755 - RNA, 20 nt, Artificial Sequence
  targeting sequence with GTCN PAM
ucuggccuuuucacucaaca

SEQ ID NO: 6756 - RNA, 20 nt, Artificial Sequence
  targeting sequence with GTCN PAM
guaaaugguaaauguucuua

SEQ ID NO: 6757 - RNA, 20 nt, Artificial Sequence
  targeting sequence with GTCN PAM
acaauuacccuaaauuuugc

SEQ ID NO: 6758 - RNA, 20 nt, Artificial Sequence
  targeting sequence with GTCN PAM
uggcacugaacacugccacc

SEQ ID NO: 6759 - RNA, 20 nt, Artificial Sequence
  targeting sequence with GTCN PAM
cugguguugugcuuuuuaca

SEQ ID NO: 6760 - RNA, 20 nt, Artificial Sequence
  targeting sequence with GTCN PAM
ccaccugccuuguauuuaca

SEQ ID NO: 6761 - RNA, 20 nt, Artificial Sequence
  targeting sequence with GTCN PAM
uguggauguuccacagcuuu

SEQ ID NO: 6762 - RNA, 20 nt, Artificial Sequence
  targeting sequence with GTCN PAM
uacuggacauguuugcugcu

SEQ ID NO: 6763 - RNA, 20 nt, Artificial Sequence
  targeting sequence with GTCN PAM
aguaggacugguaaagaaag

SEQ ID NO: 6764 - RNA, 20 nt, Artificial Sequence
  targeting sequence with GTCN PAM
uugcaccugucccaacuugg

SEQ ID NO: 6765 - RNA, 20 nt, Artificial Sequence
  targeting sequence with GTCN PAM
caacuuggcgccuuggcaua

SEQ ID NO: 6766 - RNA, 20 nt, Artificial Sequence
  targeting sequence with GTCN PAM
aagcacguguaccuuugaaa

SEQ ID NO: 6767 - RNA, 20 nt, Artificial Sequence
  targeting sequence with GTCN PAM
uucaaagguacacgugcuuu

SEQ ID NO: 6768 - RNA, 20 nt, Artificial Sequence
  targeting sequence with GTCN PAM
gucuguuuuccccauacaac

SEQ ID NO: 6769 - RNA, 20 nt, Artificial Sequence
  targeting sequence with GTCN PAM
guuuuccccauacaacucag

SEQ ID NO: 6770 - RNA, 20 nt, Artificial Sequence
  targeting sequence with GTCN PAM
ugaguuucgaggguaucauc

SEQ ID NO: 6771 - RNA, 20 nt, Artificial Sequence
  targeting sequence with GTCN PAM
ugcagucaugaguuucgagg

SEQ ID NO: 6772 - RNA, 20 nt, Artificial Sequence
  targeting sequence with GTCN PAM
ggcauggaugaugggcauuu

SEQ ID NO: 6773 - RNA, 20 nt, Artificial Sequence
  targeting sequence with GTCN PAM
uuuuccucagaucugaauuc

SEQ ID NO: 6774 - RNA, 20 nt, Artificial Sequence
  targeting sequence with GTCN PAM
ugcugccacuuccacccacc

SEQ ID NO: 6775 - RNA, 20 nt, Artificial Sequence
  targeting sequence with GTCN PAM
aggagaagcuguucgugccc

SEQ ID NO: 6776 - RNA, 20 nt, Artificial Sequence
  targeting sequence with GTCN PAM
ucgucauccuugucugcccc

SEQ ID NO: 6777 - RNA, 20 nt, Artificial Sequence
  targeting sequence with GTCN PAM
uccuugucugccccauuaca

SEQ ID NO: 6778 - RNA, 20 nt, Artificial Sequence
  targeting sequence with GTCN PAM
gccccauuacaaacccacgc

SEQ ID NO: 6779 - RNA, 20 nt, Artificial Sequence
  targeting sequence with GTCN PAM
ggauggcaaucuugggagaa

SEQ ID NO: 6780 - RNA, 20 nt, Artificial Sequence
  targeting sequence with GTCN PAM
gagagcagcaaacugcauuu

SEQ ID NO: 6781 - RNA, 20 nt, Artificial Sequence
  targeting sequence with GTCN PAM
uggcagaggaagccccaggc

SEQ ID NO: 6782 - RNA, 20 nt, Artificial Sequence
  targeting sequence with GTCN PAM
ugcugacugcaccaaggcca

SEQ ID NO: 6783 - RNA, 20 nt, Artificial Sequence
  targeting sequence with GTCN PAM
gcaagacuuugcugcugaau

SEQ ID NO: 6784 - RNA, 20 nt, Artificial Sequence
  targeting sequence with GTCN PAM
gcaggauggccuuggugcag

SEQ ID NO: 6785 - RNA, 20 nt, Artificial Sequence
  targeting sequence with GTCN PAM
ggacugccaaggguuaggaa

SEQ ID NO: 6786 - RNA, 20 nt, Artificial Sequence
  targeting sequence with GTCN PAM
ugacccgcugcgucagcagg

SEQ ID NO: 6787 - RNA, 20 nt, Artificial Sequence
  targeting sequence with GTCN PAM
ugagaauguguuuccuaacc

SEQ ID NO: 6788 - RNA, 20 nt, Artificial Sequence
  targeting sequence with GTCN PAM
ccucugccuccggccauccu

SEQ ID NO: 6789 - RNA, 20 nt, Artificial Sequence
  targeting sequence with GTCN PAM
gaugcuuucucccuccucuc

SEQ ID NO: 6790 - RNA, 20 nt, Artificial Sequence
  targeting sequence with GTCN PAM
uggaauuuuugguugccuuu

SEQ ID NO: 6791 - RNA, 20 nt, Artificial Sequence
  targeting sequence with GTCN PAM
ugugcaagaacugguuuguc

SEQ ID NO: 6792 - RNA, 20 nt, Artificial Sequence
  targeting sequence with GTCN PAM
gggcugccaaguaggacaac

SEQ ID NO: 6793 - RNA, 20 nt, Artificial Sequence
  targeting sequence with GTCN PAM
uacuuggcagcccugacaaa

SEQ ID NO: 6794 - RNA, 20 nt, Artificial Sequence
  targeting sequence with GTCN PAM
ccaccgccuugagaagcccu

SEQ ID NO: 6795 - RNA, 20 nt, Artificial Sequence
  targeting sequence with GTCN PAM
auuuuuaaaacuccacucaa

SEQ ID NO: 6796 - RNA, 20 nt, Artificial Sequence
  targeting sequence with GTCN PAM
aaguguuagccauccaucau

SEQ ID NO: 6797 - RNA, 20 nt, Artificial Sequence
  targeting sequence with GTCN PAM
cacucacggggcagucagca

SEQ ID NO: 6798 - RNA, 20 nt, Artificial Sequence
  targeting sequence with GTCN PAM
gcauggcaagcaguuggugu

SEQ ID NO: 6799 - RNA, 20 nt, Artificial Sequence
  targeting sequence with GTCN PAM
ugacucugccaucucaagca

SEQ ID NO: 6800 - RNA, 20 nt, Artificial Sequence
  targeting sequence with GTCN PAM
ggacugaaagcuggugcucc

SEQ ID NO: 6801 - RNA, 20 nt, Artificial Sequence
  targeting sequence with GTCN PAM
agccaaauuucuauuauuau

SEQ ID NO: 6802 - RNA, 20 nt, Artificial Sequence
  targeting sequence with GTCN PAM
guaauaaggagaaauaauaa

SEQ ID NO: 6803 - RNA, 20 nt, Artificial Sequence
  targeting sequence with GTCN PAM
guaaguacagccuguugcaa

SEQ ID NO: 6804 - RNA, 20 nt, Artificial Sequence
  targeting sequence with GTCN PAM
gucaguaaguacagccuguu

SEQ ID NO: 6805 - RNA, 20 nt, Artificial Sequence
  targeting sequence with GTCN PAM
ggaaaggaagaguggagcag

SEQ ID NO: 6806 - RNA, 20 nt, Artificial Sequence
  targeting sequence with GTCN PAM
uguuccuacccccaccuuuc

SEQ ID NO: 6807 - RNA, 20 nt, Artificial Sequence
  targeting sequence with GTCN PAM
ugcccagcucaggcuaccau

SEQ ID NO: 6808 - RNA, 20 nt, Artificial Sequence
  targeting sequence with GTCN PAM
ccagccuaggauguggcuga

SEQ ID NO: 6809 - RNA, 20 nt, Artificial Sequence
  targeting sequence with GTCN PAM
ccugcuccguagccuaugcc

SEQ ID NO: 6810 - RNA, 20 nt, Artificial Sequence
  targeting sequence with GTCN PAM
acucucagagcaaaacaugg

SEQ ID NO: 6811 - RNA, 20 nt, Artificial Sequence
  targeting sequence with GTCN PAM
gucuacucucagagcaaaac

SEQ ID NO: 6812 - RNA, 20 nt, Artificial Sequence
  targeting sequence with GTCN PAM
cauuuuuuagcuuuagaauu

SEQ ID NO: 6813 - RNA, 20 nt, Artificial Sequence
  targeting sequence with GTCN PAM
uugaaauuuccagucccauu

SEQ ID NO: 6814 - RNA, 20 nt, Artificial Sequence
  targeting sequence with GTCN PAM
gucuuugaaauuuccagucc

SEQ ID NO: 6815 - RNA, 20 nt, Artificial Sequence
  targeting sequence with GTCN PAM
uggcugauuucucuucccug

SEQ ID NO: 6816 - RNA, 20 nt, Artificial Sequence
  targeting sequence with GTCN PAM
uggcccaacucaagacucau

SEQ ID NO: 6817 - RNA, 20 nt, Artificial Sequence
  targeting sequence with GTCN PAM
ugaguugggccaugacaucu

SEQ ID NO: 6818 - RNA, 20 nt, Artificial Sequence
  targeting sequence with GTCN PAM
agucaccucuggcuauugcc

SEQ ID NO: 6819 - RNA, 20 nt, Artificial Sequence
  targeting sequence with GTCN PAM
ccucuggcuauugccagcua

SEQ ID NO: 6820 - RNA, 20 nt, Artificial Sequence
  targeting sequence with GTCN PAM
cagcaaauagcuggcaauag

SEQ ID NO: 6821 - RNA, 20 nt, Artificial Sequence
  targeting sequence with GTCN PAM
uuuguccucucugagucucg

SEQ ID NO: 6822 - RNA, 20 nt, Artificial Sequence
  targeting sequence with GTCN PAM
ucucugagucucggucuccu

SEQ ID NO: 6823 - RNA, 20 nt, Artificial Sequence
  targeting sequence with GTCN PAM
cggucuccugggcuguagcc

SEQ ID NO: 6824 - RNA, 20 nt, Artificial Sequence
  targeting sequence with GTCN PAM
ccugggcuguagccagggag

SEQ ID NO: 6825 - RNA, 20 nt, Artificial Sequence
  targeting sequence with GTCN PAM
ugugcaguagguauuauuuc

SEQ ID NO: 6826 - RNA, 20 nt, Artificial Sequence
  targeting sequence with GTCN PAM
ccacaguccugugcaguagg

SEQ ID NO: 6827 - RNA, 20 nt, Artificial Sequence
  targeting sequence with GTCN PAM
uuaggaacuauucaugggca

SEQ ID NO: 6828 - RNA, 20 nt, Artificial Sequence
  targeting sequence with GTCN PAM
ccagggcagggaucaggaga

SEQ ID NO: 6829 - RNA, 20 nt, Artificial Sequence
  targeting sequence with GTCN PAM
aagaaagguaagugauuugc

SEQ ID NO: 6830 - RNA, 20 nt, Artificial Sequence
  targeting sequence with GTCN PAM
cuggaagaagaggccauucc

SEQ ID NO: 6831 - RNA, 20 nt, Artificial Sequence
  targeting sequence with GTCN PAM
ggaauggccucuucuuccag

SEQ ID NO: 6832 - RNA, 20 nt, Artificial Sequence
  targeting sequence with GTCN PAM
gcaaacguagacugggguuc

SEQ ID NO: 6833 - RNA, 20 nt, Artificial Sequence
  targeting sequence with GTCN PAM
acguuugcugacacaaugaa

SEQ ID NO: 6834 - RNA, 20 nt, Artificial Sequence
  targeting sequence with GTCN PAM
agaucgcagguugugccgca

SEQ ID NO: 6835 - RNA, 20 nt, Artificial Sequence
  targeting sequence with GTCN PAM
cagcuuccucugcccuuugu

SEQ ID NO: 6836 - RNA, 20 nt, Artificial Sequence
  targeting sequence with GTCN PAM
ucccaagccccucaagcccc

SEQ ID NO: 6837 - RNA, 20 nt, Artificial Sequence
  targeting sequence with GTCN PAM
ccucuucugcagaguccucc

SEQ ID NO: 6838 - RNA, 20 nt, Artificial Sequence
  targeting sequence with GTCN PAM
cccucaccuggaaugccuuu

SEQ ID NO: 6839 - RNA, 20 nt, Artificial Sequence
  targeting sequence with GTCN PAM
ugagagaggugcaggaugga

SEQ ID NO: 6840 - RNA, 20 nt, Artificial Sequence
  targeting sequence with GTCN PAM
ucuuuuuuucccuugaugaa

SEQ ID NO: 6841 - RNA, 20 nt, Artificial Sequence
  targeting sequence with GTCN PAM
gcucccauguaccaguaccu

SEQ ID NO: 6842 - RNA, 20 nt, Artificial Sequence
  targeting sequence with GTCN PAM
cagacacugauuggcgugaa

SEQ ID NO: 6843 - RNA, 20 nt, Artificial Sequence
  targeting sequence with GTCN PAM
gugacacccaagcaagcaau

SEQ ID NO: 6844 - RNA, 20 nt, Artificial Sequence
  targeting sequence with GTCN PAM
uuguggggucccuuaagaag

SEQ ID NO: 6845 - RNA, 20 nt, Artificial Sequence
  targeting sequence with GTCN PAM
cuuaagaaggcagaugggga

SEQ ID NO: 6846 - RNA, 20 nt, Artificial Sequence
  targeting sequence with GTCN PAM
augaaucccgccaugaaggu

SEQ ID NO: 6847 - RNA, 20 nt, Artificial Sequence
  targeting sequence with GTCN PAM
uuuccuggccuagucuauga

SEQ ID NO: 6848 - RNA, 20 nt, Artificial Sequence
  targeting sequence with GTCN PAM
augaaagcuagagagauggc

SEQ ID NO: 6849 - RNA, 20 nt, Artificial Sequence
  targeting sequence with GTCN PAM
auuaaugagcugcucauuuu

SEQ ID NO: 6850 - RNA, 20 nt, Artificial Sequence
  targeting sequence with GTCN PAM
auauucccgggcugacauug

SEQ ID NO: 6851 - RNA, 20 nt, Artificial Sequence
  targeting sequence with GTCN PAM
gcccgggaauauggacaaaa

SEQ ID NO: 6852 - RNA, 20 nt, Artificial Sequence
  targeting sequence with GTCN PAM
cucuuugccacuccuucaau

SEQ ID NO: 6853 - RNA, 20 nt, Artificial Sequence
  targeting sequence with GTCN PAM
ugaucuaacccaaggcgggc

SEQ ID NO: 6854 - RNA, 20 nt, Artificial Sequence
  targeting sequence with GTCN PAM
ccucucuucaugccuacaag

SEQ ID NO: 6855 - RNA, 20 nt, Artificial Sequence
  targeting sequence with GTCN PAM
agucuccucucuucaugccu

SEQ ID NO: 6856 - RNA, 20 nt, Artificial Sequence
  targeting sequence with GTCN PAM
gguccagucuccucucuuca

SEQ ID NO: 6857 - RNA, 20 nt, Artificial Sequence
  targeting sequence with GTCN PAM
uggucugguccagucuccuc

SEQ ID NO: 6858 - RNA, 20 nt, Artificial Sequence
  targeting sequence with GTCN PAM
cauaaggggcucugggaccu

SEQ ID NO: 6859 - RNA, 20 nt, Artificial Sequence
  targeting sequence with GTCN PAM
cagagccccuuaugugacac

SEQ ID NO: 6860 - RNA, 20 nt, Artificial Sequence
  targeting sequence with GTCN PAM
ucccaguucugaaauggggg

SEQ ID NO: 6861 - RNA, 20 nt, Artificial Sequence
  targeting sequence with GTCN PAM
ugaggcuuaacugagauguu

SEQ ID NO: 6862 - RNA, 20 nt, Artificial Sequence
  targeting sequence with GTCN PAM
ucaguguaggaaaguggaga

SEQ ID NO: 6863 - RNA, 20 nt, Artificial Sequence
  targeting sequence with GTCN PAM
ugcucuauggcccaggcugg

SEQ ID NO: 6864 - RNA, 20 nt, Artificial Sequence
  targeting sequence with GTCN PAM
gagucuugcucuauggccca

SEQ ID NO: 6865 - RNA, 20 nt, Artificial Sequence
  targeting sequence with GTCN PAM
cccucccugcuggcauuucu

SEQ ID NO: 6866 - RNA, 20 nt, Artificial Sequence
  targeting sequence with GTCN PAM
ucucccucccugcuggcauu

SEQ ID NO: 6867 - RNA, 20 nt, Artificial Sequence
  targeting sequence with GTCN PAM
caauauuuaaacaaauauau

SEQ ID NO: 6868 - RNA, 20 nt, Artificial Sequence
  targeting sequence with GTCN PAM
ccgucucaauauuuaaacaa

SEQ ID NO: 6869 - RNA, 20 nt, Artificial Sequence
  targeting sequence with GTCN PAM
ugaacuccugggcucaagca

SEQ ID NO: 6870 - RNA, 20 nt, Artificial Sequence
  targeting sequence with GTCN PAM
ucuugccucagccucccaaa

SEQ ID NO: 6871 - RNA, 20 nt, Artificial Sequence
  targeting sequence with GTCN PAM
aucucuaggaaccacuauau

SEQ ID NO: 6872 - RNA, 20 nt, Artificial Sequence
  targeting sequence with GTCN PAM
ggcgggagcucagcagcucu

SEQ ID NO: 6873 - RNA, 20 nt, Artificial Sequence
  targeting sequence with GTCN PAM
caaggccccugaaugagcuc

SEQ ID NO: 6874 - RNA, 20 nt, Artificial Sequence
  targeting sequence with GTCN PAM
gagucacaaggccccugaau

SEQ ID NO: 6875 - RNA, 20 nt, Artificial Sequence
  targeting sequence with GTCN PAM
gggugccuggucagagucac

SEQ ID NO: 6876 - RNA, 20 nt, Artificial Sequence
  targeting sequence with GTCN PAM
gguugaaggaacucggaaac

SEQ ID NO: 6877 - RNA, 20 nt, Artificial Sequence
  targeting sequence with GTCN PAM
aggauuugcccauuaauaaa

SEQ ID NO: 6878 - RNA, 20 nt, Artificial Sequence
  targeting sequence with GTCN PAM
uucuagcuguagcucagcug

SEQ ID NO: 6879 - RNA, 20 nt, Artificial Sequence
  targeting sequence with GTCN PAM
guagcaggccccuuuccaca

SEQ ID NO: 6880 - RNA, 20 nt, Artificial Sequence
  targeting sequence with GTCN PAM
ucgcucugagccuacuucuc

SEQ ID NO: 6881 - RNA, 20 nt, Artificial Sequence
  targeting sequence with GTCN PAM
gaguccucgcucugagccua

SEQ ID NO: 6882 - RNA, 20 nt, Artificial Sequence
  targeting sequence with GTCN PAM
uacacaucacccucuagauc

SEQ ID NO: 6883 - RNA, 20 nt, Artificial Sequence
  targeting sequence with GTCN PAM
caagcuguaggucuuacaca

SEQ ID NO: 6884 - RNA, 20 nt, Artificial Sequence
  targeting sequence with GTCN PAM
uagcccuguguuccuuggcc

SEQ ID NO: 6885 - RNA, 20 nt, Artificial Sequence
  targeting sequence with GTCN PAM
gaaccuggcaaacaaguguu

SEQ ID NO: 6886 - RNA, 20 nt, Artificial Sequence
  targeting sequence with GTCN PAM
gagcaugagcagggguggga

SEQ ID NO: 6887 - RNA, 20 nt, Artificial Sequence
  targeting sequence with GTCN PAM
ugaucuguuuaauugaccag

SEQ ID NO: 6888 - RNA, 20 nt, Artificial Sequence
  targeting sequence with GTCN PAM
auuaaacagaucaugacacc

SEQ ID NO: 6889 - RNA, 20 nt, Artificial Sequence
  targeting sequence with GTCN PAM
acauucuaacagggaaagcu

SEQ ID NO: 6890 - RNA, 20 nt, Artificial Sequence
  targeting sequence with GTCN PAM
cccuccacaauucagagguc

SEQ ID NO: 6891 - RNA, 20 nt, Artificial Sequence
  targeting sequence with GTCN PAM
cggccccugucccccuccac

SEQ ID NO: 6892 - RNA, 20 nt, Artificial Sequence
  targeting sequence with GTCN PAM
ucagucucuugacaggaagc

SEQ ID NO: 6893 - RNA, 20 nt, Artificial Sequence
  targeting sequence with GTCN PAM
cuugacaggaagccuggucc

SEQ ID NO: 6894 - RNA, 20 nt, Artificial Sequence
  targeting sequence with GTCN PAM
agagacugaggacccaggga

SEQ ID NO: 6895 - RNA, 20 nt, Artificial Sequence
  targeting sequence with GTCN PAM
ugugggaugaaaagauaaag

SEQ ID NO: 6896 - RNA, 20 nt, Artificial Sequence
  targeting sequence with GTCN PAM
ccugcaaggcaggccgggga

SEQ ID NO: 6897 - RNA, 20 nt, Artificial Sequence
  targeting sequence with GTCN PAM
ccggccugccuugcagguga

SEQ ID NO: 6898 - RNA, 20 nt, Artificial Sequence
  targeting sequence with GTCN PAM
uuucaggagggaggaugcca

SEQ ID NO: 6899 - RNA, 20 nt, Artificial Sequence
  targeting sequence with GTCN PAM
ggauugcucugcguguucag

SEQ ID NO: 6900 - RNA, 20 nt, Artificial Sequence
  targeting sequence with GTCN PAM
gcccauuuugaauggggcaa

SEQ ID NO: 6901 - RNA, 20 nt, Artificial Sequence
  targeting sequence with GTCN PAM
ccauuuauugccccauucaa

SEQ ID NO: 6902 - RNA, 20 nt, Artificial Sequence
  targeting sequence with GTCN PAM
ggcugcuuucagguggcuuu

SEQ ID NO: 6903 - RNA, 20 nt, Artificial Sequence
  targeting sequence with GTCN PAM
gcuuguuccucagaaacuuc

SEQ ID NO: 6904 - RNA, 20 nt, Artificial Sequence
  targeting sequence with GTCN PAM
augaguuaaagucucuggcu

SEQ ID NO: 6905 - RNA, 20 nt, Artificial Sequence
  targeting sequence with GTCN PAM
cuggcuuuacugugaguuca

SEQ ID NO: 6906 - RNA, 20 nt, Artificial Sequence
  targeting sequence with GTCN PAM
guggaaggcaaacucuuuau

SEQ ID NO: 6907 - RNA, 20 nt, Artificial Sequence
  targeting sequence with GTCN PAM
uuauacccucucagcuuucc

SEQ ID NO: 6908 - RNA, 20 nt, Artificial Sequence
  targeting sequence with GTCN PAM
ccugugucuguggcaccacu

SEQ ID NO: 6909 - RNA, 20 nt, Artificial Sequence
  targeting sequence with GTCN PAM
guggcaccacuggguaggca

SEQ ID NO: 6910 - RNA, 20 nt, Artificial Sequence
  targeting sequence with GTCN PAM
ccugcauucuacccauguug

SEQ ID NO: 6911 - RNA, 20 nt, Artificial Sequence
  targeting sequence with GTCN PAM
cucaucaguccaugcaucuc

SEQ ID NO: 6912 - RNA, 20 nt, Artificial Sequence
  targeting sequence with GTCN PAM
augcaucucauccucuccug

SEQ ID NO: 6913 - RNA, 20 nt, Artificial Sequence
  targeting sequence with GTCN PAM
cgcagcaucacagcaggaga

SEQ ID NO: 6914 - RNA, 20 nt, Artificial Sequence
  targeting sequence with GTCN PAM
gaccggcuuguucuucuuug

SEQ ID NO: 6915 - RNA, 20 nt, Artificial Sequence
  targeting sequence with GTCN PAM
gacccucuggggggucacgc

SEQ ID NO: 6916 - RNA, 20 nt, Artificial Sequence
  targeting sequence with GTCN PAM
agagucucccaaggaggcac

SEQ ID NO: 6917 - RNA, 20 nt, Artificial Sequence
  targeting sequence with GTCN PAM
cccaaggaggcaccgccaca

SEQ ID NO: 6918 - RNA, 20 nt, Artificial Sequence
  targeting sequence with GTCN PAM
guggcggugccuccuuggga

SEQ ID NO: 6919 - RNA, 20 nt, Artificial Sequence
  targeting sequence with GTCN PAM
uuuugagaucagguaaaaca

SEQ ID NO: 6920 - RNA, 20 nt, Artificial Sequence
  targeting sequence with GTCN PAM
uugcuguucuuuacaugguc

SEQ ID NO: 6921 - RNA, 20 nt, Artificial Sequence
  targeting sequence with GTCN PAM
aaucccauggauaaagccau

SEQ ID NO: 6922 - RNA, 20 nt, Artificial Sequence
  targeting sequence with GTCN PAM
agauagagcuugacuuccca

SEQ ID NO: 6923 - RNA, 20 nt, Artificial Sequence
  targeting sequence with GTCN PAM
agcucuaucuagacagugag

SEQ ID NO: 6924 - RNA, 20 nt, Artificial Sequence
  targeting sequence with GTCN PAM
ucuuggcuucaaaagugggu

SEQ ID NO: 6925 - RNA, 20 nt, Artificial Sequence
  targeting sequence with GTCN PAM
uguacucugaugaaggccug

SEQ ID NO: 6926 - RNA, 20 nt, Artificial Sequence
  targeting sequence with GTCN PAM
ucaaggcucuugccuguuag

SEQ ID NO: 6927 - RNA, 20 nt, Artificial Sequence
  targeting sequence with GTCN PAM
gggcaucugggccacagccu

SEQ ID NO: 6928 - RNA, 20 nt, Artificial Sequence
  targeting sequence with GTCN PAM
cccccaguguggccacucug

SEQ ID NO: 6929 - RNA, 20 nt, Artificial Sequence
  targeting sequence with GTCN PAM
gugaaaagggauuggaccua

SEQ ID NO: 6930 - RNA, 20 nt, Artificial Sequence
  targeting sequence with GTCN PAM
aaucccuuuucacagacuag

SEQ ID NO: 6931 - RNA, 20 nt, Artificial Sequence
  targeting sequence with GTCN PAM
auuucuggggaauggagcuc

SEQ ID NO: 6932 - RNA, 20 nt, Artificial Sequence
  targeting sequence with GTCN PAM
gaacugagcgccccagaguu

SEQ ID NO: 6933 - RNA, 20 nt, Artificial Sequence
  targeting sequence with GTCN PAM
auauucucagccagaaacag

SEQ ID NO: 6934 - RNA, 20 nt, Artificial Sequence
  targeting sequence with GTCN PAM
uccaaacccaauaggccugc

SEQ ID NO: 6935 - RNA, 20 nt, Artificial Sequence
  targeting sequence with GTCN PAM
acacuaugcuuuuuuuuucu

SEQ ID NO: 6936 - RNA, 20 nt, Artificial Sequence
  targeting sequence with GTCN PAM
auaaugcuagcacuuuggga

SEQ ID NO: 6937 - RNA, 20 nt, Artificial Sequence
  targeting sequence with GTCN PAM
aagggccgggcaugguagcu

SEQ ID NO: 6938 - RNA, 20 nt, Artificial Sequence
  targeting sequence with GTCN PAM
ggcugucuguuaaaaggcau

SEQ ID NO: 6939 - RNA, 20 nt, Artificial Sequence
  targeting sequence with GTCN PAM
guuaaaaggcauauacauuu

SEQ ID NO: 6940 - RNA, 20 nt, Artificial Sequence
  targeting sequence with GTCN PAM
ugucccucucauucauuucc

SEQ ID NO: 6941 - RNA, 20 nt, Artificial Sequence
  targeting sequence with GTCN PAM
cucucauucauuuccccaua

SEQ ID NO: 6942 - RNA, 20 nt, Artificial Sequence
  targeting sequence with GTCN PAM
ugggccagcccuugugccga

SEQ ID NO: 6943 - RNA, 20 nt, Artificial Sequence
  targeting sequence with GTCN PAM
ugcugagccuuaauuuccuc

SEQ ID NO: 6944 - RNA, 20 nt, Artificial Sequence
  targeting sequence with GTCN PAM
auagccaaaaacuuggugga

SEQ ID NO: 6945 - RNA, 20 nt, Artificial Sequence
  targeting sequence with GTCN PAM
auuuccuaagcucaugcucu

SEQ ID NO: 6946 - RNA, 20 nt, Artificial Sequence
  targeting sequence with GTCN PAM
gcagcacugggcauuuugag

SEQ ID NO: 6947 - RNA, 20 nt, Artificial Sequence
  targeting sequence with GTCN PAM
ucaccugaagccaaggagca

SEQ ID NO: 6948 - RNA, 20 nt, Artificial Sequence
  targeting sequence with GTCN PAM
aacuauuacuugucacaucu

SEQ ID NO: 6949 - RNA, 20 nt, Artificial Sequence
  targeting sequence with GTCN PAM
caucuuacuggggucaaaau

SEQ ID NO: 6950 - RNA, 20 nt, Artificial Sequence
  targeting sequence with GTCN PAM
aaauguaguccucuccucgu

SEQ ID NO: 6951 - RNA, 20 nt, Artificial Sequence
  targeting sequence with GTCN PAM
ucuccucguaugcuaugagc

SEQ ID NO: 6952 - RNA, 20 nt, Artificial Sequence
  targeting sequence with GTCN PAM
cuugaaaaaaaguaaagugc

SEQ ID NO: 6953 - RNA, 20 nt, Artificial Sequence
  targeting sequence with GTCN PAM
auauagagcacacucaaagg

SEQ ID NO: 6954 - RNA, 20 nt, Artificial Sequence
  targeting sequence with GTCN PAM
gcaggcagucgauauagagc

SEQ ID NO: 6955 - RNA, 20 nt, Artificial Sequence
  targeting sequence with GTCN PAM
ugcugacggggggaaagaac

SEQ ID NO: 6956 - RNA, 20 nt, Artificial Sequence
  targeting sequence with GTCN PAM
gcaggacaagaacaucuccc

SEQ ID NO: 6957 - RNA, 20 nt, Artificial Sequence
  targeting sequence with GTCN PAM
acaugggcagguucuuuccc

SEQ ID NO: 6958 - RNA, 20 nt, Artificial Sequence
  targeting sequence with GTCN PAM
uggugauauccuggggccua

SEQ ID NO: 6959 - RNA, 20 nt, Artificial Sequence
  targeting sequence with GTCN PAM
aguaaaaccuuuuuuguuug

SEQ ID NO: 6960 - RNA, 20 nt, Artificial Sequence
  targeting sequence with GTCN PAM
ggcuauauugaccaggcugg

SEQ ID NO: 6961 - RNA, 20 nt, Artificial Sequence
  targeting sequence with GTCN PAM
auauagccagacucuaucuc

SEQ ID NO: 6962 - RNA, 20 nt, Artificial Sequence
  targeting sequence with GTCN PAM
aaagaggaggaucacuugag

SEQ ID NO: 6963 - RNA, 20 nt, Artificial Sequence
  targeting sequence with GTCN PAM
agccaaaaucaaucuuuuau

SEQ ID NO: 6964 - RNA, 20 nt, Artificial Sequence
  targeting sequence with GTCN PAM
guauggaagcauguugccuc

SEQ ID NO: 6965 - RNA, 20 nt, Artificial Sequence
  targeting sequence with GTCN PAM
aagaguuugauucaaugucu

SEQ ID NO: 6966 - RNA, 20 nt, Artificial Sequence
  targeting sequence with GTCN PAM
uaucguccuccaauaugcug

SEQ ID NO: 6967 - RNA, 20 nt, Artificial Sequence
  targeting sequence with GTCN PAM
uccaauaugcugcucuuucu

SEQ ID NO: 6968 - RNA, 20 nt, Artificial Sequence
  targeting sequence with GTCN PAM
acagcucgaguauuuguaaa

SEQ ID NO: 6969 - RNA, 20 nt, Artificial Sequence
  targeting sequence with GTCN PAM
gggaacauucgcuugucuac

SEQ ID NO: 6970 - RNA, 20 nt, Artificial Sequence
  targeting sequence with GTCN PAM
ccaacaacacacacacacac

SEQ ID NO: 6971 - RNA, 20 nt, Artificial Sequence
  targeting sequence with GTCN PAM
uuugaagcaagugauguccc

SEQ ID NO: 6972 - RNA, 20 nt, Artificial Sequence
  targeting sequence with GTCN PAM
gacagaacugcguccaaauu

SEQ ID NO: 6973 - RNA, 20 nt, Artificial Sequence
  targeting sequence with GTCN PAM
gacuccagauauuccuugua

SEQ ID NO: 6974 - RNA, 20 nt, Artificial Sequence
  targeting sequence with GTCN PAM
aaauuccagcucugucugac

SEQ ID NO: 6975 - RNA, 20 nt, Artificial Sequence
  targeting sequence with GTCN PAM
gacccugaccuguuccucuu

SEQ ID NO: 6976 - RNA, 20 nt, Artificial Sequence
  targeting sequence with GTCN PAM
gacagagcuggaauuuggac

SEQ ID NO: 6977 - RNA, 20 nt, Artificial Sequence
  targeting sequence with GTCN PAM
gggucagacagagcuggaau

SEQ ID NO: 6978 - RNA, 20 nt, Artificial Sequence
  targeting sequence with GTCN PAM
cagcguccuucacucuaaca

SEQ ID NO: 6979 - RNA, 20 nt, Artificial Sequence
  targeting sequence with GTCN PAM
uucacucuaacacuugggua

SEQ ID NO: 6980 - RNA, 20 nt, Artificial Sequence
  targeting sequence with GTCN PAM
cacuacccaaguguuagagu

SEQ ID NO: 6981 - RNA, 20 nt, Artificial Sequence
  targeting sequence with GTCN PAM
cugagaggaauaaaggggcc

SEQ ID NO: 6982 - RNA, 20 nt, Artificial Sequence
  targeting sequence with GTCN PAM
uacgauaucccuacuucuaa

SEQ ID NO: 6983 - RNA, 20 nt, Artificial Sequence
  targeting sequence with GTCN PAM
uccuauuuuauuggucuccc

SEQ ID NO: 6984 - RNA, 20 nt, Artificial Sequence
  targeting sequence with GTCN PAM
cccucuugggcagaaacccu

SEQ ID NO: 6985 - RNA, 20 nt, Artificial Sequence
  targeting sequence with GTCN PAM
uccccaugagccacaacucu

SEQ ID NO: 6986 - RNA, 20 nt, Artificial Sequence
  targeting sequence with GTCN PAM
uggaugagucagagcacaca

SEQ ID NO: 6987 - RNA, 20 nt, Artificial Sequence
  targeting sequence with GTCN PAM
gagcacacacuauucaaacu

SEQ ID NO: 6988 - RNA, 20 nt, Artificial Sequence
  targeting sequence with GTCN PAM
uagccuuggaauacacagga

SEQ ID NO: 6989 - RNA, 20 nt, Artificial Sequence
  targeting sequence with GTCN PAM
gguaaaagccugcuuuuguu

SEQ ID NO: 6990 - RNA, 20 nt, Artificial Sequence
  targeting sequence with GTCN PAM
agccuucccagcgggaaccu

SEQ ID NO: 6991 - RNA, 20 nt, Artificial Sequence
  targeting sequence with GTCN PAM
cucuccccuagguucccgcu

SEQ ID NO: 6992 - RNA, 20 nt, Artificial Sequence
  targeting sequence with GTCN PAM
cuccccgcuucuuccucucc

SEQ ID NO: 6993 - RNA, 20 nt, Artificial Sequence
  targeting sequence with GTCN PAM
uuguuggucucuccccgcuu

SEQ ID NO: 6994 - RNA, 20 nt, Artificial Sequence
  targeting sequence with GTCN PAM
guguacauuucaagcgcgag

SEQ ID NO: 6995 - RNA, 20 nt, Artificial Sequence
  targeting sequence with GTCN PAM
caggcccaagcuccagcuug

SEQ ID NO: 6996 - RNA, 20 nt, Artificial Sequence
  targeting sequence with GTCN PAM
aaguuauuuuccccaagagu

SEQ ID NO: 6997 - RNA, 20 nt, Artificial Sequence
  targeting sequence with GTCN PAM
gcagcacucuuggggaaaau

SEQ ID NO: 6998 - RNA, 20 nt, Artificial Sequence
  targeting sequence with GTCN PAM
cagaaaggauguggggaaac

SEQ ID NO: 6999 - RNA, 20 nt, Artificial Sequence
  targeting sequence with GTCN PAM
uuuguuuaccaguuucccca

SEQ ID NO: 7000 - RNA, 20 nt, Artificial Sequence
  targeting sequence with GTCN PAM
guuuuaggugaguuucaacc

SEQ ID NO: 7001 - RNA, 20 nt, Artificial Sequence
  targeting sequence with GTCN PAM
gccuuaaaggucaguuuuag

SEQ ID NO: 7002 - RNA, 20 nt, Artificial Sequence
  targeting sequence with GTCN PAM
gcccccuuggugucagccuu

SEQ ID NO: 7003 - RNA, 20 nt, Artificial Sequence
  targeting sequence with GTCN PAM
gaacugccauagucugcccc

SEQ ID NO: 7004 - RNA, 20 nt, Artificial Sequence
  targeting sequence with GTCN PAM
cugaugaaggucugaacugc

SEQ ID NO: 7005 - RNA, 20 nt, Artificial Sequence
  targeting sequence with GTCN PAM
acaccagcacaaucccuuca

SEQ ID NO: 7006 - RNA, 20 nt, Artificial Sequence
  targeting sequence with GTCN PAM
cccacaaauccucucaaucc

SEQ ID NO: 7007 - RNA, 20 nt, Artificial Sequence
  targeting sequence with GTCN PAM
ggagccgccaagaaucggug

SEQ ID NO: 7008 - RNA, 20 nt, Artificial Sequence
  targeting sequence with GTCN PAM
ucaggcaggagccgguccug

SEQ ID NO: 7009 - RNA, 20 nt, Artificial Sequence
  targeting sequence with GTCN PAM
ugccgaucaugcaggacgac

SEQ ID NO: 7010 - RNA, 20 nt, Artificial Sequence
  targeting sequence with GTCN PAM
ugcaugaucggcaggaccgg

SEQ ID NO: 7011 - RNA, 20 nt, Artificial Sequence
  targeting sequence with GTCN PAM
uccugcaugaucggcaggac

SEQ ID NO: 7012 - RNA, 20 nt, Artificial Sequence
  targeting sequence with GTCN PAM
uggacuucucacugggcuuc

SEQ ID NO: 7013 - RNA, 20 nt, Artificial Sequence
  targeting sequence with GTCN PAM
aggacaaucagcaggugcua

SEQ ID NO: 7014 - RNA, 20 nt, Artificial Sequence
  targeting sequence with GTCN PAM
ggcagagccuccgcccuccc

SEQ ID NO: 7015 - RNA, 20 nt, Artificial Sequence
  targeting sequence with GTCN PAM
caaugcaaaagggaaucucu

SEQ ID NO: 7016 - RNA, 20 nt, Artificial Sequence
  targeting sequence with GTCN PAM
aggaagcuccucuccuacac

SEQ ID NO: 7017 - RNA, 20 nt, Artificial Sequence
  targeting sequence with GTCN PAM
agacauuugcaguucagucu

SEQ ID NO: 7018 - RNA, 20 nt, Artificial Sequence
  targeting sequence with GTCN PAM
ugacugcucugggcuccuua

SEQ ID NO: 7019 - RNA, 20 nt, Artificial Sequence
  targeting sequence with GTCN PAM
aagcaagguucaaagaggcu

SEQ ID NO: 7020 - RNA, 20 nt, Artificial Sequence
  targeting sequence with GTCN PAM
uccuuccaucaaggggcuuu

SEQ ID NO: 7021 - RNA, 20 nt, Artificial Sequence
  targeting sequence with GTCN PAM
aaaguggcucucaguauguu

SEQ ID NO: 7022 - RNA, 20 nt, Artificial Sequence
  targeting sequence with GTCN PAM
cuucauaacauacugagagc

SEQ ID NO: 7023 - RNA, 20 nt, Artificial Sequence
  targeting sequence with GTCN PAM
aacaggugguggaagagcac

SEQ ID NO: 7024 - RNA, 20 nt, Artificial Sequence
  targeting sequence with GTCN PAM
ugggcaacaucacaggccac

SEQ ID NO: 7025 - RNA, 20 nt, Artificial Sequence
  targeting sequence with GTCN PAM
ugaugaacaauagguccugg

SEQ ID NO: 7026 - RNA, 20 nt, Artificial Sequence
  targeting sequence with GTCN PAM
aaguccugaugaacaauagg

SEQ ID NO: 7027 - RNA, 20 nt, Artificial Sequence
  targeting sequence with GTCN PAM
uuucaccuuagugauuucuu

SEQ ID NO: 7028 - RNA, 20 nt, Artificial Sequence
  targeting sequence with GTCN PAM
cagguacggagugaagaaau

SEQ ID NO: 7029 - RNA, 20 nt, Artificial Sequence
  targeting sequence with GTCN PAM
ccuuuccuacccucccucag

SEQ ID NO: 7030 - RNA, 20 nt, Artificial Sequence
  targeting sequence with GTCN PAM
uugguggggccugagggagg

SEQ ID NO: 7031 - RNA, 20 nt, Artificial Sequence
  targeting sequence with GTCN PAM
gugcaucucugcuuccgggg

SEQ ID NO: 7032 - RNA, 20 nt, Artificial Sequence
  targeting sequence with GTCN PAM
ugaucccuuaaggguucauc

SEQ ID NO: 7033 - RNA, 20 nt, Artificial Sequence
  targeting sequence with GTCN PAM
ggcauuuucuacugcagcac

SEQ ID NO: 7034 - RNA, 20 nt, Artificial Sequence
  targeting sequence with GTCN PAM
agaccagccugggcaauaug

SEQ ID NO: 7035 - RNA, 20 nt, Artificial Sequence
  targeting sequence with GTCN PAM
cgaccuccugagcucaagca

SEQ ID NO: 7036 - RNA, 20 nt, Artificial Sequence
  targeting sequence with GTCN PAM
cagcuacugggaggcuaagg

SEQ ID NO: 7037 - RNA, 20 nt, Artificial Sequence
  targeting sequence with GTCN PAM
cccaggcuggaaugcagugg

SEQ ID NO: 7038 - RNA, 20 nt, Artificial Sequence
  targeting sequence with GTCN PAM
ugcucugucacccaggcugg

SEQ ID NO: 7039 - RNA, 20 nt, Artificial Sequence
  targeting sequence with GTCN PAM
aaaaaaaauaauaaaaugcc

SEQ ID NO: 7040 - RNA, 20 nt, Artificial Sequence
  targeting sequence with GTCN PAM
ucccacagaaagaaacugca

SEQ ID NO: 7041 - RNA, 20 nt, Artificial Sequence
  targeting sequence with GTCN PAM
cuauuaccaucugagaaggg

SEQ ID NO: 7042 - RNA, 20 nt, Artificial Sequence
  targeting sequence with GTCN PAM
ugagauuugcacagaauaau

SEQ ID NO: 7043 - RNA, 20 nt, Artificial Sequence
  targeting sequence with GTCN PAM
cguguggccccucucaucuu

SEQ ID NO: 7044 - RNA, 20 nt, Artificial Sequence
  targeting sequence with GTCN PAM
accacaguguaaggaggggc

SEQ ID NO: 7045 - RNA, 20 nt, Artificial Sequence
  targeting sequence with GTCN PAM
cucuaugaagguaaauacuc

SEQ ID NO: 7046 - RNA, 20 nt, Artificial Sequence
  targeting sequence with GTCN PAM
cagaguauuuaccuucauag

SEQ ID NO: 7047 - RNA, 20 nt, Artificial Sequence
  targeting sequence with GTCN PAM
gaauuugagaaauauguacc

SEQ ID NO: 7048 - RNA, 20 nt, Artificial Sequence
  targeting sequence with GTCN PAM
ugauuaacguggcauauuuu

SEQ ID NO: 7049 - RNA, 20 nt, Artificial Sequence
  targeting sequence with GTCN PAM
cuuauccagaaagcauacaa

SEQ ID NO: 7050 - RNA, 20 nt, Artificial Sequence
  targeting sequence with GTCN PAM
cauucaucacucagcacagc

SEQ ID NO: 7051 - RNA, 20 nt, Artificial Sequence
  targeting sequence with GTCN PAM
acuucagggccaagucuuug

SEQ ID NO: 7052 - RNA, 20 nt, Artificial Sequence
  targeting sequence with GTCN PAM
uugccauggccccagauaau

SEQ ID NO: 7053 - RNA, 20 nt, Artificial Sequence
  targeting sequence with GTCN PAM
aaaagcuuccuucaaggcuc

SEQ ID NO: 7054 - RNA, 20 nt, Artificial Sequence
  targeting sequence with GTCN PAM
cagcucccugagugaccagc

SEQ ID NO: 7055 - RNA, 20 nt, Artificial Sequence
  targeting sequence with GTCN PAM
cucagggagcugugacuuca

SEQ ID NO: 7056 - RNA, 20 nt, Artificial Sequence
  targeting sequence with GTCN PAM
ccccugguccccugagcacu

SEQ ID NO: 7057 - RNA, 20 nt, Artificial Sequence
  targeting sequence with GTCN PAM
ccugagcacucacugaaguc

SEQ ID NO: 7058 - RNA, 20 nt, Artificial Sequence
  targeting sequence with GTCN PAM
cuuugaaggacauuucuagu

SEQ ID NO: 7059 - RNA, 20 nt, Artificial Sequence
  targeting sequence with GTCN PAM
uucaaagggacuucagugag

SEQ ID NO: 7060 - RNA, 20 nt, Artificial Sequence
  targeting sequence with GTCN PAM
ccuaagaugccuguuuuccu

SEQ ID NO: 7061 - RNA, 20 nt, Artificial Sequence
  targeting sequence with GTCN PAM
guaaaggcccaaacuaggcg

SEQ ID NO: 7062 - RNA, 20 nt, Artificial Sequence
  targeting sequence with GTCN PAM
ccgccuaguuugggccuuua

SEQ ID NO: 7063 - RNA, 20 nt, Artificial Sequence
  targeting sequence with GTCN PAM
gcuccagggagaaccaaagg

SEQ ID NO: 7064 - RNA, 20 nt, Artificial Sequence
  targeting sequence with GTCN PAM
ucuauugggucccagcauca

SEQ ID NO: 7065 - RNA, 20 nt, Artificial Sequence
  targeting sequence with GTCN PAM
cagcaucaggguauacaaug

SEQ ID NO: 7066 - RNA, 20 nt, Artificial Sequence
  targeting sequence with GTCN PAM
gccuaauauaugauacauuu

SEQ ID NO: 7067 - RNA, 20 nt, Artificial Sequence
  targeting sequence with GTCN PAM
auguaugcuaaaaauccacu

SEQ ID NO: 7068 - RNA, 20 nt, Artificial Sequence
  targeting sequence with GTCN PAM
gaaaaguacagucaauguau

SEQ ID NO: 7069 - RNA, 20 nt, Artificial Sequence
  targeting sequence with GTCN PAM
gccucacugagaacaaaaaa

SEQ ID NO: 7070 - RNA, 20 nt, Artificial Sequence
  targeting sequence with GTCN PAM
caggaauaauguacccugug

SEQ ID NO: 7071 - RNA, 20 nt, Artificial Sequence
  targeting sequence with GTCN PAM
auguuacugguaagaagugg

SEQ ID NO: 7072 - RNA, 20 nt, Artificial Sequence
  targeting sequence with GTCN PAM
uggaggcucagagaucaggc

SEQ ID NO: 7073 - RNA, 20 nt, Artificial Sequence
  targeting sequence with GTCN PAM
ucuccugagcaccuucccug

SEQ ID NO: 7074 - RNA, 20 nt, Artificial Sequence
  targeting sequence with GTCN PAM
cacugucggaucagguucuc

SEQ ID NO: 7075 - RNA, 20 nt, Artificial Sequence
  targeting sequence with GTCN PAM
gaucagguucucaccccugc

SEQ ID NO: 7076 - RNA, 20 nt, Artificial Sequence
  targeting sequence with GTCN PAM
gcaggggugagaaccugauc

SEQ ID NO: 7077 - RNA, 20 nt, Artificial Sequence
  targeting sequence with GTCN PAM
ggucugcaggggugagaacc

SEQ ID NO: 7078 - RNA, 20 nt, Artificial Sequence
  targeting sequence with GTCN PAM
uugccccaguuacuuuccug

SEQ ID NO: 7079 - RNA, 20 nt, Artificial Sequence
  targeting sequence with GTCN PAM
ccagcaaacauucugugccc

SEQ ID NO: 7080 - RNA, 20 nt, Artificial Sequence
  targeting sequence with GTCN PAM
uuuuguuuguguaaguuuag

SEQ ID NO: 7081 - RNA, 20 nt, Artificial Sequence
  targeting sequence with GTCN PAM
ucuuauucagaucauauggg

SEQ ID NO: 7082 - RNA, 20 nt, Artificial Sequence
  targeting sequence with GTCN PAM
cgauauguggaauugugcac

SEQ ID NO: 7083 - RNA, 20 nt, Artificial Sequence
  targeting sequence with GTCN PAM
cauugcuguuuaggaacagu

SEQ ID NO: 7084 - RNA, 20 nt, Artificial Sequence
  targeting sequence with GTCN PAM
uguauugaccaaacuaugug

SEQ ID NO: 7085 - RNA, 20 nt, Artificial Sequence
  targeting sequence with GTCN PAM
auacaggacuguuccuaaac

SEQ ID NO: 7086 - RNA, 20 nt, Artificial Sequence
  targeting sequence with GTCN PAM
cucucucacauaguuugguc

SEQ ID NO: 7087 - RNA, 20 nt, Artificial Sequence
  targeting sequence with GTCN PAM
gggguucaugaucaggcugu

SEQ ID NO: 7088 - RNA, 20 nt, Artificial Sequence
  targeting sequence with GTCN PAM
gcagggucggggguucauga

SEQ ID NO: 7089 - RNA, 20 nt, Artificial Sequence
  targeting sequence with GTCN PAM
agaaaguguuguuuagccga

SEQ ID NO: 7090 - RNA, 20 nt, Artificial Sequence
  targeting sequence with GTCN PAM
cacaaaugggcauuuguuca

SEQ ID NO: 7091 - RNA, 20 nt, Artificial Sequence
  targeting sequence with GTCN PAM
cugaugcugucccaggaucc

SEQ ID NO: 7092 - RNA, 20 nt, Artificial Sequence
  targeting sequence with GTCN PAM
caggaucccccaggaacacc

SEQ ID NO: 7093 - RNA, 20 nt, Artificial Sequence
  targeting sequence with GTCN PAM
cgggaagagugaucucaggc

SEQ ID NO: 7094 - RNA, 20 nt, Artificial Sequence
  targeting sequence with GTCN PAM
caggucucgggaagagugau

SEQ ID NO: 7095 - RNA, 20 nt, Artificial Sequence
  targeting sequence with GTCN PAM
ccagauccaaggaaauccug

SEQ ID NO: 7096 - RNA, 20 nt, Artificial Sequence
  targeting sequence with GTCN PAM
gccuguuuggugauuagcau

SEQ ID NO: 7097 - RNA, 20 nt, Artificial Sequence
  targeting sequence with GTCN PAM
aggccaucgagaucuguggu

SEQ ID NO: 7098 - RNA, 20 nt, Artificial Sequence
  targeting sequence with GTCN PAM
ccacagaucucgauggccuu

SEQ ID NO: 7099 - RNA, 20 nt, Artificial Sequence
  targeting sequence with GTCN PAM
acccagccauggucaccaca

SEQ ID NO: 7100 - RNA, 20 nt, Artificial Sequence
  targeting sequence with GTCN PAM
cugccccgagaagcauuugg

SEQ ID NO: 7101 - RNA, 20 nt, Artificial Sequence
  targeting sequence with GTCN PAM
ucacaugucaccucuugacu

SEQ ID NO: 7102 - RNA, 20 nt, Artificial Sequence
  targeting sequence with GTCN PAM
ccucuugacugacaagggaa

SEQ ID NO: 7103 - RNA, 20 nt, Artificial Sequence
  targeting sequence with GTCN PAM
agaggugacaugugaugaca

SEQ ID NO: 7104 - RNA, 20 nt, Artificial Sequence
  targeting sequence with GTCN PAM
gucaagaggugacaugugau

SEQ ID NO: 7105 - RNA, 20 nt, Artificial Sequence
  targeting sequence with GTCN PAM
ccugaagaaccuagccacua

SEQ ID NO: 7106 - RNA, 20 nt, Artificial Sequence
  targeting sequence with GTCN PAM
cuaggggaagggaugguggg

SEQ ID NO: 7107 - RNA, 20 nt, Artificial Sequence
  targeting sequence with GTCN PAM
ccaccaucccuuccccuagu

SEQ ID NO: 7108 - RNA, 20 nt, Artificial Sequence
  targeting sequence with GTCN PAM
ccucuucccugguccccacc

SEQ ID NO: 7109 - RNA, 20 nt, Artificial Sequence
  targeting sequence with GTCN PAM
cggugucuccucuucccugg

SEQ ID NO: 7110 - RNA, 20 nt, Artificial Sequence
  targeting sequence with GTCN PAM
ggguuguagugagcgcucag

SEQ ID NO: 7111 - RNA, 20 nt, Artificial Sequence
  targeting sequence with GTCN PAM
ccucgcccaccuugcagaug

SEQ ID NO: 7112 - RNA, 20 nt, Artificial Sequence
  targeting sequence with GTCN PAM
cuuuagcuucuguuucauca

SEQ ID NO: 7113 - RNA, 20 nt, Artificial Sequence
  targeting sequence with GTCN PAM
agauagcuggaaaguuguag

SEQ ID NO: 7114 - RNA, 20 nt, Artificial Sequence
  targeting sequence with GTCN PAM
augccaacuacgcguguaau

SEQ ID NO: 7115 - RNA, 20 nt, Artificial Sequence
  targeting sequence with GTCN PAM
ccuaagagaagauauccaug

SEQ ID NO: 7116 - RNA, 20 nt, Artificial Sequence
  targeting sequence with GTCN PAM
cuucauggaaagagugucuc

SEQ ID NO: 7117 - RNA, 20 nt, Artificial Sequence
  targeting sequence with GTCN PAM
uuuauuccaaccagagccaa

SEQ ID NO: 7118 - RNA, 20 nt, Artificial Sequence
  targeting sequence with GTCN PAM
uucacccucccauucccaca

SEQ ID NO: 7119 - RNA, 20 nt, Artificial Sequence
  targeting sequence with GTCN PAM
cucacuauuggcaaaucuaa

SEQ ID NO: 7120 - RNA, 20 nt, Artificial Sequence
  targeting sequence with GTCN PAM
gacacccccucaggcaggca

SEQ ID NO: 7121 - RNA, 20 nt, Artificial Sequence
  targeting sequence with GTCN PAM
gacuguagguggucacucac

SEQ ID NO: 7122 - RNA, 20 nt, Artificial Sequence
  targeting sequence with GTCN PAM
ccauucuaccugccugccug

SEQ ID NO: 7123 - RNA, 20 nt, Artificial Sequence
  targeting sequence with GTCN PAM
ggcuggcuuugcucuguggc

SEQ ID NO: 7124 - RNA, 20 nt, Artificial Sequence
  targeting sequence with GTCN PAM
agguggacaacagggagagg

SEQ ID NO: 7125 - RNA, 20 nt, Artificial Sequence
  targeting sequence with GTCN PAM
accuugacgaaugguguaac

SEQ ID NO: 7126 - RNA, 20 nt, Artificial Sequence
  targeting sequence with GTCN PAM
cagugcugccccaccccaac

SEQ ID NO: 7127 - RNA, 20 nt, Artificial Sequence
  targeting sequence with GTCN PAM
caaggcugaauccauccugu

SEQ ID NO: 7128 - RNA, 20 nt, Artificial Sequence
  targeting sequence with GTCN PAM
ggugugcugagucccaaggc

SEQ ID NO: 7129 - RNA, 20 nt, Artificial Sequence
  targeting sequence with GTCN PAM
ucccagucagugagcuucag

SEQ ID NO: 7130 - RNA, 20 nt, Artificial Sequence
  targeting sequence with GTCN PAM
gugagcuucaggcucaagca

SEQ ID NO: 7131 - RNA, 20 nt, Artificial Sequence
  targeting sequence with GTCN PAM
uuugccuaccgcagcagcau

SEQ ID NO: 7132 - RNA, 20 nt, Artificial Sequence
  targeting sequence with GTCN PAM
caucguguccuuugccuacc

SEQ ID NO: 7133 - RNA, 20 nt, Artificial Sequence
  targeting sequence with GTCN PAM
uaaaggcuguugauucuucu

SEQ ID NO: 7134 - RNA, 20 nt, Artificial Sequence
  targeting sequence with GTCN PAM
acagguagcaguggcccagc

SEQ ID NO: 7135 - RNA, 20 nt, Artificial Sequence
  targeting sequence with GTCN PAM
cuuugugaggggcccacaca

SEQ ID NO: 7136 - RNA, 20 nt, Artificial Sequence
  targeting sequence with GTCN PAM
uaccaccccaucuuuuucuu

SEQ ID NO: 7137 - RNA, 20 nt, Artificial Sequence
  targeting sequence with GTCN PAM
gauaguaauuuuuuuaaaga

SEQ ID NO: 7138 - RNA, 20 nt, Artificial Sequence
  targeting sequence with GTCN PAM
uuaaaaaaauuacuaucgga

SEQ ID NO: 7139 - RNA, 20 nt, Artificial Sequence
  targeting sequence with GTCN PAM
cuuucauuuguaagugcuau

SEQ ID NO: 7140 - RNA, 20 nt, Artificial Sequence
  targeting sequence with GTCN PAM
uuccuccagggacguugggu

SEQ ID NO: 7141 - RNA, 20 nt, Artificial Sequence
  targeting sequence with GTCN PAM
cuggaggaaagacaccuuuu

SEQ ID NO: 7142 - RNA, 20 nt, Artificial Sequence
  targeting sequence with GTCN PAM
augccaccuuucccuaaaaa

SEQ ID NO: 7143 - RNA, 20 nt, Artificial Sequence
  targeting sequence with GTCN PAM
uuuuucugcugagcaguguu

SEQ ID NO: 7144 - RNA, 20 nt, Artificial Sequence
  targeting sequence with GTCN PAM
acacuuagaauaauaauggc

SEQ ID NO: 7145 - RNA, 20 nt, Artificial Sequence
  targeting sequence with GTCN PAM
gucuacacuuagaauaauaa

SEQ ID NO: 7146 - RNA, 20 nt, Artificial Sequence
  targeting sequence with GTCN PAM
ccagacagggauucguuaca

SEQ ID NO: 7147 - RNA, 20 nt, Artificial Sequence
  targeting sequence with GTCN PAM
ggagacaggcaaggcacgga

SEQ ID NO: 7148 - RNA, 20 nt, Artificial Sequence
  targeting sequence with GTCN PAM
uggugagaaaggaaggagaa

SEQ ID NO: 7149 - RNA, 20 nt, Artificial Sequence
  targeting sequence with GTCN PAM
aacuaacucucccaggagaa

SEQ ID NO: 7150 - RNA, 20 nt, Artificial Sequence
  targeting sequence with GTCN PAM
ggcuggaauuuggagucaaa

SEQ ID NO: 7151 - RNA, 20 nt, Artificial Sequence
  targeting sequence with GTCN PAM
ccaugagugaugggagggcu

SEQ ID NO: 7152 - RNA, 20 nt, Artificial Sequence
  targeting sequence with GTCN PAM
cugcagcuccucccucuuug

SEQ ID NO: 7153 - RNA, 20 nt, Artificial Sequence
  targeting sequence with GTCN PAM
gcacguuggccaggaggaca

SEQ ID NO: 7154 - RNA, 20 nt, Artificial Sequence
  targeting sequence with GTCN PAM
uccuggccaacgugcugacc

SEQ ID NO: 7155 - RNA, 20 nt, Artificial Sequence
  targeting sequence with GTCN PAM
ucccuguccuccuggccaac

SEQ ID NO: 7156 - RNA, 20 nt, Artificial Sequence
  targeting sequence with GTCN PAM
agagcucagagcaggcccca

SEQ ID NO: 7157 - RNA, 20 nt, Artificial Sequence
  targeting sequence with GTCN PAM
uugagguauucuuaugccuu

SEQ ID NO: 7158 - RNA, 20 nt, Artificial Sequence
  targeting sequence with GTCN PAM
ugggcugggugcuucaccuu

SEQ ID NO: 7159 - RNA, 20 nt, Artificial Sequence
  targeting sequence with GTCN PAM
guggggaaggugaagcaccc

SEQ ID NO: 7160 - RNA, 20 nt, Artificial Sequence
  targeting sequence with GTCN PAM
ucuggguaccugguagggga

SEQ ID NO: 7161 - RNA, 20 nt, Artificial Sequence
  targeting sequence with GTCN PAM
aucaaccuggagagggaagg

SEQ ID NO: 7162 - RNA, 20 nt, Artificial Sequence
  targeting sequence with GTCN PAM
aguuugcgggcgaugucgau

SEQ ID NO: 7163 - RNA, 20 nt, Artificial Sequence
  targeting sequence with GTCN PAM
agcuucuugagguagguagc

SEQ ID NO: 7164 - RNA, 20 nt, Artificial Sequence
  targeting sequence with GTCN PAM
cagcagcauagccagggcug

SEQ ID NO: 7165 - RNA, 20 nt, Artificial Sequence
  targeting sequence with GTCN PAM
cccaucuucagguaggucuc

SEQ ID NO: 7166 - RNA, 20 nt, Artificial Sequence
  targeting sequence with GTCN PAM
cuggugcagcugcacgugga

SEQ ID NO: 7167 - RNA, 20 nt, Artificial Sequence
  targeting sequence with GTCN PAM
ccacgugcagcugcaccagg

SEQ ID NO: 7168 - RNA, 20 nt, Artificial Sequence
  targeting sequence with GTCN PAM
cagggcucagguggggcccc

SEQ ID NO: 7169 - RNA, 20 nt, Artificial Sequence
  targeting sequence with GTCN PAM
gguaacuuaaccucgaauuc

SEQ ID NO: 7170 - RNA, 20 nt, Artificial Sequence
  targeting sequence with GTCN PAM
cuucauucagucauugagaa

SEQ ID NO: 7171 - RNA, 20 nt, Artificial Sequence
  targeting sequence with GTCN PAM
uugagaaaaucguuacugac

SEQ ID NO: 7172 - RNA, 20 nt, Artificial Sequence
  targeting sequence with GTCN PAM
guaacgauuuucucaaugac

SEQ ID NO: 7173 - RNA, 20 nt, Artificial Sequence
  targeting sequence with GTCN PAM
ccacccuggcagagcuggcu

SEQ ID NO: 7174 - RNA, 20 nt, Artificial Sequence
  targeting sequence with GTCN PAM
uguucacacuaacauccccg

SEQ ID NO: 7175 - RNA, 20 nt, Artificial Sequence
  targeting sequence with GTCN PAM
gaggcagcucagcccaacag

SEQ ID NO: 7176 - RNA, 20 nt, Artificial Sequence
  targeting sequence with GTCN PAM
gagccuguggugcuggucag

SEQ ID NO: 7177 - RNA, 20 nt, Artificial Sequence
  targeting sequence with GTCN PAM
cgcaggugcaucuccacauc

SEQ ID NO: 7178 - RNA, 20 nt, Artificial Sequence
  targeting sequence with GTCN PAM
ggaucuggaaagcacagaug

SEQ ID NO: 7179 - RNA, 20 nt, Artificial Sequence
  targeting sequence with GTCN PAM
ggggcuguaaagaauuagcc

SEQ ID NO: 7180 - RNA, 20 nt, Artificial Sequence
  targeting sequence with GTCN PAM
gcgagaaagguggccagccu

SEQ ID NO: 7181 - RNA, 20 nt, Artificial Sequence
  targeting sequence with GTCN PAM
ggggaggaucuuggcacagc

SEQ ID NO: 7182 - RNA, 20 nt, Artificial Sequence
  targeting sequence with GTCN PAM
auuuuagagugaaagcaaag

SEQ ID NO: 7183 - RNA, 20 nt, Artificial Sequence
  targeting sequence with GTCN PAM
gacuguugucugcucucuga

SEQ ID NO: 7184 - RNA, 20 nt, Artificial Sequence
  targeting sequence with GTCN PAM
gacggcuccucucagugaag

SEQ ID NO: 7185 - RNA, 20 nt, Artificial Sequence
  targeting sequence with GTCN PAM
gcucucugaacagcuccauu

SEQ ID NO: 7186 - RNA, 20 nt, Artificial Sequence
  targeting sequence with GTCN PAM
gucaugagaaaagguggggc

SEQ ID NO: 7187 - RNA, 20 nt, Artificial Sequence
  targeting sequence with GTCN PAM
ugagaaaagguggggcuagg

SEQ ID NO: 7188 - RNA, 20 nt, Artificial Sequence
  targeting sequence with GTCN PAM
cuagccccaccuuuucucau

SEQ ID NO: 7189 - RNA, 20 nt, Artificial Sequence
  targeting sequence with GTCN PAM
uucuaagaugcucuaaucua

SEQ ID NO: 7190 - RNA, 20 nt, Artificial Sequence
  targeting sequence with GTCN PAM
gagucauucuaagaugcucu

SEQ ID NO: 7191 - RNA, 20 nt, Artificial Sequence
  targeting sequence with GTCN PAM
gccugaugcacagcgagguc

SEQ ID NO: 7192 - RNA, 20 nt, Artificial Sequence
  targeting sequence with GTCN PAM
gguucuccuggccugacagg

SEQ ID NO: 7193 - RNA, 20 nt, Artificial Sequence
  targeting sequence with GTCN PAM
ggccaggagaaccggacaug

SEQ ID NO: 7194 - RNA, 20 nt, Artificial Sequence
  targeting sequence with GTCN PAM
guggguccauacagcacgaa

SEQ ID NO: 7195 - RNA, 20 nt, Artificial Sequence
  targeting sequence with GTCN PAM
auacagcacgaagcccacag

SEQ ID NO: 7196 - RNA, 20 nt, Artificial Sequence
  targeting sequence with GTCN PAM
ucuuugacaacugauaagaa

SEQ ID NO: 7197 - RNA, 20 nt, Artificial Sequence
  targeting sequence with GTCN PAM
aagaugacugugggcuucgu

SEQ ID NO: 7198 - RNA, 20 nt, Artificial Sequence
  targeting sequence with GTCN PAM
auucuguuuccuuagguguc

SEQ ID NO: 7199 - RNA, 20 nt, Artificial Sequence
  targeting sequence with GTCN PAM
cccgcaauuaaaagaaaucu

SEQ ID NO: 7200 - RNA, 20 nt, Artificial Sequence
  targeting sequence with GTCN PAM
agaaacagacuguguuguua

SEQ ID NO: 7201 - RNA, 20 nt, Artificial Sequence
  targeting sequence with GTCN PAM
guuucuggaccacagaagcg

SEQ ID NO: 7202 - RNA, 20 nt, Artificial Sequence
  targeting sequence with GTCN PAM
cuugcauauugcuguuaauu

SEQ ID NO: 7203 - RNA, 20 nt, Artificial Sequence
  targeting sequence with GTCN PAM
ggcuggcaaaauaugauguc

SEQ ID NO: 7204 - RNA, 20 nt, Artificial Sequence
  targeting sequence with GTCN PAM
cuaauggauucagccaagua

SEQ ID NO: 7205 - RNA, 20 nt, Artificial Sequence
  targeting sequence with GTCN PAM
uaauaaagcugccccugcag

SEQ ID NO: 7206 - RNA, 20 nt, Artificial Sequence
  targeting sequence with GTCN PAM
uccuuaaacucaggaugcuu

SEQ ID NO: 7207 - RNA, 20 nt, Artificial Sequence
  targeting sequence with GTCN PAM
guguugccuaccuuucuggg

SEQ ID NO: 7208 - RNA, 20 nt, Artificial Sequence
  targeting sequence with GTCN PAM
ccuucuagaaggagcaggag

SEQ ID NO: 7209 - RNA, 20 nt, Artificial Sequence
  targeting sequence with GTCN PAM
uuccaugcuccacagucuuu

SEQ ID NO: 7210 - RNA, 20 nt, Artificial Sequence
  targeting sequence with GTCN PAM
cacccuccugggccacacuc

SEQ ID NO: 7211 - RNA, 20 nt, Artificial Sequence
  targeting sequence with GTCN PAM
ucaugguacccuggcucaca

SEQ ID NO: 7212 - RNA, 20 nt, Artificial Sequence
  targeting sequence with GTCN PAM
cuacugagaauagaaacuca

SEQ ID NO: 7213 - RNA, 20 nt, Artificial Sequence
  targeting sequence with GTCN PAM
cccguuuaucugagccagaa

SEQ ID NO: 7214 - RNA, 20 nt, Artificial Sequence
  targeting sequence with GTCN PAM
acuuuaaaaaauaugauuaa

SEQ ID NO: 7215 - RNA, 20 nt, Artificial Sequence
  targeting sequence with GTCN PAM
ggcccuggcugagcacuuaa

SEQ ID NO: 7216 - RNA, 20 nt, Artificial Sequence
  targeting sequence with GTCN PAM
uugcacagcuguuggcaaga

SEQ ID NO: 7217 - RNA, 20 nt, Artificial Sequence
  targeting sequence with GTCN PAM
caaaucuagucagcagcaga

SEQ ID NO: 7218 - RNA, 20 nt, Artificial Sequence
  targeting sequence with GTCN PAM
gcagcagagccagaauugga

SEQ ID NO: 7219 - RNA, 20 nt, Artificial Sequence
  targeting sequence with GTCN PAM
aauucuggcucugcugcuga

SEQ ID NO: 7220 - RNA, 20 nt, Artificial Sequence
  targeting sequence with GTCN PAM
gagagguacugguccaauuc

SEQ ID NO: 7221 - RNA, 20 nt, Artificial Sequence
  targeting sequence with GTCN PAM
agagagggcaacgguuacca

SEQ ID NO: 7222 - RNA, 20 nt, Artificial Sequence
  targeting sequence with GTCN PAM
cccuguuggagccccucaac

SEQ ID NO: 7223 - RNA, 20 nt, Artificial Sequence
  targeting sequence with GTCN PAM
gugucugcccuuccaagaau

SEQ ID NO: 7224 - RNA, 20 nt, Artificial Sequence
  targeting sequence with GTCN PAM
gcccuuccaagaauccauca

SEQ ID NO: 7225 - RNA, 20 nt, Artificial Sequence
  targeting sequence with GTCN PAM
gaguaccaaguuacuauggu

SEQ ID NO: 7226 - RNA, 20 nt, Artificial Sequence
  targeting sequence with GTCN PAM
ggccuuuguuccguucucau

SEQ ID NO: 7227 - RNA, 20 nt, Artificial Sequence
  targeting sequence with GTCN PAM
uggcuacaagugcuucacug

SEQ ID NO: 7228 - RNA, 20 nt, Artificial Sequence
  targeting sequence with GTCN PAM
uugaaaagcagucauuugaa

SEQ ID NO: 7229 - RNA, 20 nt, Artificial Sequence
  targeting sequence with GTCN PAM
uuugaagacaaacugaggac

SEQ ID NO: 7230 - RNA, 20 nt, Artificial Sequence
  targeting sequence with GTCN PAM
ucaaaugacugcuuuucaau

SEQ ID NO: 7231 - RNA, 20 nt, Artificial Sequence
  targeting sequence with GTCN PAM
ucaguuugucuucaaaugac

SEQ ID NO: 7232 - RNA, 20 nt, Artificial Sequence
  targeting sequence with GTCN PAM
cagaaccaagcccaacucaa

SEQ ID NO: 7233 - RNA, 20 nt, Artificial Sequence
  targeting sequence with GTCN PAM
cacccaaggucccagaacca

SEQ ID NO: 7234 - RNA, 20 nt, Artificial Sequence
  targeting sequence with GTCN PAM
guggugaggauccagugagg

SEQ ID NO: 7235 - RNA, 20 nt, Artificial Sequence
  targeting sequence with GTCN PAM
uguuucuaucaccuuaggag

SEQ ID NO: 7236 - RNA, 20 nt, Artificial Sequence
  targeting sequence with GTCN PAM
caaaacuuugcccuggaaug

SEQ ID NO: 7237 - RNA, 20 nt, Artificial Sequence
  targeting sequence with GTCN PAM
aagagugaaacuugcucauc

SEQ ID NO: 7238 - RNA, 20 nt, Artificial Sequence
  targeting sequence with GTCN PAM
gucgccuuuucccagccaaa

SEQ ID NO: 7239 - RNA, 20 nt, Artificial Sequence
  targeting sequence with GTCN PAM
ccuuuucccagccaaaaagg

SEQ ID NO: 7240 - RNA, 20 nt, Artificial Sequence
  targeting sequence with GTCN PAM
uacuuccaaagcagcccugu

SEQ ID NO: 7241 - RNA, 20 nt, Artificial Sequence
  targeting sequence with GTCN PAM
cccagccuuguggaacgcug

SEQ ID NO: 7242 - RNA, 20 nt, Artificial Sequence
  targeting sequence with GTCN PAM
aggugcuggagcagcucaca

SEQ ID NO: 7243 - RNA, 20 nt, Artificial Sequence
  targeting sequence with GTCN PAM
augcagugccucgauauagc

SEQ ID NO: 7244 - RNA, 20 nt, Artificial Sequence
  targeting sequence with GTCN PAM
ggcugauguuuacacaccuu

SEQ ID NO: 7245 - RNA, 20 nt, Artificial Sequence
  targeting sequence with GTCN PAM
gaguggggcuugggaaaaca

SEQ ID NO: 7246 - RNA, 20 nt, Artificial Sequence
  targeting sequence with GTCN PAM
cagcucuucugauguuuauc

SEQ ID NO: 7247 - RNA, 20 nt, Artificial Sequence
  targeting sequence with GTCN PAM
auaagccugccuugcagugg

SEQ ID NO: 7248 - RNA, 20 nt, Artificial Sequence
  targeting sequence with GTCN PAM
ucauaccauucugaugggca

SEQ ID NO: 7249 - RNA, 20 nt, Artificial Sequence
  targeting sequence with GTCN PAM
ugggguuaugguuggcaggu

SEQ ID NO: 7250 - RNA, 20 nt, Artificial Sequence
  targeting sequence with GTCN PAM
agcccugcauugcuaauuca

SEQ ID NO: 7251 - RNA, 20 nt, Artificial Sequence
  targeting sequence with GTCN PAM
agcuaugggcucccagguag

SEQ ID NO: 7252 - RNA, 20 nt, Artificial Sequence
  targeting sequence with GTCN PAM
ugugaaagaaagcaauauug

SEQ ID NO: 7253 - RNA, 20 nt, Artificial Sequence
  targeting sequence with GTCN PAM
cuuccacuuccacuacuccu

SEQ ID NO: 7254 - RNA, 20 nt, Artificial Sequence
  targeting sequence with GTCN PAM
aguggagaagaacaucuccu

SEQ ID NO: 7255 - RNA, 20 nt, Artificial Sequence
  targeting sequence with GTCN PAM
ccugcagcuuccaugccagu

SEQ ID NO: 7256 - RNA, 20 nt, Artificial Sequence
  targeting sequence with GTCN PAM
caauccuuccugagcucugc

SEQ ID NO: 7257 - RNA, 20 nt, Artificial Sequence
  targeting sequence with GTCN PAM
ugugggagucccuuguccug

SEQ ID NO: 7258 - RNA, 20 nt, Artificial Sequence
  targeting sequence with GTCN PAM
cuuguccuggucccuuuggu

SEQ ID NO: 7259 - RNA, 20 nt, Artificial Sequence
  targeting sequence with GTCN PAM
uggucccuuugguugcuggg

SEQ ID NO: 7260 - RNA, 20 nt, Artificial Sequence
  targeting sequence with GTCN PAM
cuuugguugcugggagccuc

SEQ ID NO: 7261 - RNA, 20 nt, Artificial Sequence
  targeting sequence with GTCN PAM
ugcuuacaguuugaaaauug

SEQ ID NO: 7262 - RNA, 20 nt, Artificial Sequence
  targeting sequence with GTCN PAM
agccuagguguaaggucgca

SEQ ID NO: 7263 - RNA, 20 nt, Artificial Sequence
  targeting sequence with GTCN PAM
cauuuuucuguuugggccag

SEQ ID NO: 7264 - RNA, 20 nt, Artificial Sequence
  targeting sequence with GTCN PAM
gccugccuuugucccagcag

SEQ ID NO: 7265 - RNA, 20 nt, Artificial Sequence
  targeting sequence with GTCN PAM
cagcaggcucuuccgacaca

SEQ ID NO: 7266 - RNA, 20 nt, Artificial Sequence
  targeting sequence with GTCN PAM
gaagagccugcugggacaaa

SEQ ID NO: 7267 - RNA, 20 nt, Artificial Sequence
  targeting sequence with GTCN PAM
ugcugcagcugucgcucccc

SEQ ID NO: 7268 - RNA, 20 nt, Artificial Sequence
  targeting sequence with GTCN PAM
cucccccaggggaauaaucu

SEQ ID NO: 7269 - RNA, 20 nt, Artificial Sequence
  targeting sequence with GTCN PAM
accuaagaauucaccauccu

SEQ ID NO: 7270 - RNA, 20 nt, Artificial Sequence
  targeting sequence with GTCN PAM
cucacccuggcacagacacu

SEQ ID NO: 7271 - RNA, 20 nt, Artificial Sequence
  targeting sequence with GTCN PAM
gugccagggugagggacaaa

SEQ ID NO: 7272 - RNA, 20 nt, Artificial Sequence
  targeting sequence with GTCN PAM
guggcugccaacuggcccca

SEQ ID NO: 7273 - RNA, 20 nt, Artificial Sequence
  targeting sequence with GTCN PAM
aacagugucuguggcugcca

SEQ ID NO: 7274 - RNA, 20 nt, Artificial Sequence
  targeting sequence with GTCN PAM
uucugggcaggaucugcugu

SEQ ID NO: 7275 - RNA, 20 nt, Artificial Sequence
  targeting sequence with GTCN PAM
ccagcaccugaggguaccau

SEQ ID NO: 7276 - RNA, 20 nt, Artificial Sequence
  targeting sequence with GTCN PAM
cgggcauaucuaaagagcag

SEQ ID NO: 7277 - RNA, 20 nt, Artificial Sequence
  targeting sequence with GTCN PAM
gcugcucuuuagauaugccc

SEQ ID NO: 7278 - RNA, 20 nt, Artificial Sequence
  targeting sequence with GTCN PAM
cagugaacugcugaggaauc

SEQ ID NO: 7279 - RNA, 20 nt, Artificial Sequence
  targeting sequence with GTCN PAM
ccucugggaagaaaaaguuu

SEQ ID NO: 7280 - RNA, 20 nt, Artificial Sequence
  targeting sequence with GTCN PAM
aucaaagaaacucaaacuuu

SEQ ID NO: 7281 - RNA, 20 nt, Artificial Sequence
  targeting sequence with GTCN PAM
gccaugcaucaagcaguggg

SEQ ID NO: 7282 - RNA, 20 nt, Artificial Sequence
  targeting sequence with GTCN PAM
ucaaagccugcacugaggaa

SEQ ID NO: 7283 - RNA, 20 nt, Artificial Sequence
  targeting sequence with GTCN PAM
gugauuuguguguucuucag

SEQ ID NO: 7284 - RNA, 20 nt, Artificial Sequence
  targeting sequence with GTCN PAM
cucaguuuccuucucuguga

SEQ ID NO: 7285 - RNA, 20 nt, Artificial Sequence
  targeting sequence with GTCN PAM
ccagaaacccaaguaguucu

SEQ ID NO: 7286 - RNA, 20 nt, Artificial Sequence
  targeting sequence with GTCN PAM
guuuauuucuguagcauaaa

SEQ ID NO: 7287 - RNA, 20 nt, Artificial Sequence
  targeting sequence with GTCN PAM
aaucccaaaguauggauuuu

SEQ ID NO: 7288 - RNA, 20 nt, Artificial Sequence
  targeting sequence with GTCN PAM
ggugaauauugcgaugaggc

SEQ ID NO: 7289 - RNA, 20 nt, Artificial Sequence
  targeting sequence with GTCN PAM
gguggguggagaagaauugg

SEQ ID NO: 7290 - RNA, 20 nt, Artificial Sequence
  targeting sequence with GTCN PAM
gauccuggugaaaugauuac

SEQ ID NO: 7291 - RNA, 20 nt, Artificial Sequence
  targeting sequence with GTCN PAM
gauccacuacaguugucuga

SEQ ID NO: 7292 - RNA, 20 nt, Artificial Sequence
  targeting sequence with GTCN PAM
gcugcuggucugauccacua

SEQ ID NO: 7293 - RNA, 20 nt, Artificial Sequence
  targeting sequence with GTCN PAM
ugaucacuguuugguggucu

SEQ ID NO: 7294 - RNA, 20 nt, Artificial Sequence
  targeting sequence with GTCN PAM
agccguggagcuggucauca

SEQ ID NO: 7295 - RNA, 20 nt, Artificial Sequence
  targeting sequence with GTCN PAM
ucacgguugucauguaaagu

SEQ ID NO: 7296 - RNA, 20 nt, Artificial Sequence
  targeting sequence with GTCN PAM
uguaaaguccacuuuuuguc

SEQ ID NO: 7297 - RNA, 20 nt, Artificial Sequence
  targeting sequence with GTCN PAM
acuuuuugucacaccucaca

SEQ ID NO: 7298 - RNA, 20 nt, Artificial Sequence
  targeting sequence with GTCN PAM
caccucacaucugauugaga

SEQ ID NO: 7299 - RNA, 20 nt, Artificial Sequence
  targeting sequence with GTCN PAM
uuucuuauucuaugcaacaa

SEQ ID NO: 7300 - RNA, 20 nt, Artificial Sequence
  targeting sequence with GTCN PAM
uuuugaaguguugucuuuuc

SEQ ID NO: 7301 - RNA, 20 nt, Artificial Sequence
  targeting sequence with GTCN PAM
accauucuacgguuguuugg

SEQ ID NO: 7302 - RNA, 20 nt, Artificial Sequence
  targeting sequence with GTCN PAM
acuuccaguggccggccacu

SEQ ID NO: 7303 - RNA, 20 nt, Artificial Sequence
  targeting sequence with GTCN PAM
auguuacgaguugucucugu

SEQ ID NO: 7304 - RNA, 20 nt, Artificial Sequence
  targeting sequence with GTCN PAM
cuguugcuuuaugacccauu

SEQ ID NO: 7305 - RNA, 20 nt, Artificial Sequence
  targeting sequence with GTCN PAM
uaaagcaacagagacaacuc

SEQ ID NO: 7306 - RNA, 20 nt, Artificial Sequence
  targeting sequence with GTCN PAM
aacaucauuugcauagucua

SEQ ID NO: 7307 - RNA, 20 nt, Artificial Sequence
  targeting sequence with GTCN PAM
aaaauaaacaguaaguaaua

SEQ ID NO: 7308 - RNA, 20 nt, Artificial Sequence
  targeting sequence with GTCN PAM
caguagucuggcacuggagc

SEQ ID NO: 7309 - RNA, 20 nt, Artificial Sequence
  targeting sequence with GTCN PAM
ggcacuggagccuguguucc

SEQ ID NO: 7310 - RNA, 20 nt, Artificial Sequence
  targeting sequence with GTCN PAM
ccuuuuagagaaagcaggcu

SEQ ID NO: 7311 - RNA, 20 nt, Artificial Sequence
  targeting sequence with GTCN PAM
ucacacacaaaugacacugu

SEQ ID NO: 7312 - RNA, 20 nt, Artificial Sequence
  targeting sequence with GTCN PAM
uuugugugugaggacucucg

SEQ ID NO: 7313 - RNA, 20 nt, Artificial Sequence
  targeting sequence with GTCN PAM
aauccucaaaacaaucccau

SEQ ID NO: 7314 - RNA, 20 nt, Artificial Sequence
  targeting sequence with GTCN PAM
cucugugcuagguacucuuc

SEQ ID NO: 7315 - RNA, 20 nt, Artificial Sequence
  targeting sequence with GTCN PAM
gggaaagcuggcgugaagcc

SEQ ID NO: 7316 - RNA, 20 nt, Artificial Sequence
  targeting sequence with GTCN PAM
cugucgcccaagguggagug

SEQ ID NO: 7317 - RNA, 20 nt, Artificial Sequence
  targeting sequence with GTCN PAM
cccaagguggagugcagugu

SEQ ID NO: 7318 - RNA, 20 nt, Artificial Sequence
  targeting sequence with GTCN PAM
ugaucauagcucauggcagc

SEQ ID NO: 7319 - RNA, 20 nt, Artificial Sequence
  targeting sequence with GTCN PAM
agcaguuugaggcugccaug

SEQ ID NO: 7320 - RNA, 20 nt, Artificial Sequence
  targeting sequence with GTCN PAM
aagaacggcgggaaggcugg

SEQ ID NO: 7321 - RNA, 20 nt, Artificial Sequence
  targeting sequence with GTCN PAM
gcacagauuagagggaaaga

SEQ ID NO: 7322 - RNA, 20 nt, Artificial Sequence
  targeting sequence with GTCN PAM
ggcaagaaggacuccugaca

SEQ ID NO: 7323 - RNA, 20 nt, Artificial Sequence
  targeting sequence with GTCN PAM
uucuugccagacuuucccaa

SEQ ID NO: 7324 - RNA, 20 nt, Artificial Sequence
  targeting sequence with GTCN PAM
ggaguccuucuugccagacu

SEQ ID NO: 7325 - RNA, 20 nt, Artificial Sequence
  targeting sequence with GTCN PAM
gucuaguguuacaucucuuc

SEQ ID NO: 7326 - RNA, 20 nt, Artificial Sequence
  targeting sequence with GTCN PAM
aguguuacaucucuucccac

SEQ ID NO: 7327 - RNA, 20 nt, Artificial Sequence
  targeting sequence with GTCN PAM
guggucucaagggaccucau

SEQ ID NO: 7328 - RNA, 20 nt, Artificial Sequence
  targeting sequence with GTCN PAM
caagggaccucaucuucccu

SEQ ID NO: 7329 - RNA, 20 nt, Artificial Sequence
  targeting sequence with GTCN PAM
cuugagaccacugacccugc

SEQ ID NO: 7330 - RNA, 20 nt, Artificial Sequence
  targeting sequence with GTCN PAM
uuggcuuuccugaaacgaga

SEQ ID NO: 7331 - RNA, 20 nt, Artificial Sequence
  targeting sequence with GTCN PAM
cguuucaggaaagccaaaga

SEQ ID NO: 7332 - RNA, 20 nt, Artificial Sequence
  targeting sequence with GTCN PAM
cucaucuuuaucaggugcuc

SEQ ID NO: 7333 - RNA, 20 nt, Artificial Sequence
  targeting sequence with GTCN PAM
gggcuccuuuuguggugguu

SEQ ID NO: 7334 - RNA, 20 nt, Artificial Sequence
  targeting sequence with GTCN PAM
gggcccagcucagccucacu

SEQ ID NO: 7335 - RNA, 20 nt, Artificial Sequence
  targeting sequence with GTCN PAM
gagggaaggagcugagagcc

SEQ ID NO: 7336 - RNA, 20 nt, Artificial Sequence
  targeting sequence with GTCN PAM
ucuuccucaccuggggcaug

SEQ ID NO: 7337 - RNA, 20 nt, Artificial Sequence
  targeting sequence with GTCN PAM
cuaacagcugagcucugcuc

SEQ ID NO: 7338 - RNA, 20 nt, Artificial Sequence
  targeting sequence with GTCN PAM
uggagcagagcucagcuguu

SEQ ID NO: 7339 - RNA, 20 nt, Artificial Sequence
  targeting sequence with GTCN PAM
cauguagguccuggagcaga

SEQ ID NO: 7340 - RNA, 20 nt, Artificial Sequence
  targeting sequence with GTCN PAM
gaggccccuuagcuccuagu

SEQ ID NO: 7341 - RNA, 20 nt, Artificial Sequence
  targeting sequence with GTCN PAM
cguaguaggcauuuauugaa

SEQ ID NO: 7342 - RNA, 20 nt, Artificial Sequence
  targeting sequence with GTCN PAM
gucacguaguaggcauuuau

SEQ ID NO: 7343 - RNA, 20 nt, Artificial Sequence
  targeting sequence with GTCN PAM
caucacagggucugucacgu

SEQ ID NO: 7344 - RNA, 20 nt, Artificial Sequence
  targeting sequence with GTCN PAM
ccaggucucaucacaggguc

SEQ ID NO: 7345 - RNA, 20 nt, Artificial Sequence
  targeting sequence with GTCN PAM
cugcagucagucccagucua

SEQ ID NO: 7346 - RNA, 20 nt, Artificial Sequence
  targeting sequence with GTCN PAM
gucccagucuagcaaacagg

SEQ ID NO: 7347 - RNA, 20 nt, Artificial Sequence
  targeting sequence with GTCN PAM
cagucuagcaaacaggacaa

SEQ ID NO: 7348 - RNA, 20 nt, Artificial Sequence
  targeting sequence with GTCN PAM
agcaaacaggacaaucccuc

SEQ ID NO: 7349 - RNA, 20 nt, Artificial Sequence
  targeting sequence with GTCN PAM
uguuugcuagacugggacug

SEQ ID NO: 7350 - RNA, 20 nt, Artificial Sequence
  targeting sequence with GTCN PAM
cuucacaggccucuaaacgu

SEQ ID NO: 7351 - RNA, 20 nt, Artificial Sequence
  targeting sequence with GTCN PAM
ucucagccagaaggagggag

SEQ ID NO: 7352 - RNA, 20 nt, Artificial Sequence
  targeting sequence with GTCN PAM
cagccugugcaaaggccugg

SEQ ID NO: 7353 - RNA, 20 nt, Artificial Sequence
  targeting sequence with GTCN PAM
ugcccugaaucagugcugcu

SEQ ID NO: 7354 - RNA, 20 nt, Artificial Sequence
  targeting sequence with GTCN PAM
uuccuggauacauggcaucu

SEQ ID NO: 7355 - RNA, 20 nt, Artificial Sequence
  targeting sequence with GTCN PAM
uuuccucugggaaagaugcc

SEQ ID NO: 7356 - RNA, 20 nt, Artificial Sequence
  targeting sequence with GTCN PAM
cagagagaauagguagcagg

SEQ ID NO: 7357 - RNA, 20 nt, Artificial Sequence
  targeting sequence with GTCN PAM
cagguuuucuuggguucuug

SEQ ID NO: 7358 - RNA, 20 nt, Artificial Sequence
  targeting sequence with GTCN PAM
ucaggaguucagaccaauua

SEQ ID NO: 7359 - RNA, 20 nt, Artificial Sequence
  targeting sequence with GTCN PAM
gaacuccugaggacucacuu

SEQ ID NO: 7360 - RNA, 20 nt, Artificial Sequence
  targeting sequence with GTCN PAM
ugugaggcccuacucaucac

SEQ ID NO: 7361 - RNA, 20 nt, Artificial Sequence
  targeting sequence with GTCN PAM
acaaaagguuaagaauaccu

SEQ ID NO: 7362 - RNA, 20 nt, Artificial Sequence
  targeting sequence with GTCN PAM
gcugagcuucuggcagccuc

SEQ ID NO: 7363 - RNA, 20 nt, Artificial Sequence
  targeting sequence with GTCN PAM
ucguaccuagaggcugccag

SEQ ID NO: 7364 - RNA, 20 nt, Artificial Sequence
  targeting sequence with GTCN PAM
gcaguugaggaacuccgcau

SEQ ID NO: 7365 - RNA, 20 nt, Artificial Sequence
  targeting sequence with GTCN PAM
agcugcuguuggaaagcaca

SEQ ID NO: 7366 - RNA, 20 nt, Artificial Sequence
  targeting sequence with GTCN PAM
uucaacagaggcauuuagcc

SEQ ID NO: 7367 - RNA, 20 nt, Artificial Sequence
  targeting sequence with GTCN PAM
uaagcugcauagaaggucuu

SEQ ID NO: 7368 - RNA, 20 nt, Artificial Sequence
  targeting sequence with GTCN PAM
ucucuuuuagagcuaauugg

SEQ ID NO: 7369 - RNA, 20 nt, Artificial Sequence
  targeting sequence with GTCN PAM
ccaauuagcucuaaaagaga

SEQ ID NO: 7370 - RNA, 20 nt, Artificial Sequence
  targeting sequence with GTCN PAM
uucuuccaagcuguacugcc

SEQ ID NO: 7371 - RNA, 20 nt, Artificial Sequence
  targeting sequence with GTCN PAM
gauuccaaagcccaagaaug

SEQ ID NO: 7372 - RNA, 20 nt, Artificial Sequence
  targeting sequence with GTCN PAM
ccaacuagaacagagcugag

SEQ ID NO: 7373 - RNA, 20 nt, Artificial Sequence
  targeting sequence with GTCN PAM
guuuccucaucaguacugug

SEQ ID NO: 7374 - RNA, 20 nt, Artificial Sequence
  targeting sequence with GTCN PAM
uuaacauaauaaccuugugg

SEQ ID NO: 7375 - RNA, 20 nt, Artificial Sequence
  targeting sequence with GTCN PAM
caucuggucuuuaacauaau

SEQ ID NO: 7376 - RNA, 20 nt, Artificial Sequence
  targeting sequence with GTCN PAM
cucagaauuauuggugucug

SEQ ID NO: 7377 - RNA, 20 nt, Artificial Sequence
  targeting sequence with GTCN PAM
gccuuuuggccuggcccagc

SEQ ID NO: 7378 - RNA, 20 nt, Artificial Sequence
  targeting sequence with GTCN PAM
aucguccugaaacucuuuuc

SEQ ID NO: 7379 - RNA, 20 nt, Artificial Sequence
  targeting sequence with GTCN PAM
ugaaacucuuuucaacaucu

SEQ ID NO: 7380 - RNA, 20 nt, Artificial Sequence
  targeting sequence with GTCN PAM
uugggcaggcugugcagcag

SEQ ID NO: 7381 - RNA, 20 nt, Artificial Sequence
  targeting sequence with GTCN PAM
caccaccguucuugucuaau

SEQ ID NO: 7382 - RNA, 20 nt, Artificial Sequence
  targeting sequence with GTCN PAM
aauggccccaagaaauuccu

SEQ ID NO: 7383 - RNA, 20 nt, Artificial Sequence
  targeting sequence with GTCN PAM
ucccugaggguugcugagag

SEQ ID NO: 7384 - RNA, 20 nt, Artificial Sequence
  targeting sequence with GTCN PAM
cuggccaacacacuguccca

SEQ ID NO: 7385 - RNA, 20 nt, Artificial Sequence
  targeting sequence with GTCN PAM
caaucccuccuagaacccac

SEQ ID NO: 7386 - RNA, 20 nt, Artificial Sequence
  targeting sequence with GTCN PAM
cacccucaucuguggguucu

SEQ ID NO: 7387 - RNA, 20 nt, Artificial Sequence
  targeting sequence with GTCN PAM
ggagaagugcccaagguucc

SEQ ID NO: 7388 - RNA, 20 nt, Artificial Sequence
  targeting sequence with GTCN PAM
caaguuagggucugguuugg

SEQ ID NO: 7389 - RNA, 20 nt, Artificial Sequence
  targeting sequence with GTCN PAM
gguuugguggaugugugcug

SEQ ID NO: 7390 - RNA, 20 nt, Artificial Sequence
  targeting sequence with GTCN PAM
gaggguggaaugaagcugag

SEQ ID NO: 7391 - RNA, 20 nt, Artificial Sequence
  targeting sequence with GTCN PAM
gggccauggucagggaaguu

SEQ ID NO: 7392 - RNA, 20 nt, Artificial Sequence
  targeting sequence with GTCN PAM
gggaaguuuaccuggaggag

SEQ ID NO: 7393 - RNA, 20 nt, Artificial Sequence
  targeting sequence with GTCN PAM
aucaugcaagcugaggcagc

SEQ ID NO: 7394 - RNA, 20 nt, Artificial Sequence
  targeting sequence with GTCN PAM
uccccuggaacauccacuug

SEQ ID NO: 7395 - RNA, 20 nt, Artificial Sequence
  targeting sequence with GTCN PAM
ccucacccucucccacaugc

SEQ ID NO: 7396 - RNA, 20 nt, Artificial Sequence
  targeting sequence with GTCN PAM
ugcugccucuccggccccuc

SEQ ID NO: 7397 - RNA, 20 nt, Artificial Sequence
  targeting sequence with GTCN PAM
uggaugucaggagacauaau

SEQ ID NO: 7398 - RNA, 20 nt, Artificial Sequence
  targeting sequence with GTCN PAM
ggagacauaauugucccugu

SEQ ID NO: 7399 - RNA, 20 nt, Artificial Sequence
  targeting sequence with GTCN PAM
ccugacauccaagaccuuaa

SEQ ID NO: 7400 - RNA, 20 nt, Artificial Sequence
  targeting sequence with GTCN PAM
cuguucuuuucuaaaucuca

SEQ ID NO: 7401 - RNA, 20 nt, Artificial Sequence
  targeting sequence with GTCN PAM
ucuccaguggaguggguuuu

SEQ ID NO: 7402 - RNA, 20 nt, Artificial Sequence
  targeting sequence with GTCN PAM
gaccucugcugcaugcgucu

SEQ ID NO: 7403 - RNA, 20 nt, Artificial Sequence
  targeting sequence with GTCN PAM
gacuccaggaaggcaccccu

SEQ ID NO: 7404 - RNA, 20 nt, Artificial Sequence
  targeting sequence with GTCN PAM
ccgucuuuccccguaggagc

SEQ ID NO: 7405 - RNA, 20 nt, Artificial Sequence
  targeting sequence with GTCN PAM
uuccccguaggagcagucag

SEQ ID NO: 7406 - RNA, 20 nt, Artificial Sequence
  targeting sequence with GTCN PAM
gggcuaugccugugggggcu

SEQ ID NO: 7407 - RNA, 20 nt, Artificial Sequence
  targeting sequence with GTCN PAM
acagcuugauagaaccucua

SEQ ID NO: 7408 - RNA, 20 nt, Artificial Sequence
  targeting sequence with GTCN PAM
ccaggggauggcacagggua

SEQ ID NO: 7409 - RNA, 20 nt, Artificial Sequence
  targeting sequence with GTCN PAM
ggagccauuuccaggucccc

SEQ ID NO: 7410 - RNA, 20 nt, Artificial Sequence
  targeting sequence with GTCN PAM
cugacuuugaggagucaugc

SEQ ID NO: 7411 - RNA, 20 nt, Artificial Sequence
  targeting sequence with GTCN PAM
gggacugucaggagccauuu

SEQ ID NO: 7412 - RNA, 20 nt, Artificial Sequence
  targeting sequence with GTCN PAM
ugcuggagacacagaaggaa

SEQ ID NO: 7413 - RNA, 20 nt, Artificial Sequence
  targeting sequence with GTCN PAM
ccagcaugacuccucaaagu

SEQ ID NO: 7414 - RNA, 20 nt, Artificial Sequence
  targeting sequence with GTCN PAM
acuucagcaguucuguggag

SEQ ID NO: 7415 - RNA, 20 nt, Artificial Sequence
  targeting sequence with GTCN PAM
gcagugcagccccguccacu

SEQ ID NO: 7416 - RNA, 20 nt, Artificial Sequence
  targeting sequence with GTCN PAM
ccuccgauguuggcugcccc

SEQ ID NO: 7417 - RNA, 20 nt, Artificial Sequence
  targeting sequence with GTCN PAM
gccucuggcugaggagcuuc

SEQ ID NO: 7418 - RNA, 20 nt, Artificial Sequence
  targeting sequence with GTCN PAM
gcacacccuuccccgagggc

SEQ ID NO: 7419 - RNA, 20 nt, Artificial Sequence
  targeting sequence with GTCN PAM
ggaccaggccccaccuggca

SEQ ID NO: 7420 - RNA, 20 nt, Artificial Sequence
  targeting sequence with GTCN PAM
agacucccuggggagccacc

SEQ ID NO: 7421 - RNA, 20 nt, Artificial Sequence
  targeting sequence with GTCN PAM
ggguauaagaugagccauca

SEQ ID NO: 7422 - RNA, 20 nt, Artificial Sequence
  targeting sequence with GTCN PAM
uuccucugccuucccggcac

SEQ ID NO: 7423 - RNA, 20 nt, Artificial Sequence
  targeting sequence with GTCN PAM
uuggagugagccccaggcug

SEQ ID NO: 7424 - RNA, 20 nt, Artificial Sequence
  targeting sequence with GTCN PAM
uuaacccuguucacggcagg

SEQ ID NO: 7425 - RNA, 20 nt, Artificial Sequence
  targeting sequence with GTCN PAM
uaggcgugccgggccagccu

SEQ ID NO: 7426 - RNA, 20 nt, Artificial Sequence
  targeting sequence with GTCN PAM
auugagcuggguacccugac

SEQ ID NO: 7427 - RNA, 20 nt, Artificial Sequence
  targeting sequence with GTCN PAM
ggguacccagcucaauggac

SEQ ID NO: 7428 - RNA, 20 nt, Artificial Sequence
  targeting sequence with GTCN PAM
uggaagggcuuggcgcggau

SEQ ID NO: 7429 - RNA, 20 nt, Artificial Sequence
  targeting sequence with GTCN PAM
cucuucaaacggaacccagg

SEQ ID NO: 7430 - RNA, 20 nt, Artificial Sequence
  targeting sequence with GTCN PAM
accuccuguucuccccgcag

SEQ ID NO: 7431 - RNA, 20 nt, Artificial Sequence
  targeting sequence with GTCN PAM
accuggcgcccgcucacagc

SEQ ID NO: 7432 - RNA, 20 nt, Artificial Sequence
  targeting sequence with GTCN PAM
gcucuggggccaggccuggg

SEQ ID NO: 7433 - RNA, 20 nt, Artificial Sequence
  targeting sequence with GTCN PAM
uugcucugagcuugagggag

SEQ ID NO: 7434 - RNA, 20 nt, Artificial Sequence
  targeting sequence with GTCN PAM
gaaccaaguccuugcucuga

SEQ ID NO: 7435 - RNA, 20 nt, Artificial Sequence
  targeting sequence with GTCN PAM
gucugaaccaaguccuugcu

SEQ ID NO: 7436 - RNA, 20 nt, Artificial Sequence
  targeting sequence with GTCN PAM
ccaucuuucugcaccuuggg

SEQ ID NO: 7437 - RNA, 20 nt, Artificial Sequence
  targeting sequence with GTCN PAM
acgugcuccgcacggugccc

SEQ ID NO: 7438 - RNA, 20 nt, Artificial Sequence
  targeting sequence with GTCN PAM
uuccugccaggggaaaagug

SEQ ID NO: 7439 - RNA, 20 nt, Artificial Sequence
  targeting sequence with GTCN PAM
ugggcacggggacccaagug

SEQ ID NO: 7440 - RNA, 20 nt, Artificial Sequence
  targeting sequence with GTCN PAM
ccgugcccaagacaccugca

SEQ ID NO: 7441 - RNA, 20 nt, Artificial Sequence
  targeting sequence with GTCN PAM
cuuggguccccgugcccaag

SEQ ID NO: 7442 - RNA, 20 nt, Artificial Sequence
  targeting sequence with GTCN PAM
agggggaggaggacacgugc

SEQ ID NO: 7443 - RNA, 20 nt, Artificial Sequence
  targeting sequence with GTCN PAM
uccucccccuggacucuggc

SEQ ID NO: 7444 - RNA, 20 nt, Artificial Sequence
  targeting sequence with GTCN PAM
guggcuguuuuguaggaguu

SEQ ID NO: 7445 - RNA, 20 nt, Artificial Sequence
  targeting sequence with GTCN PAM
gcaucaacugccgccagccc

SEQ ID NO: 7446 - RNA, 20 nt, Artificial Sequence
  targeting sequence with GTCN PAM
cugcauccugagcauguggg

SEQ ID NO: 7447 - RNA, 20 nt, Artificial Sequence
  targeting sequence with GTCN PAM
cacccacaugcucaggaugc

SEQ ID NO: 7448 - RNA, 20 nt, Artificial Sequence
  targeting sequence with GTCN PAM
acaggcugucccacccacau

SEQ ID NO: 7449 - RNA, 20 nt, Artificial Sequence
  targeting sequence with GTCN PAM
ugaggccagagagcagugga

SEQ ID NO: 7450 - RNA, 20 nt, Artificial Sequence
  targeting sequence with GTCN PAM
cuguuuaugaaaugaggaca

SEQ ID NO: 7451 - RNA, 20 nt, Artificial Sequence
  targeting sequence with GTCN PAM
ucauuucauaaacagggaca

SEQ ID NO: 7452 - RNA, 20 nt, Artificial Sequence
  targeting sequence with GTCN PAM
gaguguccucauuucauaaa

SEQ ID NO: 7453 - RNA, 20 nt, Artificial Sequence
  targeting sequence with GTCN PAM
gguaggugggcgucagagug

SEQ ID NO: 7454 - RNA, 20 nt, Artificial Sequence
  targeting sequence with GTCN PAM
cugucgguguucccagagau

SEQ ID NO: 7455 - RNA, 20 nt, Artificial Sequence
  targeting sequence with GTCN PAM
guguucccagagauaggacc

SEQ ID NO: 7456 - RNA, 20 nt, Artificial Sequence
  targeting sequence with GTCN PAM
uaucucugggaacaccgaca

SEQ ID NO: 7457 - RNA, 20 nt, Artificial Sequence
  targeting sequence with GTCN PAM
gauggcuuugcauucagacc

SEQ ID NO: 7458 - RNA, 20 nt, Artificial Sequence
  targeting sequence with GTCN PAM
gaaugcaaagccaucggacu

SEQ ID NO: 7459 - RNA, 20 nt, Artificial Sequence
  targeting sequence with GTCN PAM
acaucaaaggagcugggccu

SEQ ID NO: 7460 - RNA, 20 nt, Artificial Sequence
  targeting sequence with GTCN PAM
guguguguguguggccucug

SEQ ID NO: 7461 - RNA, 20 nt, Artificial Sequence
  targeting sequence with GTCN PAM
gugugugcgugugugucugu

SEQ ID NO: 7462 - RNA, 20 nt, Artificial Sequence
  targeting sequence with GTCN PAM
gugugugugugugcaggggc

SEQ ID NO: 7463 - RNA, 20 nt, Artificial Sequence
  targeting sequence with GTCN PAM
cugaacacacacacagacug

SEQ ID NO: 7464 - RNA, 20 nt, Artificial Sequence
  targeting sequence with GTCN PAM
guguguguguucagggacag

SEQ ID NO: 7465 - RNA, 20 nt, Artificial Sequence
  targeting sequence with GTCN PAM
gugugugugugugcaggagc

SEQ ID NO: 7466 - RNA, 20 nt, Artificial Sequence
  targeting sequence with GTCN PAM
cugugugugcaggggcaguc

SEQ ID NO: 7467 - RNA, 20 nt, Artificial Sequence
  targeting sequence with GTCN PAM
cugugugugugugcaggggc

SEQ ID NO: 7468 - RNA, 20 nt, Artificial Sequence
  targeting sequence with GTCN PAM
ccgugugugugcaggggcgg

SEQ ID NO: 7469 - RNA, 20 nt, Artificial Sequence
  targeting sequence with GTCN PAM
gugugugugugcagaggcag

SEQ ID NO: 7470 - RNA, 20 nt, Artificial Sequence
  targeting sequence with GTCN PAM
gugugugcacgcaggggcag

SEQ ID NO: 7471 - RNA, 20 nt, Artificial Sequence
  targeting sequence with GTCN PAM
cugugugugugugugugugu

SEQ ID NO: 7472 - RNA, 20 nt, Artificial Sequence
  targeting sequence with GTCN PAM
cugugugugugcaggggcag

SEQ ID NO: 7473 - RNA, 20 nt, Artificial Sequence
  targeting sequence with GTCN PAM
cugugugugugugcaggggc

SEQ ID NO: 7474 - RNA, 20 nt, Artificial Sequence
  targeting sequence with GTCN PAM
cugugugugugugcaggggc

SEQ ID NO: 7475 - RNA, 20 nt, Artificial Sequence
  targeting sequence with GTCN PAM
cuguaugugugugcaggagc

SEQ ID NO: 7476 - RNA, 20 nt, Artificial Sequence
  targeting sequence with GTCN PAM
gugugugugugcaggggcag

SEQ ID NO: 7477 - RNA, 20 nt, Artificial Sequence
  targeting sequence with GTCN PAM
cugugugugugggcaggggc

SEQ ID NO: 7478 - RNA, 20 nt, Artificial Sequence
  targeting sequence with GTCN PAM
ccaugugugugugcaggggc

SEQ ID NO: 7479 - RNA, 20 nt, Artificial Sequence
  targeting sequence with GTCN PAM
ccaugugugugugcaggggc

SEQ ID NO: 7480 - RNA, 20 nt, Artificial Sequence
  targeting sequence with GTCN PAM
cugugugugcacgcaggggc

SEQ ID NO: 7481 - RNA, 20 nt, Artificial Sequence
  targeting sequence with GTCN PAM
cucugugugugugugugugc

SEQ ID NO: 7482 - RNA, 20 nt, Artificial Sequence
  targeting sequence with GTCN PAM
cugugugugugcaggggcag

SEQ ID NO: 7483 - RNA, 20 nt, Artificial Sequence
  targeting sequence with GTCN PAM
ccgugugugugugugugugc

SEQ ID NO: 7484 - RNA, 20 nt, Artificial Sequence
  targeting sequence with GTCN PAM
cucugugugugugugugugu

SEQ ID NO: 7485 - RNA, 20 nt, Artificial Sequence
  targeting sequence with GTCN PAM
gugugugugugugcaggggc

SEQ ID NO: 7486 - RNA, 20 nt, Artificial Sequence
  targeting sequence with GTCN PAM
gugugcaggggcagucugug

SEQ ID NO: 7487 - RNA, 20 nt, Artificial Sequence
  targeting sequence with GTCN PAM
cugugugucugugugcaggg

SEQ ID NO: 7488 - RNA, 20 nt, Artificial Sequence
  targeting sequence with GTCN PAM
cugugugugugcaggagcgg

SEQ ID NO: 7489 - RNA, 20 nt, Artificial Sequence
  targeting sequence with GTCN PAM
cugugugugugugcaggggc

SEQ ID NO: 7490 - RNA, 20 nt, Artificial Sequence
  targeting sequence with GTCN PAM
gugugugugcaggggcagcc

SEQ ID NO: 7491 - RNA, 20 nt, Artificial Sequence
  targeting sequence with GTCN PAM
gugugcaggagcggucugug

SEQ ID NO: 7492 - RNA, 20 nt, Artificial Sequence
  targeting sequence with GTCN PAM
cugugugucugugugcagga

SEQ ID NO: 7493 - RNA, 20 nt, Artificial Sequence
  targeting sequence with GTCN PAM
ccgugugugugcaggagcgg

SEQ ID NO: 7494 - RNA, 20 nt, Artificial Sequence
  targeting sequence with GTCN PAM
cugugugugugcaggggcag

SEQ ID NO: 7495 - RNA, 20 nt, Artificial Sequence
  targeting sequence with GTCN PAM
guguguguguguguaggggc

SEQ ID NO: 7496 - RNA, 20 nt, Artificial Sequence
  targeting sequence with GTCN PAM
gugugugugugugugugugu

SEQ ID NO: 7497 - RNA, 20 nt, Artificial Sequence
  targeting sequence with GTCN PAM
cugugugugugugcaggggc

SEQ ID NO: 7498 - RNA, 20 nt, Artificial Sequence
  targeting sequence with GTCN PAM
gugugcaggggcagucucug

SEQ ID NO: 7499 - RNA, 20 nt, Artificial Sequence
  targeting sequence with GTCN PAM
cugugugucugugugcaggg

SEQ ID NO: 7500 - RNA, 20 nt, Artificial Sequence
  targeting sequence with GTCN PAM
ccaugugugugugcaggagc

SEQ ID NO: 7501 - RNA, 20 nt, Artificial Sequence
  targeting sequence with GTCN PAM
ccgugugugugcaggggcag

SEQ ID NO: 7502 - RNA, 20 nt, Artificial Sequence
  targeting sequence with GTCN PAM
cugugugugugcagaggcag

SEQ ID NO: 7503 - RNA, 20 nt, Artificial Sequence
  targeting sequence with GTCN PAM
guguguguguguaggggcag

SEQ ID NO: 7504 - RNA, 20 nt, Artificial Sequence
  targeting sequence with GTCN PAM
cugugugugugugugugugu

SEQ ID NO: 7505 - RNA, 20 nt, Artificial Sequence
  targeting sequence with GTCN PAM
cuguaugugugugcaggagc

SEQ ID NO: 7506 - RNA, 20 nt, Artificial Sequence
  targeting sequence with GTCN PAM
ccccaccugccuggcggcaa

SEQ ID NO: 7507 - RNA, 20 nt, Artificial Sequence
  targeting sequence with GTCN PAM
uuugcaaggccuccagcccc

SEQ ID NO: 7508 - RNA, 20 nt, Artificial Sequence
  targeting sequence with GTCN PAM
ggagggcauagagaaagggc

SEQ ID NO: 7509 - RNA, 20 nt, Artificial Sequence
  targeting sequence with GTCN PAM
augagggagauggcuucuuc

SEQ ID NO: 7510 - RNA, 20 nt, Artificial Sequence
  targeting sequence with GTCN PAM
cagcaccuccaggucgauga

SEQ ID NO: 7511 - RNA, 20 nt, Artificial Sequence
  targeting sequence with GTCN PAM
ucccgcuugggucucagcac

SEQ ID NO: 7512 - RNA, 20 nt, Artificial Sequence
  targeting sequence with GTCN PAM
gucaucccgcuugggucuca

SEQ ID NO: 7513 - RNA, 20 nt, Artificial Sequence
  targeting sequence with GTCN PAM
ggggacaggcgggaaguagg

SEQ ID NO: 7514 - RNA, 20 nt, Artificial Sequence
  targeting sequence with GTCN PAM
ccagaccccucacacagccg

SEQ ID NO: 7515 - RNA, 20 nt, Artificial Sequence
  targeting sequence with GTCN PAM
caggggaucgcgggccaugc

SEQ ID NO: 7516 - RNA, 20 nt, Artificial Sequence
  targeting sequence with GTCN PAM
caugugggccucuccaaucu

SEQ ID NO: 7517 - RNA, 20 nt, Artificial Sequence
  targeting sequence with GTCN PAM
cugucccaugugggccucuc

SEQ ID NO: 7518 - RNA, 20 nt, Artificial Sequence
  targeting sequence with GTCN PAM
gcccaucucugaucccuguc

SEQ ID NO: 7519 - RNA, 20 nt, Artificial Sequence
  targeting sequence with GTCN PAM
uuaggcccuggccagcuguc

SEQ ID NO: 7520 - RNA, 20 nt, Artificial Sequence
  targeting sequence with GTCN PAM
ucccgugugggucucccacc

SEQ ID NO: 7521 - RNA, 20 nt, Artificial Sequence
  targeting sequence with GTCN PAM
cccacccuccccugaccccu

SEQ ID NO: 7522 - RNA, 20 nt, Artificial Sequence
  targeting sequence with GTCN PAM
ggggagggugggagacccac

SEQ ID NO: 7523 - RNA, 20 nt, Artificial Sequence
  targeting sequence with GTCN PAM
gugcauagcuccugcauagc

SEQ ID NO: 7524 - RNA, 20 nt, Artificial Sequence
  targeting sequence with GTCN PAM
cauguuggcuaugcaggagc

SEQ ID NO: 7525 - RNA, 20 nt, Artificial Sequence
  targeting sequence with GTCN PAM
ugaugucgguguuggccccc

SEQ ID NO: 7526 - RNA, 20 nt, Artificial Sequence
  targeting sequence with GTCN PAM
guguuggcccccagcucuuc

SEQ ID NO: 7527 - RNA, 20 nt, Artificial Sequence
  targeting sequence with GTCN PAM
cuuucgcaugcaagugacag

SEQ ID NO: 7528 - RNA, 20 nt, Artificial Sequence
  targeting sequence with GTCN PAM
cuugcaugcgaaagugacuu

SEQ ID NO: 7529 - RNA, 20 nt, Artificial Sequence
  targeting sequence with GTCN PAM
aaaacugacaagcugaacaa

SEQ ID NO: 7530 - RNA, 20 nt, Artificial Sequence
  targeting sequence with GTCN PAM
guuuuggacucugucacuug

SEQ ID NO: 7531 - RNA, 20 nt, Artificial Sequence
  targeting sequence with GTCN PAM
ggucggucacaggcuggcuc

SEQ ID NO: 7532 - RNA, 20 nt, Artificial Sequence
  targeting sequence with GTCN PAM
gucacaggcuggcucugccu

SEQ ID NO: 7533 - RNA, 20 nt, Artificial Sequence
  targeting sequence with GTCN PAM
caggcuggcucugccucucu

SEQ ID NO: 7534 - RNA, 20 nt, Artificial Sequence
  targeting sequence with GTCN PAM
ucugggcaacuucauucuuu

SEQ ID NO: 7535 - RNA, 20 nt, Artificial Sequence
  targeting sequence with GTCN PAM
ggagcagugccagccccaca

SEQ ID NO: 7536 - RNA, 20 nt, Artificial Sequence
  targeting sequence with GTCN PAM
agggcaggccacacuugcag

SEQ ID NO: 7537 - RNA, 20 nt, Artificial Sequence
  targeting sequence with GTCN PAM
agccugcaaguguggccugc

SEQ ID NO: 7538 - RNA, 20 nt, Artificial Sequence
  targeting sequence with GTCN PAM
gugcaagggagcgaggccuc

SEQ ID NO: 7539 - RNA, 20 nt, Artificial Sequence
  targeting sequence with GTCN PAM
gcaggccugggggcuguaag

SEQ ID NO: 7540 - RNA, 20 nt, Artificial Sequence
  targeting sequence with GTCN PAM
uuccuucagcaagcagcucu

SEQ ID NO: 7541 - RNA, 20 nt, Artificial Sequence
  targeting sequence with GTCN PAM
gucuuuccuucagcaagcag

SEQ ID NO: 7542 - RNA, 20 nt, Artificial Sequence
  targeting sequence with GTCN PAM
ccauguccugggccucccug

SEQ ID NO: 7543 - RNA, 20 nt, Artificial Sequence
  targeting sequence with GTCN PAM
ugggccucccugcaggaccc

SEQ ID NO: 7544 - RNA, 20 nt, Artificial Sequence
  targeting sequence with GTCN PAM
ugcagggaggcccaggacau

SEQ ID NO: 7545 - RNA, 20 nt, Artificial Sequence
  targeting sequence with GTCN PAM
cuggaaaccgccccucuccc

SEQ ID NO: 7546 - RNA, 20 nt, Artificial Sequence
  targeting sequence with GTCN PAM
gacccgcccuggggucagca

SEQ ID NO: 7547 - RNA, 20 nt, Artificial Sequence
  targeting sequence with GTCN PAM
gacucaccuggaggucccug

SEQ ID NO: 7548 - RNA, 20 nt, Artificial Sequence
  targeting sequence with GTCN PAM
gcagggacucucgccccugu

SEQ ID NO: 7549 - RNA, 20 nt, Artificial Sequence
  targeting sequence with GTCN PAM
cugcugaccccagggcgggu

SEQ ID NO: 7550 - RNA, 20 nt, Artificial Sequence
  targeting sequence with GTCN PAM
gcuccaucacaagugcccgc

SEQ ID NO: 7551 - RNA, 20 nt, Artificial Sequence
  targeting sequence with GTCN PAM
gcgggcacuugugauggagc

SEQ ID NO: 7552 - RNA, 20 nt, Artificial Sequence
  targeting sequence with GTCN PAM
cuuccuucugauuccuuggc

SEQ ID NO: 7553 - RNA, 20 nt, Artificial Sequence
  targeting sequence with GTCN PAM
ggcugcccuugagucuucuc

SEQ ID NO: 7554 - RNA, 20 nt, Artificial Sequence
  targeting sequence with GTCN PAM
ucucacagggguguagggug

SEQ ID NO: 7555 - RNA, 20 nt, Artificial Sequence
  targeting sequence with GTCN PAM
gucuccaucucugcuucuga

SEQ ID NO: 7556 - RNA, 20 nt, Artificial Sequence
  targeting sequence with GTCN PAM
ccaucucugcuucugauucc

SEQ ID NO: 7557 - RNA, 20 nt, Artificial Sequence
  targeting sequence with GTCN PAM
aggauggaaucagaagcaga

SEQ ID NO: 7558 - RNA, 20 nt, Artificial Sequence
  targeting sequence with GTCN PAM
ccacuagccgcagaaucugg

SEQ ID NO: 7559 - RNA, 20 nt, Artificial Sequence
  targeting sequence with GTCN PAM
uuggucuccacuagccgcag

SEQ ID NO: 7560 - RNA, 20 nt, Artificial Sequence
  targeting sequence with GTCN PAM
ucaucuccgauggaguccuu

SEQ ID NO: 7561 - RNA, 20 nt, Artificial Sequence
  targeting sequence with GTCN PAM
cccagagaggcacccucacc

SEQ ID NO: 7562 - RNA, 20 nt, Artificial Sequence
  targeting sequence with GTCN PAM
ccaugugcacaggagaaggg

SEQ ID NO: 7563 - RNA, 20 nt, Artificial Sequence
  targeting sequence with GTCN PAM
ugccccuccuucgugccacc

SEQ ID NO: 7564 - RNA, 20 nt, Artificial Sequence
  targeting sequence with GTCN PAM
cucgggggcagccauggcuc

SEQ ID NO: 7565 - RNA, 20 nt, Artificial Sequence
  targeting sequence with GTCN PAM
guggacagggaggcagcuuc

SEQ ID NO: 7566 - RNA, 20 nt, Artificial Sequence
  targeting sequence with GTCN PAM
acagaccugcgcccuuggcc

SEQ ID NO: 7567 - RNA, 20 nt, Artificial Sequence
  targeting sequence with GTCN PAM
ccuggguuuaggaagcaggu

SEQ ID NO: 7568 - RNA, 20 nt, Artificial Sequence
  targeting sequence with GTCN PAM
ucucucaccacugccaaaga

SEQ ID NO: 7569 - RNA, 20 nt, Artificial Sequence
  targeting sequence with GTCN PAM
cacuguggcugagugaggac

SEQ ID NO: 7570 - RNA, 20 nt, Artificial Sequence
  targeting sequence with GTCN PAM
ucacucagccacagugagac

SEQ ID NO: 7571 - RNA, 20 nt, Artificial Sequence
  targeting sequence with GTCN PAM
ucaucaagcgauggccccca

SEQ ID NO: 7572 - RNA, 20 nt, Artificial Sequence
  targeting sequence with GTCN PAM
ggcagcagugagcggaagua

SEQ ID NO: 7573 - RNA, 20 nt, Artificial Sequence
  targeting sequence with GTCN PAM
cucugggaggcguggccccu

SEQ ID NO: 7574 - RNA, 20 nt, Artificial Sequence
  targeting sequence with GTCN PAM
caacuuggagccauggaugu

SEQ ID NO: 7575 - RNA, 20 nt, Artificial Sequence
  targeting sequence with GTCN PAM
guccucuccccugcuugcau

SEQ ID NO: 7576 - RNA, 20 nt, Artificial Sequence
  targeting sequence with GTCN PAM
ucuccccugcuugcauucca

SEQ ID NO: 7577 - RNA, 20 nt, Artificial Sequence
  targeting sequence with GTCN PAM
acuuuagaugcacauggaau

SEQ ID NO: 7578 - RNA, 20 nt, Artificial Sequence
  targeting sequence with GTCN PAM
acauccuccccaaauccugg

SEQ ID NO: 7579 - RNA, 20 nt, Artificial Sequence
  targeting sequence with GTCN PAM
agggcacaucacgcuugcug

SEQ ID NO: 7580 - RNA, 20 nt, Artificial Sequence
  targeting sequence with GTCN PAM
guguccagcccugaccacug

SEQ ID NO: 7581 - RNA, 20 nt, Artificial Sequence
  targeting sequence with GTCN PAM
agcccugaccacugccaagc

SEQ ID NO: 7582 - RNA, 20 nt, Artificial Sequence
  targeting sequence with GTCN PAM
gggcuggacacagaccugca

SEQ ID NO: 7583 - RNA, 20 nt, Artificial Sequence
  targeting sequence with GTCN PAM
uggccccaggcguagggcug

SEQ ID NO: 7584 - RNA, 20 nt, Artificial Sequence
  targeting sequence with GTCN PAM
uacagcugucuucccuuaga

SEQ ID NO: 7585 - RNA, 20 nt, Artificial Sequence
  targeting sequence with GTCN PAM
ucccuuagauguuccauucu

SEQ ID NO: 7586 - RNA, 20 nt, Artificial Sequence
  targeting sequence with GTCN PAM
ucagaauggaacaucuaagg

SEQ ID NO: 7587 - RNA, 20 nt, Artificial Sequence
  targeting sequence with GTCN PAM
uccuugcaccugcggcagua

SEQ ID NO: 7588 - RNA, 20 nt, Artificial Sequence
  targeting sequence with GTCN PAM
ugggccagggucauccuugc

SEQ ID NO: 7589 - RNA, 20 nt, Artificial Sequence
  targeting sequence with GTCN PAM
ccaggaugcuggucaugggc

SEQ ID NO: 7590 - RNA, 20 nt, Artificial Sequence
  targeting sequence with GTCN PAM
gcugggcugugaaggagaau

SEQ ID NO: 7591 - RNA, 20 nt, Artificial Sequence
  targeting sequence with GTCN PAM
gaauguguuucuugcccaga

SEQ ID NO: 7592 - RNA, 20 nt, Artificial Sequence
  targeting sequence with GTCN PAM
gccgaucugucagaccguua

SEQ ID NO: 7593 - RNA, 20 nt, Artificial Sequence
  targeting sequence with GTCN PAM
gaccguuagcauguacauuu

SEQ ID NO: 7594 - RNA, 20 nt, Artificial Sequence
  targeting sequence with GTCN PAM
gacagaucggcggacuccag

SEQ ID NO: 7595 - RNA, 20 nt, Artificial Sequence
  targeting sequence with GTCN PAM
uuauugaggcaaucuguugg

SEQ ID NO: 7596 - RNA, 20 nt, Artificial Sequence
  targeting sequence with GTCN PAM
gcaacuuaauuuccguaugc

SEQ ID NO: 7597 - RNA, 20 nt, Artificial Sequence
  targeting sequence with GTCN PAM
agauggauccccauuaaauc

SEQ ID NO: 7598 - RNA, 20 nt, Artificial Sequence
  targeting sequence with GTCN PAM
aaagaagauggcaggaguuu

SEQ ID NO: 7599 - RNA, 20 nt, Artificial Sequence
  targeting sequence with GTCN PAM
aggcuccuguccaggcucug

SEQ ID NO: 7600 - RNA, 20 nt, Artificial Sequence
  targeting sequence with GTCN PAM
aggcucuggagccgcccucu

SEQ ID NO: 7601 - RNA, 20 nt, Artificial Sequence
  targeting sequence with GTCN PAM
ccauugggcuggggcugcuc

SEQ ID NO: 7602 - RNA, 20 nt, Artificial Sequence
  targeting sequence with GTCN PAM
ggaaucucaaacggaaaccc

SEQ ID NO: 7603 - RNA, 20 nt, Artificial Sequence
  targeting sequence with GTCN PAM
guucccucaggcaucacugg

SEQ ID NO: 7604 - RNA, 20 nt, Artificial Sequence
  targeting sequence with GTCN PAM
aguccaacagcuugagggca

SEQ ID NO: 7605 - RNA, 20 nt, Artificial Sequence
  targeting sequence with GTCN PAM
aacagcuugagggcauggaa

SEQ ID NO: 7606 - RNA, 20 nt, Artificial Sequence
  targeting sequence with GTCN PAM
cccauacaugugaguucucc

SEQ ID NO: 7607 - RNA, 20 nt, Artificial Sequence
  targeting sequence with GTCN PAM
caggccucucagcagcccug

SEQ ID NO: 7608 - RNA, 20 nt, Artificial Sequence
  targeting sequence with GTCN PAM
agccccaaggcccugccccu

SEQ ID NO: 7609 - RNA, 20 nt, Artificial Sequence
  targeting sequence with GTCN PAM
accugccagagguggcaaug

SEQ ID NO: 7610 - RNA, 20 nt, Artificial Sequence
  targeting sequence with GTCN PAM
ugccaugccgaaacgcaccc

SEQ ID NO: 7611 - RNA, 20 nt, Artificial Sequence
  targeting sequence with GTCN PAM
gggcagggcaaauaugccca

SEQ ID NO: 7612 - RNA, 20 nt, Artificial Sequence
  targeting sequence with GTCN PAM
cuccagugggcauauuugcc

SEQ ID NO: 7613 - RNA, 20 nt, Artificial Sequence
  targeting sequence with GTCN PAM
gcgucccuccagugggcaua

SEQ ID NO: 7614 - RNA, 20 nt, Artificial Sequence
  targeting sequence with GTCN PAM
cagugucugcgucccuccag

SEQ ID NO: 7615 - RNA, 20 nt, Artificial Sequence
  targeting sequence with GTCN PAM
gagcuagagccccaucccag

SEQ ID NO: 7616 - RNA, 20 nt, Artificial Sequence
  targeting sequence with GTCN PAM
gggguggggcaagggcucug

SEQ ID NO: 7617 - RNA, 20 nt, Artificial Sequence
  targeting sequence with GTCN PAM
ggcucccuuucuuuauuuuc

SEQ ID NO: 7618 - RNA, 20 nt, Artificial Sequence
  targeting sequence with GTCN PAM
agugucuaauuacuuaccau

SEQ ID NO: 7619 - RNA, 20 nt, Artificial Sequence
  targeting sequence with GTCN PAM
aauuacuuaccaucaugcau

SEQ ID NO: 7620 - RNA, 20 nt, Artificial Sequence
  targeting sequence with GTCN PAM
ugcgcuaauggaaauccuaa

SEQ ID NO: 7621 - RNA, 20 nt, Artificial Sequence
  targeting sequence with GTCN PAM
aucacagugacagaucagau

SEQ ID NO: 7622 - RNA, 20 nt, Artificial Sequence
  targeting sequence with GTCN PAM
cugugauugacugcugggua

SEQ ID NO: 7623 - RNA, 20 nt, Artificial Sequence
  targeting sequence with GTCN PAM
cuggcuggaggcaggggagg

SEQ ID NO: 7624 - RNA, 20 nt, Artificial Sequence
  targeting sequence with GTCN PAM
cggcuggaacccuccccugc

SEQ ID NO: 7625 - RNA, 20 nt, Artificial Sequence
  targeting sequence with GTCN PAM
uacucaggccucuagagcug

SEQ ID NO: 7626 - RNA, 20 nt, Artificial Sequence
  targeting sequence with GTCN PAM
ucaccuguguaauaggcagc

SEQ ID NO: 7627 - RNA, 20 nt, Artificial Sequence
  targeting sequence with GTCN PAM
uguuauuuuucauucagcaa

SEQ ID NO: 7628 - RNA, 20 nt, Artificial Sequence
  targeting sequence with GTCN PAM
caccugggugcaaccuuugu

SEQ ID NO: 7629 - RNA, 20 nt, Artificial Sequence
  targeting sequence with GTCN PAM
ggcugcuuuucucucucagc

SEQ ID NO: 7630 - RNA, 20 nt, Artificial Sequence
  targeting sequence with GTCN PAM
gaaccaaguccagucuuuuc

SEQ ID NO: 7631 - RNA, 20 nt, Artificial Sequence
  targeting sequence with GTCN PAM
agucuuuucuccaaggcugu

SEQ ID NO: 7632 - RNA, 20 nt, Artificial Sequence
  targeting sequence with GTCN PAM
uuucuccaaggcuguuuccc

SEQ ID NO: 7633 - RNA, 20 nt, Artificial Sequence
  targeting sequence with GTCN PAM
gagcuggagggggcccuuuu

SEQ ID NO: 7634 - RNA, 20 nt, Artificial Sequence
  targeting sequence with GTCN PAM
gcgucugugaacagcgcugg

SEQ ID NO: 7635 - RNA, 20 nt, Artificial Sequence
  targeting sequence with GTCN PAM
gugaacagcgcuggaugaug

SEQ ID NO: 7636 - RNA, 20 nt, Artificial Sequence
  targeting sequence with GTCN PAM
acaggaucaucauccagcgc

SEQ ID NO: 7637 - RNA, 20 nt, Artificial Sequence
  targeting sequence with GTCN PAM
caggcacuugaggggucaac

SEQ ID NO: 7638 - RNA, 20 nt, Artificial Sequence
  targeting sequence with GTCN PAM
cuguggugccuuccuuguca

SEQ ID NO: 7639 - RNA, 20 nt, Artificial Sequence
  targeting sequence with GTCN PAM
ucuuaguucaaugggcauca

SEQ ID NO: 7640 - RNA, 20 nt, Artificial Sequence
  targeting sequence with GTCN PAM
caacuacucaggaggcugag

SEQ ID NO: 7641 - RNA, 20 nt, Artificial Sequence
  targeting sequence with GTCN PAM
uuggcucaauugauccuucc

SEQ ID NO: 7642 - RNA, 20 nt, Artificial Sequence
  targeting sequence with GTCN PAM
ucuuaaaacaauuuuuaaau

SEQ ID NO: 7643 - RNA, 20 nt, Artificial Sequence
  targeting sequence with GTCN PAM
cucacaccuguaaucucagc

SEQ ID NO: 7644 - RNA, 20 nt, Artificial Sequence
  targeting sequence with GTCN PAM
cuaacucccggcucaagcga

SEQ ID NO: 7645 - RNA, 20 nt, Artificial Sequence
  targeting sequence with GTCN PAM
gagcuggucucuaacucccg

SEQ ID NO: 7646 - RNA, 20 nt, Artificial Sequence
  targeting sequence with GTCN PAM
cccuauauugucugagcugg

SEQ ID NO: 7647 - RNA, 20 nt, Artificial Sequence
  targeting sequence with GTCN PAM
gauggggucucccuauauug

SEQ ID NO: 7648 - RNA, 20 nt, Artificial Sequence
  targeting sequence with GTCN PAM
cagucagauggggucucccu

SEQ ID NO: 7649 - RNA, 20 nt, Artificial Sequence
  targeting sequence with GTCN PAM
ugaucucucaucuccaagug

SEQ ID NO: 7650 - RNA, 20 nt, Artificial Sequence
  targeting sequence with GTCN PAM
accucucccuuacuuccucc

SEQ ID NO: 7651 - RNA, 20 nt, Artificial Sequence
  targeting sequence with GTCN PAM
accugaggcugcucagucua

SEQ ID NO: 7652 - RNA, 20 nt, Artificial Sequence
  targeting sequence with GTCN PAM
gguccaccugaggcugcuca

SEQ ID NO: 7653 - RNA, 20 nt, Artificial Sequence
  targeting sequence with GTCN PAM
ccagucagguccaccugagg

SEQ ID NO: 7654 - RNA, 20 nt, Artificial Sequence
  targeting sequence with GTCN PAM
ccgggccuugguuucccauc

SEQ ID NO: 7655 - RNA, 20 nt, Artificial Sequence
  targeting sequence with GTCN PAM
ccagcaaggcugugaagcua

SEQ ID NO: 7656 - RNA, 20 nt, Artificial Sequence
  targeting sequence with GTCN PAM
cacaggugggcagaggcccc

SEQ ID NO: 7657 - RNA, 20 nt, Artificial Sequence
  targeting sequence with GTCN PAM
cucugugucucuucccuggc

SEQ ID NO: 7658 - RNA, 20 nt, Artificial Sequence
  targeting sequence with GTCN PAM
cuucccuggcuuggagucug

SEQ ID NO: 7659 - RNA, 20 nt, Artificial Sequence
  targeting sequence with GTCN PAM
gugugcccacagcagaggcc

SEQ ID NO: 7660 - RNA, 20 nt, Artificial Sequence
  targeting sequence with GTCN PAM
ccauaccaggccaguguucu

SEQ ID NO: 7661 - RNA, 20 nt, Artificial Sequence
  targeting sequence with GTCN PAM
uggcccucccugcuugccac

SEQ ID NO: 7662 - RNA, 20 nt, Artificial Sequence
  targeting sequence with GTCN PAM
ggguguuggcugaauugcau

SEQ ID NO: 7663 - RNA, 20 nt, Artificial Sequence
  targeting sequence with GTCN PAM
cccaagcagggcagguaggg

SEQ ID NO: 7664 - RNA, 20 nt, Artificial Sequence
  targeting sequence with GTCN PAM
aaagagucucccaagcaggg

SEQ ID NO: 7665 - RNA, 20 nt, Artificial Sequence
  targeting sequence with GTCN PAM
accuuuugcuccucugggcu

SEQ ID NO: 7666 - RNA, 20 nt, Artificial Sequence
  targeting sequence with GTCN PAM
cagugcugugggagcccaga

SEQ ID NO: 7667 - RNA, 20 nt, Artificial Sequence
  targeting sequence with GTCN PAM
caggggguacugaucggaaa

SEQ ID NO: 7668 - RNA, 20 nt, Artificial Sequence
  targeting sequence with GTCN PAM
ccagggccuggcgcauauaa

SEQ ID NO: 7669 - RNA, 20 nt, Artificial Sequence
  targeting sequence with GTCN PAM
uucucccucccuuauucccc

SEQ ID NO: 7670 - RNA, 20 nt, Artificial Sequence
  targeting sequence with GTCN PAM
ccaaggcuacaugaggccuu

SEQ ID NO: 7671 - RNA, 20 nt, Artificial Sequence
  targeting sequence with GTCN PAM
cccacauggcucagccccac

SEQ ID NO: 7672 - RNA, 20 nt, Artificial Sequence
  targeting sequence with GTCN PAM
gcauccuucuccuccuucuc

SEQ ID NO: 7673 - RNA, 20 nt, Artificial Sequence
  targeting sequence with GTCN PAM
cagcccucgggagcccggcu

SEQ ID NO: 7674 - RNA, 20 nt, Artificial Sequence
  targeting sequence with GTCN PAM
agagaaacccaugguguggg

SEQ ID NO: 7675 - RNA, 20 nt, Artificial Sequence
  targeting sequence with GTCN PAM
ggcaguccagagaaacccau

SEQ ID NO: 7676 - RNA, 20 nt, Artificial Sequence
  targeting sequence with GTCN PAM
aaguuccucugcagagcugg

SEQ ID NO: 7677 - RNA, 20 nt, Artificial Sequence
  targeting sequence with GTCN PAM
guggggaguuagacccucuu

SEQ ID NO: 7678 - RNA, 20 nt, Artificial Sequence
  targeting sequence with GTCN PAM
aacuccccacugaccacuga

SEQ ID NO: 7679 - RNA, 20 nt, Artificial Sequence
  targeting sequence with GTCN PAM
ugcauucuagaaauagaugg

SEQ ID NO: 7680 - RNA, 20 nt, Artificial Sequence
  targeting sequence with GTCN PAM
gucaauaaguagacaaauga

SEQ ID NO: 7681 - RNA, 20 nt, Artificial Sequence
  targeting sequence with GTCN PAM
auaaguagacaaaugaggcc

SEQ ID NO: 7682 - RNA, 20 nt, Artificial Sequence
  targeting sequence with GTCN PAM
acuuauugacugacuuccca

SEQ ID NO: 7683 - RNA, 20 nt, Artificial Sequence
  targeting sequence with GTCN PAM
acaggcaugccaccacaccu

SEQ ID NO: 7684 - RNA, 20 nt, Artificial Sequence
  targeting sequence with GTCN PAM
uaggcucaagugauccuccu

SEQ ID NO: 7685 - RNA, 20 nt, Artificial Sequence
  targeting sequence with GTCN PAM
ugcucuguugcccaggcugg

SEQ ID NO: 7686 - RNA, 20 nt, Artificial Sequence
  targeting sequence with GTCN PAM
ucuuaaaacaauuuuuaaau

SEQ ID NO: 7687 - RNA, 20 nt, Artificial Sequence
  targeting sequence with GTCN PAM
cugaugguaaugacugugua

SEQ ID NO: 7688 - RNA, 20 nt, Artificial Sequence
  targeting sequence with GTCN PAM
uuaccaucagcgacuaucuc

SEQ ID NO: 7689 - RNA, 20 nt, Artificial Sequence
  targeting sequence with GTCN PAM
aagcuguucucuaacuccca

SEQ ID NO: 7690 - RNA, 20 nt, Artificial Sequence
  targeting sequence with GTCN PAM
cagcuacucagggguugagg

SEQ ID NO: 7691 - RNA, 20 nt, Artificial Sequence
  targeting sequence with GTCN PAM
accaccucaaccccugagua

SEQ ID NO: 7692 - RNA, 20 nt, Artificial Sequence
  targeting sequence with GTCN PAM
cagagugauacccugucuca

SEQ ID NO: 7693 - RNA, 20 nt, Artificial Sequence
  targeting sequence with GTCN PAM
caaaaaacaauaggccaggu

SEQ ID NO: 7694 - RNA, 20 nt, Artificial Sequence
  targeting sequence with GTCN PAM
cuaacuccugaucucaagug

SEQ ID NO: 7695 - RNA, 20 nt, Artificial Sequence
  targeting sequence with GTCN PAM
guacuaaaaauauaaaaauu

SEQ ID NO: 7696 - RNA, 20 nt, Artificial Sequence
  targeting sequence with GTCN PAM
ugguuacuugggaggcuaag

SEQ ID NO: 7697 - RNA, 20 nt, Artificial Sequence
  targeting sequence with GTCN PAM
cccaagcuggagugcagugg

SEQ ID NO: 7698 - RNA, 20 nt, Artificial Sequence
  targeting sequence with GTCN PAM
cacucugucacccaagcugg

SEQ ID NO: 7699 - RNA, 20 nt, Artificial Sequence
  targeting sequence with GTCN PAM
caaaacagcuaaaccuggug

SEQ ID NO: 7700 - RNA, 20 nt, Artificial Sequence
  targeting sequence with GTCN PAM
gggguggucucuccaaggac

SEQ ID NO: 7701 - RNA, 20 nt, Artificial Sequence
  targeting sequence with GTCN PAM
cuccaaggacaugaguguga

SEQ ID NO: 7702 - RNA, 20 nt, Artificial Sequence
  targeting sequence with GTCN PAM
uuggagagaccaccccugac

SEQ ID NO: 7703 - RNA, 20 nt, Artificial Sequence
  targeting sequence with GTCN PAM
ccgcucacacucauguccuu

SEQ ID NO: 7704 - RNA, 20 nt, Artificial Sequence
  targeting sequence with GTCN PAM
ccuucaggucuccgcucaca

SEQ ID NO: 7705 - RNA, 20 nt, Artificial Sequence
  targeting sequence with GTCN PAM
gcaacaaauauauugaucac

SEQ ID NO: 7706 - RNA, 20 nt, Artificial Sequence
  targeting sequence with GTCN PAM
agauguaaggguggguggaa

SEQ ID NO: 7707 - RNA, 20 nt, Artificial Sequence
  targeting sequence with GTCN PAM
aaagauucacgaaccaggcu

SEQ ID NO: 7708 - RNA, 20 nt, Artificial Sequence
  targeting sequence with GTCN PAM
gagcaaacugaggcccagag

SEQ ID NO: 7709 - RNA, 20 nt, Artificial Sequence
  targeting sequence with GTCN PAM
ugcuuccuuccccucucugg

SEQ ID NO: 7710 - RNA, 20 nt, Artificial Sequence
  targeting sequence with GTCN PAM
ccaugguaguccugcuuccu

SEQ ID NO: 7711 - RNA, 20 nt, Artificial Sequence
  targeting sequence with GTCN PAM
uugagucaccaugguagucc

SEQ ID NO: 7712 - RNA, 20 nt, Artificial Sequence
  targeting sequence with GTCN PAM
cacaggccuggcguggggca

SEQ ID NO: 7713 - RNA, 20 nt, Artificial Sequence
  targeting sequence with GTCN PAM
agggccuuuccauuacccca

SEQ ID NO: 7714 - RNA, 20 nt, Artificial Sequence
  targeting sequence with GTCN PAM
uuuauaccauggugugaaug

SEQ ID NO: 7715 - RNA, 20 nt, Artificial Sequence
  targeting sequence with GTCN PAM
uuccugagagcuaucuuuga

SEQ ID NO: 7716 - RNA, 20 nt, Artificial Sequence
  targeting sequence with GTCN PAM
acugggcuuccugggguauc

SEQ ID NO: 7717 - RNA, 20 nt, Artificial Sequence
  targeting sequence with GTCN PAM
cugauuuguaacgggaccug

SEQ ID NO: 7718 - RNA, 20 nt, Artificial Sequence
  targeting sequence with GTCN PAM
cguuacaaaucagugacagc

SEQ ID NO: 7719 - RNA, 20 nt, Artificial Sequence
  targeting sequence with GTCN PAM
uuucaucugcaaaauggaua

SEQ ID NO: 7720 - RNA, 20 nt, Artificial Sequence
  targeting sequence with GTCN PAM
gaguaggugacuucgaauga

SEQ ID NO: 7721 - RNA, 20 nt, Artificial Sequence
  targeting sequence with GTCN PAM
ccuacucugaccaucucugc

SEQ ID NO: 7722 - RNA, 20 nt, Artificial Sequence
  targeting sequence with GTCN PAM
uucgaagucaccuacucuga

SEQ ID NO: 7723 - RNA, 20 nt, Artificial Sequence
  targeting sequence with GTCN PAM
guuuuccugaacaaagagca

SEQ ID NO: 7724 - RNA, 20 nt, Artificial Sequence
  targeting sequence with GTCN PAM
ggcccaagaaauuuuuuuuu

SEQ ID NO: 7725 - RNA, 20 nt, Artificial Sequence
  targeting sequence with GTCN PAM
ugaacuccuggcucaagcga

SEQ ID NO: 7726 - RNA, 20 nt, Artificial Sequence
  targeting sequence with GTCN PAM
cgcuauguugcccaggcugg

SEQ ID NO: 7727 - RNA, 20 nt, Artificial Sequence
  targeting sequence with GTCN PAM
cagcuacucaggaggcugag

SEQ ID NO: 7728 - RNA, 20 nt, Artificial Sequence
  targeting sequence with GTCN PAM
cccaggcuggagugcagugc

SEQ ID NO: 7729 - RNA, 20 nt, Artificial Sequence
  targeting sequence with GTCN PAM
cugucgcccaggcuggagug

SEQ ID NO: 7730 - RNA, 20 nt, Artificial Sequence
  targeting sequence with GTCN PAM
caaaacuuuuuuuuucuucg

SEQ ID NO: 7731 - RNA, 20 nt, Artificial Sequence
  targeting sequence with GTCN PAM
agcuuuacagaauaaagagc

SEQ ID NO: 7732 - RNA, 20 nt, Artificial Sequence
  targeting sequence with GTCN PAM
ccucagugauggcuguuagu

SEQ ID NO: 7733 - RNA, 20 nt, Artificial Sequence
  targeting sequence with GTCN PAM
cagguuccuccuuugugagu

SEQ ID NO: 7734 - RNA, 20 nt, Artificial Sequence
  targeting sequence with GTCN PAM
auucccccacucacucguuc

SEQ ID NO: 7735 - RNA, 20 nt, Artificial Sequence
  targeting sequence with GTCN PAM
ccagggccuggcaccuagaa

SEQ ID NO: 7736 - RNA, 20 nt, Artificial Sequence
  targeting sequence with GTCN PAM
guuuuguucacugauguguc

SEQ ID NO: 7737 - RNA, 20 nt, Artificial Sequence
  targeting sequence with GTCN PAM
cugggaacccuguugugagc

SEQ ID NO: 7738 - RNA, 20 nt, Artificial Sequence
  targeting sequence with GTCN PAM
ugcucacaacaggguuccca

SEQ ID NO: 7739 - RNA, 20 nt, Artificial Sequence
  targeting sequence with GTCN PAM
gucuugcucacaacaggguu

SEQ ID NO: 7740 - RNA, 20 nt, Artificial Sequence
  targeting sequence with GTCN PAM
acaaggguaagccugggucu

SEQ ID NO: 7741 - RNA, 20 nt, Artificial Sequence
  targeting sequence with GTCN PAM
cccugccuguaacaugaguc

SEQ ID NO: 7742 - RNA, 20 nt, Artificial Sequence
  targeting sequence with GTCN PAM
gaagcacuaugcaaaaagca

SEQ ID NO: 7743 - RNA, 20 nt, Artificial Sequence
  targeting sequence with GTCN PAM
gucuugacccaaggcaucca

SEQ ID NO: 7744 - RNA, 20 nt, Artificial Sequence
  targeting sequence with GTCN PAM
ugacccaaggcauccaggac

SEQ ID NO: 7745 - RNA, 20 nt, Artificial Sequence
  targeting sequence with GTCN PAM
agacugacccacaacuggcc

SEQ ID NO: 7746 - RNA, 20 nt, Artificial Sequence
  targeting sequence with GTCN PAM
uggaugccuugggucaagac

SEQ ID NO: 7747 - RNA, 20 nt, Artificial Sequence
  targeting sequence with GTCN PAM
acgucagaaucaaacccuca

SEQ ID NO: 7748 - RNA, 20 nt, Artificial Sequence
  targeting sequence with GTCN PAM
gaaucaaacccucaccuuaa

SEQ ID NO: 7749 - RNA, 20 nt, Artificial Sequence
  targeting sequence with GTCN PAM
aacagcguuuggcacacgug

SEQ ID NO: 7750 - RNA, 20 nt, Artificial Sequence
  targeting sequence with GTCN PAM
gcucagaagagugcccccuu

SEQ ID NO: 7751 - RNA, 20 nt, Artificial Sequence
  targeting sequence with GTCN PAM
cucuucccacccaggauucc

SEQ ID NO: 7752 - RNA, 20 nt, Artificial Sequence
  targeting sequence with GTCN PAM
uuccgccuggauguccuucc

SEQ ID NO: 7753 - RNA, 20 nt, Artificial Sequence
  targeting sequence with GTCN PAM
uuccccugaagcuuccuccu

SEQ ID NO: 7754 - RNA, 20 nt, Artificial Sequence
  targeting sequence with GTCN PAM
cagccacucccaacacagga

SEQ ID NO: 7755 - RNA, 20 nt, Artificial Sequence
  targeting sequence with GTCN PAM
cuacuguuauucgcucuucu

SEQ ID NO: 7756 - RNA, 20 nt, Artificial Sequence
  targeting sequence with GTCN PAM
cugugcccccucaccccaca

SEQ ID NO: 7757 - RNA, 20 nt, Artificial Sequence
  targeting sequence with GTCN PAM
ccaaggaccaagcaccuugu

SEQ ID NO: 7758 - RNA, 20 nt, Artificial Sequence
  targeting sequence with GTCN PAM
uuggggacacacaggguaca

SEQ ID NO: 7759 - RNA, 20 nt, Artificial Sequence
  targeting sequence with GTCN PAM
gggccacaguaggugcucaa

SEQ ID NO: 7760 - RNA, 20 nt, Artificial Sequence
  targeting sequence with GTCN PAM
agccaacauguguauugagc

SEQ ID NO: 7761 - RNA, 20 nt, Artificial Sequence
  targeting sequence with GTCN PAM
cugagcggccgcacgucggg

SEQ ID NO: 7762 - RNA, 20 nt, Artificial Sequence
  targeting sequence with GTCN PAM
ggcacucucagcacuugcac

SEQ ID NO: 7763 - RNA, 20 nt, Artificial Sequence
  targeting sequence with GTCN PAM
ggggcggccugugcaagugc

SEQ ID NO: 7764 - RNA, 20 nt, Artificial Sequence
  targeting sequence with GTCN PAM
ucauguugcuuggacgacgg

SEQ ID NO: 7765 - RNA, 20 nt, Artificial Sequence
  targeting sequence with GTCN PAM
aagcaacaugaugacaccuc

SEQ ID NO: 7766 - RNA, 20 nt, Artificial Sequence
  targeting sequence with GTCN PAM
uccaagcaacaugaugacac

SEQ ID NO: 7767 - RNA, 20 nt, Artificial Sequence
  targeting sequence with GTCN PAM
cccucuccccgucguccaag

SEQ ID NO: 7768 - RNA, 20 nt, Artificial Sequence
  targeting sequence with GTCN PAM
ucugcccccaaggcucugac

SEQ ID NO: 7769 - RNA, 20 nt, Artificial Sequence
  targeting sequence with GTCN PAM
gagccuugggggcagaugac

SEQ ID NO: 7770 - RNA, 20 nt, Artificial Sequence
  targeting sequence with GTCN PAM
gcugccuccagggccagccu

SEQ ID NO: 7771 - RNA, 20 nt, Artificial Sequence
  targeting sequence with GTCN PAM
gaaggggaggcuggcccugg

SEQ ID NO: 7772 - RNA, 20 nt, Artificial Sequence
  targeting sequence with GTCN PAM
ccugaaggguucugccccuc

SEQ ID NO: 7773 - RNA, 20 nt, Artificial Sequence
  targeting sequence with GTCN PAM
ccuuucuacaccagugaucu

SEQ ID NO: 7774 - RNA, 20 nt, Artificial Sequence
  targeting sequence with GTCN PAM
ugaacgcuaggccggggaac

SEQ ID NO: 7775 - RNA, 20 nt, Artificial Sequence
  targeting sequence with GTCN PAM
gggaggccauguuugggccu

SEQ ID NO: 7776 - RNA, 20 nt, Artificial Sequence
  targeting sequence with GTCN PAM
ggcccugucuccacaaccuc

SEQ ID NO: 7777 - RNA, 20 nt, Artificial Sequence
  targeting sequence with GTCN PAM
ccacaaccucacagccaccc

SEQ ID NO: 7778 - RNA, 20 nt, Artificial Sequence
  targeting sequence with GTCN PAM
aggguggcugugagguugug

SEQ ID NO: 7779 - RNA, 20 nt, Artificial Sequence
  targeting sequence with GTCN PAM
uccucagccccugagcuccu

SEQ ID NO: 7780 - RNA, 20 nt, Artificial Sequence
  targeting sequence with GTCN PAM
ggcaccagaaacggaagcug

SEQ ID NO: 7781 - RNA, 20 nt, Artificial Sequence
  targeting sequence with GTCN PAM
gaggaguguggggacuggau

SEQ ID NO: 7782 - RNA, 20 nt, Artificial Sequence
  targeting sequence with GTCN PAM
ccacacuccucugacaggag

SEQ ID NO: 7783 - RNA, 20 nt, Artificial Sequence
  targeting sequence with GTCN PAM
uccaguccccacacuccucu

SEQ ID NO: 7784 - RNA, 20 nt, Artificial Sequence
  targeting sequence with GTCN PAM
cacagccccuuaccuguucg

SEQ ID NO: 7785 - RNA, 20 nt, Artificial Sequence
  targeting sequence with GTCN PAM
cucaucucgucacacagccc

SEQ ID NO: 7786 - RNA, 20 nt, Artificial Sequence
  targeting sequence with GTCN PAM
cuagcuguccagaggacaua

SEQ ID NO: 7787 - RNA, 20 nt, Artificial Sequence
  targeting sequence with GTCN PAM
agaggacauagcacagaggc

SEQ ID NO: 7788 - RNA, 20 nt, Artificial Sequence
  targeting sequence with GTCN PAM
ucuggacagcuagagacuuu

SEQ ID NO: 7789 - RNA, 20 nt, Artificial Sequence
  targeting sequence with GTCN PAM
cuauuucaaacccaggccac

SEQ ID NO: 7790 - RNA, 20 nt, Artificial Sequence
  targeting sequence with GTCN PAM
gguggccuggguuugaaaua

SEQ ID NO: 7791 - RNA, 20 nt, Artificial Sequence
  targeting sequence with GTCN PAM
cagcucagucugguggccug

SEQ ID NO: 7792 - RNA, 20 nt, Artificial Sequence
  targeting sequence with GTCN PAM
caaggucccagcucagucug

SEQ ID NO: 7793 - RNA, 20 nt, Artificial Sequence
  targeting sequence with GTCN PAM
gucccaaggucccagcucag

SEQ ID NO: 7794 - RNA, 20 nt, Artificial Sequence
  targeting sequence with GTCN PAM
ugcagaaguuaggggaccuu

SEQ ID NO: 7795 - RNA, 20 nt, Artificial Sequence
  targeting sequence with GTCN PAM
ccuaacuucugcaugacuug

SEQ ID NO: 7796 - RNA, 20 nt, Artificial Sequence
  targeting sequence with GTCN PAM
gggaggagagguacucagga

SEQ ID NO: 7797 - RNA, 20 nt, Artificial Sequence
  targeting sequence with GTCN PAM
ccuuggccccucuuagaagc

SEQ ID NO: 7798 - RNA, 20 nt, Artificial Sequence
  targeting sequence with GTCN PAM
cuuuauaagggucugggggg

SEQ ID NO: 7799 - RNA, 20 nt, Artificial Sequence
  targeting sequence with GTCN PAM
gggggggucagaacccagag

SEQ ID NO: 7800 - RNA, 20 nt, Artificial Sequence
  targeting sequence with GTCN PAM
gaacccagagucauccagcu

SEQ ID NO: 7801 - RNA, 20 nt, Artificial Sequence
  targeting sequence with GTCN PAM
uccagcuggagcccugagug

SEQ ID NO: 7802 - RNA, 20 nt, Artificial Sequence
  targeting sequence with GTCN PAM
gccacaagggccacagccau

SEQ ID NO: 7803 - RNA, 20 nt, Artificial Sequence
  targeting sequence with GTCN PAM
cauuggagaagggcacguag

SEQ ID NO: 7804 - RNA, 20 nt, Artificial Sequence
  targeting sequence with GTCN PAM
ccguccagcacaagaagcug

SEQ ID NO: 7805 - RNA, 20 nt, Artificial Sequence
  targeting sequence with GTCN PAM
agcacaagaagcugcgcacg

SEQ ID NO: 7806 - RNA, 20 nt, Artificial Sequence
  targeting sequence with GTCN PAM
gccacggcuagguugagcag

SEQ ID NO: 7807 - RNA, 20 nt, Artificial Sequence
  targeting sequence with GTCN PAM
uagguggcuucaccagcacc

SEQ ID NO: 7808 - RNA, 20 nt, Artificial Sequence
  targeting sequence with GTCN PAM
ucgggcccacaggaugcaau

SEQ ID NO: 7809 - RNA, 20 nt, Artificial Sequence
  targeting sequence with GTCN PAM
gggagagucccgggcuuggc

SEQ ID NO: 7810 - RNA, 20 nt, Artificial Sequence
  targeting sequence with GTCN PAM
cgggcuuggcggugguggcu

SEQ ID NO: 7811 - RNA, 20 nt, Artificial Sequence
  targeting sequence with GTCN PAM
ugucaauguuauccaaagcc

SEQ ID NO: 7812 - RNA, 20 nt, Artificial Sequence
  targeting sequence with GTCN PAM
auguuauccaaagcccucau

SEQ ID NO: 7813 - RNA, 20 nt, Artificial Sequence
  targeting sequence with GTCN PAM
acaaacaccauucaugguga

SEQ ID NO: 7814 - RNA, 20 nt, Artificial Sequence
  targeting sequence with GTCN PAM
aauuucacagcaagaaaacu

SEQ ID NO: 7815 - RNA, 20 nt, Artificial Sequence
  targeting sequence with GTCN PAM
agcgcccugcuggggcguca

SEQ ID NO: 7816 - RNA, 20 nt, Artificial Sequence
  targeting sequence with GTCN PAM
cacagggacgggugcagagu

SEQ ID NO: 7817 - RNA, 20 nt, Artificial Sequence
  targeting sequence with GTCN PAM
cugugugacgccccagcagg

SEQ ID NO: 7818 - RNA, 20 nt, Artificial Sequence
  targeting sequence with GTCN PAM
gacccaggcugggcacugag

SEQ ID NO: 7819 - RNA, 20 nt, Artificial Sequence
  targeting sequence with GTCN PAM
gacucagcacagcugcucca

SEQ ID NO: 7820 - RNA, 20 nt, Artificial Sequence
  targeting sequence with GTCN PAM
ggcuugcccagcucucccuc

SEQ ID NO: 7821 - RNA, 20 nt, Artificial Sequence
  targeting sequence with GTCN PAM
uugggucuucccugugcugg

SEQ ID NO: 7822 - RNA, 20 nt, Artificial Sequence
  targeting sequence with GTCN PAM
ucccugugcugggcaauggg

SEQ ID NO: 7823 - RNA, 20 nt, Artificial Sequence
  targeting sequence with GTCN PAM
ccucuggcauccucugccuc

SEQ ID NO: 7824 - RNA, 20 nt, Artificial Sequence
  targeting sequence with GTCN PAM
ucaggugccccuccagccuc

SEQ ID NO: 7825 - RNA, 20 nt, Artificial Sequence
  targeting sequence with GTCN PAM
ccugguguugagaaccgcaa

SEQ ID NO: 7826 - RNA, 20 nt, Artificial Sequence
  targeting sequence with GTCN PAM
ugcauuuaacaggaaaacag

SEQ ID NO: 7827 - RNA, 20 nt, Artificial Sequence
  targeting sequence with GTCN PAM
cuuccccucucccugccuca

SEQ ID NO: 7828 - RNA, 20 nt, Artificial Sequence
  targeting sequence with GTCN PAM
ccuggcugugauccaggaau

SEQ ID NO: 7829 - RNA, 20 nt, Artificial Sequence
  targeting sequence with GTCN PAM
ccuccugcaucucagcagag

SEQ ID NO: 7830 - RNA, 20 nt, Artificial Sequence
  targeting sequence with GTCN PAM
cccagcuuugcaauggcugc

SEQ ID NO: 7831 - RNA, 20 nt, Artificial Sequence
  targeting sequence with GTCN PAM
cucugccagccuugcccugu

SEQ ID NO: 7832 - RNA, 20 nt, Artificial Sequence
  targeting sequence with GTCN PAM
cccccauguccaggcugcug

SEQ ID NO: 7833 - RNA, 20 nt, Artificial Sequence
  targeting sequence with GTCN PAM
aggcugcugccucgguccca

SEQ ID NO: 7834 - RNA, 20 nt, Artificial Sequence
  targeting sequence with GTCN PAM
cauucucagggaaucucugg

SEQ ID NO: 7835 - RNA, 20 nt, Artificial Sequence
  targeting sequence with GTCN PAM
gucccaguuuacaaauauug

SEQ ID NO: 7836 - RNA, 20 nt, Artificial Sequence
  targeting sequence with GTCN PAM
caguuuacaaauauuguccc

SEQ ID NO: 7837 - RNA, 20 nt, Artificial Sequence
  targeting sequence with GTCN PAM
cuuucacuguuaggaauguc

SEQ ID NO: 7838 - RNA, 20 nt, Artificial Sequence
  targeting sequence with GTCN PAM
caguuugguugauuaacuau

SEQ ID NO: 7839 - RNA, 20 nt, Artificial Sequence
  targeting sequence with GTCN PAM
ugcucaccaccccaugaagu

SEQ ID NO: 7840 - RNA, 20 nt, Artificial Sequence
  targeting sequence with GTCN PAM
gaauuccaucauuuccuucu

SEQ ID NO: 7841 - RNA, 20 nt, Artificial Sequence
  targeting sequence with GTCN PAM
ggguuauuucauuucccgag

SEQ ID NO: 7842 - RNA, 20 nt, Artificial Sequence
  targeting sequence with GTCN PAM
uuccucccucucccuucucg

SEQ ID NO: 7843 - RNA, 20 nt, Artificial Sequence
  targeting sequence with GTCN PAM
ggauugaacugggaacccgg

SEQ ID NO: 7844 - RNA, 20 nt, Artificial Sequence
  targeting sequence with GTCN PAM
cuuaugggcccagagcgcua

SEQ ID NO: 7845 - RNA, 20 nt, Artificial Sequence
  targeting sequence with GTCN PAM
cucugccccuucccccuccu

SEQ ID NO: 7846 - RNA, 20 nt, Artificial Sequence
  targeting sequence with GTCN PAM
aggggggagugcacccuccu

SEQ ID NO: 7847 - RNA, 20 nt, Artificial Sequence
  targeting sequence with GTCN PAM
gugcugaccgccugcugacu

SEQ ID NO: 7848 - RNA, 20 nt, Artificial Sequence
  targeting sequence with GTCN PAM
gcacagaccccacugccuaa

SEQ ID NO: 7849 - RNA, 20 nt, Artificial Sequence
  targeting sequence with GTCN PAM
gcaggcggucagcacagacc

SEQ ID NO: 7850 - RNA, 20 nt, Artificial Sequence
  targeting sequence with GTCN PAM
uuggugguccuggccaucga

SEQ ID NO: 7851 - RNA, 20 nt, Artificial Sequence
  targeting sequence with GTCN PAM
uggccaucgagcgguacgug

SEQ ID NO: 7852 - RNA, 20 nt, Artificial Sequence
  targeting sequence with GTCN PAM
uggcgcuggccugcgccgca

SEQ ID NO: 7853 - RNA, 20 nt, Artificial Sequence
  targeting sequence with GTCN PAM
agguaauggcacugagcaga

SEQ ID NO: 7854 - RNA, 20 nt, Artificial Sequence
  targeting sequence with GTCN PAM
uccagucaggacucaaaccc

SEQ ID NO: 7855 - RNA, 20 nt, Artificial Sequence
  targeting sequence with GTCN PAM
ggacucaaacccaguagugu

SEQ ID NO: 7856 - RNA, 20 nt, Artificial Sequence
  targeting sequence with GTCN PAM
ugacuggaggacccuacaaa

SEQ ID NO: 7857 - RNA, 20 nt, Artificial Sequence
  targeting sequence with GTCN PAM
gguuccaggcacugaccuug

SEQ ID NO: 7858 - RNA, 20 nt, Artificial Sequence
  targeting sequence with GTCN PAM
gugccuggaaccagacacua

SEQ ID NO: 7859 - RNA, 20 nt, Artificial Sequence
  targeting sequence with GTCN PAM
ccuggcccaaaugcccacuc

SEQ ID NO: 7860 - RNA, 20 nt, Artificial Sequence
  targeting sequence with GTCN PAM
guuucuucuucugcccuaca

SEQ ID NO: 7861 - RNA, 20 nt, Artificial Sequence
  targeting sequence with GTCN PAM
caucuccugagccccauguc

SEQ ID NO: 7862 - RNA, 20 nt, Artificial Sequence
  targeting sequence with GTCN PAM
aacagaauccaagacauccc

SEQ ID NO: 7863 - RNA, 20 nt, Artificial Sequence
  targeting sequence with GTCN PAM
uggauucuguuugacauggg

SEQ ID NO: 7864 - RNA, 20 nt, Artificial Sequence
  targeting sequence with GTCN PAM
aguaccccgggggcagcccc

SEQ ID NO: 7865 - RNA, 20 nt, Artificial Sequence
  targeting sequence with GTCN PAM
cacucagccucuaggcgauu

SEQ ID NO: 7866 - RNA, 20 nt, Artificial Sequence
  targeting sequence with GTCN PAM
ccuaauggggcugagaugag

SEQ ID NO: 7867 - RNA, 20 nt, Artificial Sequence
  targeting sequence with GTCN PAM
caucucagccccauuaggag

SEQ ID NO: 7868 - RNA, 20 nt, Artificial Sequence
  targeting sequence with GTCN PAM
ccacugugucucaucucagc

SEQ ID NO: 7869 - RNA, 20 nt, Artificial Sequence
  targeting sequence with GTCN PAM
aaaccacuguccccacugug

SEQ ID NO: 7870 - RNA, 20 nt, Artificial Sequence
  targeting sequence with GTCN PAM
uauuguccaaaccacugucc

SEQ ID NO: 7871 - RNA, 20 nt, Artificial Sequence
  targeting sequence with GTCN PAM
ccaguccuauuguccaaacc

SEQ ID NO: 7872 - RNA, 20 nt, Artificial Sequence
  targeting sequence with GTCN PAM
ccagaggccucaugucccuc

SEQ ID NO: 7873 - RNA, 20 nt, Artificial Sequence
  targeting sequence with GTCN PAM
cucugucuccagaaaauucc

SEQ ID NO: 7874 - RNA, 20 nt, Artificial Sequence
  targeting sequence with GTCN PAM
ccagaaaauucccacucuca

SEQ ID NO: 7875 - RNA, 20 nt, Artificial Sequence
  targeting sequence with GTCN PAM
ugcuaggguccauuucuuac

SEQ ID NO: 7876 - RNA, 20 nt, Artificial Sequence
  targeting sequence with GTCN PAM
auuucuuaccccuugcugaa

SEQ ID NO: 7877 - RNA, 20 nt, Artificial Sequence
  targeting sequence with GTCN PAM
agggggugggcucaaauuca

SEQ ID NO: 7878 - RNA, 20 nt, Artificial Sequence
  targeting sequence with GTCN PAM
agcggcucugcuuccagagg

SEQ ID NO: 7879 - RNA, 20 nt, Artificial Sequence
  targeting sequence with GTCN PAM
acugucaccaauaucaggaa

SEQ ID NO: 7880 - RNA, 20 nt, Artificial Sequence
  targeting sequence with GTCN PAM
ccaauaucaggaaccauugc

SEQ ID NO: 7881 - RNA, 20 nt, Artificial Sequence
  targeting sequence with GTCN PAM
uaaugacgugcgcuggaagc

SEQ ID NO: 7882 - RNA, 20 nt, Artificial Sequence
  targeting sequence with GTCN PAM
uuaggacguggcaaugguuc

SEQ ID NO: 7883 - RNA, 20 nt, Artificial Sequence
  targeting sequence with GTCN PAM
aucuuuggccuggaaaauac

SEQ ID NO: 7884 - RNA, 20 nt, Artificial Sequence
  targeting sequence with GTCN PAM
uccuagccccagggugagag

SEQ ID NO: 7885 - RNA, 20 nt, Artificial Sequence
  targeting sequence with GTCN PAM
ucugguaacgcagccaccaa

SEQ ID NO: 7886 - RNA, 20 nt, Artificial Sequence
  targeting sequence with GTCN PAM
cuucauuguuugguggcugc

SEQ ID NO: 7887 - RNA, 20 nt, Artificial Sequence
  targeting sequence with GTCN PAM
cccagccaugcagacguuua

SEQ ID NO: 7888 - RNA, 20 nt, Artificial Sequence
  targeting sequence with GTCN PAM
gcauggcugggugacaggau

SEQ ID NO: 7889 - RNA, 20 nt, Artificial Sequence
  targeting sequence with GTCN PAM
cucacaggcagggucucccu

SEQ ID NO: 7890 - RNA, 20 nt, Artificial Sequence
  targeting sequence with GTCN PAM
cccuaccugccuguccucag

SEQ ID NO: 7891 - RNA, 20 nt, Artificial Sequence
  targeting sequence with GTCN PAM
ucagguacauccccgagggc

SEQ ID NO: 7892 - RNA, 20 nt, Artificial Sequence
  targeting sequence with GTCN PAM
auuccacacgagcacugcag

SEQ ID NO: 7893 - RNA, 20 nt, Artificial Sequence
  targeting sequence with GTCN PAM
acaacgagucuuuugucauc

SEQ ID NO: 7894 - RNA, 20 nt, Artificial Sequence
  targeting sequence with GTCN PAM
uuugucaucuacauguucgu

SEQ ID NO: 7895 - RNA, 20 nt, Artificial Sequence
  targeting sequence with GTCN PAM
ucuacauguucgugguccac

SEQ ID NO: 7896 - RNA, 20 nt, Artificial Sequence
  targeting sequence with GTCN PAM
acuucaccauccccaugauu

SEQ ID NO: 7897 - RNA, 20 nt, Artificial Sequence
  targeting sequence with GTCN PAM
ucaccgucaaggagguacgg

SEQ ID NO: 7898 - RNA, 20 nt, Artificial Sequence
  targeting sequence with GTCN PAM
aggagguacgggccgggggg

SEQ ID NO: 7899 - RNA, 20 nt, Artificial Sequence
  targeting sequence with GTCN PAM
agcccccagcaugcaucugc

SEQ ID NO: 7900 - RNA, 20 nt, Artificial Sequence
  targeting sequence with GTCN PAM
ggacccgggucccguguccu

SEQ ID NO: 7901 - RNA, 20 nt, Artificial Sequence
  targeting sequence with GTCN PAM
agaccauggcuccuccaggg

SEQ ID NO: 7902 - RNA, 20 nt, Artificial Sequence
  targeting sequence with GTCN PAM
cguguccugcaggccgcugc

SEQ ID NO: 7903 - RNA, 20 nt, Artificial Sequence
  targeting sequence with GTCN PAM
ugcaggccgcugcccagcag

SEQ ID NO: 7904 - RNA, 20 nt, Artificial Sequence
  targeting sequence with GTCN PAM
gccaccacacagaaggcaga

SEQ ID NO: 7905 - RNA, 20 nt, Artificial Sequence
  targeting sequence with GTCN PAM
cccgcauggucaucaucaug

SEQ ID NO: 7906 - RNA, 20 nt, Artificial Sequence
  targeting sequence with GTCN PAM
ucaucauggucaucgcuuuc

SEQ ID NO: 7907 - RNA, 20 nt, Artificial Sequence
  targeting sequence with GTCN PAM
ucgcuuuccugaucugcugg

SEQ ID NO: 7908 - RNA, 20 nt, Artificial Sequence
  targeting sequence with GTCN PAM
caucuucaugaccaucccag

SEQ ID NO: 7909 - RNA, 20 nt, Artificial Sequence
  targeting sequence with GTCN PAM
ugaagaugggaccgaaguug

SEQ ID NO: 7910 - RNA, 20 nt, Artificial Sequence
  targeting sequence with GTCN PAM
ucuauaucaugaugaacaag

SEQ ID NO: 7911 - RNA, 20 nt, Artificial Sequence
  targeting sequence with GTCN PAM
uuggcaggcagcgccugugg

SEQ ID NO: 7912 - RNA, 20 nt, Artificial Sequence
  targeting sequence with GTCN PAM
ugggucagcagucccaaugg

SEQ ID NO: 7913 - RNA, 20 nt, Artificial Sequence
  targeting sequence with GTCN PAM
gcagucccaauggggagugu

SEQ ID NO: 7914 - RNA, 20 nt, Artificial Sequence
  targeting sequence with GTCN PAM
caauggggagugugugagaa

SEQ ID NO: 7915 - RNA, 20 nt, Artificial Sequence
  targeting sequence with GTCN PAM
gcuaguucuggaagcccaau

SEQ ID NO: 7916 - RNA, 20 nt, Artificial Sequence
  targeting sequence with GTCN PAM
aagucagaaggacccaaguc

SEQ ID NO: 7917 - RNA, 20 nt, Artificial Sequence
  targeting sequence with GTCN PAM
gaaggacccaagucgggaau

SEQ ID NO: 7918 - RNA, 20 nt, Artificial Sequence
  targeting sequence with GTCN PAM
uucugacuuugacauugggc

SEQ ID NO: 7919 - RNA, 20 nt, Artificial Sequence
  targeting sequence with GTCN PAM
ggaaugggaugggccagucu

SEQ ID NO: 7920 - RNA, 20 nt, Artificial Sequence
  targeting sequence with GTCN PAM
ccauaaagcugaauaaggag

SEQ ID NO: 7921 - RNA, 20 nt, Artificial Sequence
  targeting sequence with GTCN PAM
uauucugagggguaaagggg

SEQ ID NO: 7922 - RNA, 20 nt, Artificial Sequence
  targeting sequence with GTCN PAM
cugaagucagcucugccauu

SEQ ID NO: 7923 - RNA, 20 nt, Artificial Sequence
  targeting sequence with GTCN PAM
gcucugccauuuucuagcug

SEQ ID NO: 7924 - RNA, 20 nt, Artificial Sequence
  targeting sequence with GTCN PAM
auuuccuucucugugcuuug

SEQ ID NO: 7925 - RNA, 20 nt, Artificial Sequence
  targeting sequence with GTCN PAM
cgggugacacagcccccuug

SEQ ID NO: 7926 - RNA, 20 nt, Artificial Sequence
  targeting sequence with GTCN PAM
cccgugacauuucauggugc

SEQ ID NO: 7927 - RNA, 20 nt, Artificial Sequence
  targeting sequence with GTCN PAM
cuggcaucucuaggggugag

SEQ ID NO: 7928 - RNA, 20 nt, Artificial Sequence
  targeting sequence with GTCN PAM
gccuagcagguucccuccag

SEQ ID NO: 7929 - RNA, 20 nt, Artificial Sequence
  targeting sequence with GTCN PAM
gggcgaaccucacuaacgug

SEQ ID NO: 7930 - RNA, 20 nt, Artificial Sequence
  targeting sequence with GTCN PAM
gggccagggcugcccacagu

SEQ ID NO: 7931 - RNA, 20 nt, Artificial Sequence
  targeting sequence with GTCN PAM
cccaguggguucuugccgca

SEQ ID NO: 7932 - RNA, 20 nt, Artificial Sequence
  targeting sequence with GTCN PAM
aagacggagacgagccaggu

SEQ ID NO: 7933 - RNA, 20 nt, Artificial Sequence
  targeting sequence with GTCN PAM
uggacacgguagcagaggcc

SEQ ID NO: 7934 - RNA, 20 nt, Artificial Sequence
  targeting sequence with GTCN PAM
ccgucuuggacacgguagca

SEQ ID NO: 7935 - RNA, 20 nt, Artificial Sequence
  targeting sequence with GTCN PAM
uaggccggggccaccuggcu

SEQ ID NO: 7936 - RNA, 20 nt, Artificial Sequence
  targeting sequence with GTCN PAM
uaggcaggucuuaggccggg

SEQ ID NO: 7937 - RNA, 20 nt, Artificial Sequence
  targeting sequence with GTCN PAM
gccacagaguccuaggcagg

SEQ ID NO: 7938 - RNA, 20 nt, Artificial Sequence
  targeting sequence with GTCN PAM
cccauccccuacaccuuccc

SEQ ID NO: 7939 - RNA, 20 nt, Artificial Sequence
  targeting sequence with GTCN PAM
cauaggcuccuuaauuuuuu

SEQ ID NO: 7940 - RNA, 20 nt, Artificial Sequence
  targeting sequence with GTCN PAM
caggugagugaggagccuca

SEQ ID NO: 7941 - RNA, 20 nt, Artificial Sequence
  targeting sequence with GTCN PAM
cuucucaggcugucccaggu

SEQ ID NO: 7942 - RNA, 20 nt, Artificial Sequence
  targeting sequence with GTCN PAM
ugguggaugucccuucucag

SEQ ID NO: 7943 - RNA, 20 nt, Artificial Sequence
  targeting sequence with GTCN PAM
cacguuccccaaggccagcg

SEQ ID NO: 7944 - RNA, 20 nt, Artificial Sequence
  targeting sequence with GTCN PAM
cagcuuagggauaagugucu

SEQ ID NO: 7945 - RNA, 20 nt, Artificial Sequence
  targeting sequence with GTCN PAM
agcacagaauggggcacaca

SEQ ID NO: 7946 - RNA, 20 nt, Artificial Sequence
  targeting sequence with GTCN PAM
gagaggauagauauguucuc

SEQ ID NO: 7947 - RNA, 20 nt, Artificial Sequence
  targeting sequence with GTCN PAM
ugccgacacgcagcuacuga

SEQ ID NO: 7948 - RNA, 20 nt, Artificial Sequence
  targeting sequence with GTCN PAM
gcaggaccagggaucuggga

SEQ ID NO: 7949 - RNA, 20 nt, Artificial Sequence
  targeting sequence with GTCN PAM
ucucaguagcugcgugucgg

SEQ ID NO: 7950 - RNA, 20 nt, Artificial Sequence
  targeting sequence with GTCN PAM
auguguguguuucagcacuu

SEQ ID NO: 7951 - RNA, 20 nt, Artificial Sequence
  targeting sequence with GTCN PAM
ggccuugaugccuagcuaau

SEQ ID NO: 7952 - RNA, 20 nt, Artificial Sequence
  targeting sequence with GTCN PAM
cugccuacagcccaaccccc

SEQ ID NO: 7953 - RNA, 20 nt, Artificial Sequence
  targeting sequence with GTCN PAM
caggaaugcagaaugcaguc

SEQ ID NO: 7954 - RNA, 20 nt, Artificial Sequence
  targeting sequence with GTCN PAM
ucagaccugaaaaaacaaca

SEQ ID NO: 7955 - RNA, 20 nt, Artificial Sequence
  targeting sequence with GTCN PAM
gaugacugcauucugcauuc

SEQ ID NO: 7956 - RNA, 20 nt, Artificial Sequence
  targeting sequence with GTCN PAM
cccucccccaguguuguuuu

SEQ ID NO: 7957 - RNA, 20 nt, Artificial Sequence
  targeting sequence with GTCN PAM
caccccuaguguggggcccc

SEQ ID NO: 7958 - RNA, 20 nt, Artificial Sequence
  targeting sequence with GTCN PAM
cgugccuccccuucccaaug

SEQ ID NO: 7959 - RNA, 20 nt, Artificial Sequence
  targeting sequence with GTCN PAM
cuccauaggccacauuggga

SEQ ID NO: 7960 - RNA, 20 nt, Artificial Sequence
  targeting sequence with GTCN PAM
cagcaucuagagcauggagc

SEQ ID NO: 7961 - RNA, 20 nt, Artificial Sequence
  targeting sequence with GTCN PAM
cugaugucauccuuaucucg

SEQ ID NO: 7962 - RNA, 20 nt, Artificial Sequence
  targeting sequence with GTCN PAM
uccuuaucucgaagagcuua

SEQ ID NO: 7963 - RNA, 20 nt, Artificial Sequence
  targeting sequence with GTCN PAM
ggcaagggaaacuggaaacu

SEQ ID NO: 7964 - RNA, 20 nt, Artificial Sequence
  targeting sequence with GTCN PAM
auucuccauucuggagaauc

SEQ ID NO: 7965 - RNA, 20 nt, Artificial Sequence
  targeting sequence with GTCN PAM
gaauuaagcugccucaguaa

SEQ ID NO: 7966 - RNA, 20 nt, Artificial Sequence
  targeting sequence with GTCN PAM
ccaggcagagcuggguaaag

SEQ ID NO: 7967 - RNA, 20 nt, Artificial Sequence
  targeting sequence with GTCN PAM
gggaucagguggaagcuggc

SEQ ID NO: 7968 - RNA, 20 nt, Artificial Sequence
  targeting sequence with GTCN PAM
ccuggggcuagagguggagg

SEQ ID NO: 7969 - RNA, 20 nt, Artificial Sequence
  targeting sequence with GTCN PAM
ugggaaugggaaaaacccca

SEQ ID NO: 7970 - RNA, 20 nt, Artificial Sequence
  targeting sequence with GTCN PAM
uagaggcacagguaacccau

SEQ ID NO: 7971 - RNA, 20 nt, Artificial Sequence
  targeting sequence with GTCN PAM
ccucucagagcuuccuuauc

SEQ ID NO: 7972 - RNA, 20 nt, Artificial Sequence
  targeting sequence with GTCN PAM
guuuuaagauucuuuuuugc

SEQ ID NO: 7973 - RNA, 20 nt, Artificial Sequence
  targeting sequence with GTCN PAM
ggaguuugagaccagccuga

SEQ ID NO: 7974 - RNA, 20 nt, Artificial Sequence
  targeting sequence with GTCN PAM
caaacuccugaccucgugau

SEQ ID NO: 7975 - RNA, 20 nt, Artificial Sequence
  targeting sequence with GTCN PAM
ggcuggucucaaacuccuga

SEQ ID NO: 7976 - RNA, 20 nt, Artificial Sequence
  targeting sequence with GTCN PAM
cuacuaaaaauacaaaaauc

SEQ ID NO: 7977 - RNA, 20 nt, Artificial Sequence
  targeting sequence with GTCN PAM
cucuguugcucaggcuggag

SEQ ID NO: 7978 - RNA, 20 nt, Artificial Sequence
  targeting sequence with GTCN PAM
gucuccaaacaaaacaaaac

SEQ ID NO: 7979 - RNA, 20 nt, Artificial Sequence
  targeting sequence with GTCN PAM
ccaaacaaaacaaaacaaac

SEQ ID NO: 7980 - RNA, 20 nt, Artificial Sequence
  targeting sequence with GTCN PAM
caucuaauccccuuaggauc

SEQ ID NO: 7981 - RNA, 20 nt, Artificial Sequence
  targeting sequence with GTCN PAM
acagucgcaucuaauccccu

SEQ ID NO: 7982 - RNA, 20 nt, Artificial Sequence
  targeting sequence with GTCN PAM
caucugcugcaugccaggca

SEQ ID NO: 7983 - RNA, 20 nt, Artificial Sequence
  targeting sequence with GTCN PAM
cuaguaaggccagcucugag

SEQ ID NO: 7984 - RNA, 20 nt, Artificial Sequence
  targeting sequence with GTCN PAM
caaaggggaaaaggauggag

SEQ ID NO: 7985 - RNA, 20 nt, Artificial Sequence
  targeting sequence with GTCN PAM
cccccuccuccgaggugaga

SEQ ID NO: 7986 - RNA, 20 nt, Artificial Sequence
  targeting sequence with GTCN PAM
cucuuuacugugacucacua

SEQ ID NO: 7987 - RNA, 20 nt, Artificial Sequence
  targeting sequence with GTCN PAM
caguaaagagggacaaugau

SEQ ID NO: 7988 - RNA, 20 nt, Artificial Sequence
  targeting sequence with GTCN PAM
ggauacuuuuggucacaagu

SEQ ID NO: 7989 - RNA, 20 nt, Artificial Sequence
  targeting sequence with GTCN PAM
caagugauaggaaauccaac

SEQ ID NO: 7990 - RNA, 20 nt, Artificial Sequence
  targeting sequence with GTCN PAM
cuuuugcuucagcccaaaug

SEQ ID NO: 7991 - RNA, 20 nt, Artificial Sequence
  targeting sequence with GTCN PAM
uggugauacccugugccuga

SEQ ID NO: 7992 - RNA, 20 nt, Artificial Sequence
  targeting sequence with GTCN PAM
aggucaccugaucauacgua

SEQ ID NO: 7993 - RNA, 20 nt, Artificial Sequence
  targeting sequence with GTCN PAM
ccugaucauacguaacucau

SEQ ID NO: 7994 - RNA, 20 nt, Artificial Sequence
  targeting sequence with GTCN PAM
gauugcaaaaauccaaaaaa

SEQ ID NO: 7995 - RNA, 20 nt, Artificial Sequence
  targeting sequence with GTCN PAM
ucgccaaggucugauugcaa

SEQ ID NO: 7996 - RNA, 20 nt, Artificial Sequence
  targeting sequence with GTCN PAM
aacugcaucaccauggcugg

SEQ ID NO: 7997 - RNA, 20 nt, Artificial Sequence
  targeting sequence with GTCN PAM
gaccuaggucacaugcucac

SEQ ID NO: 7998 - RNA, 20 nt, Artificial Sequence
  targeting sequence with GTCN PAM
gaccaaucagaggaugaauc

SEQ ID NO: 7999 - RNA, 20 nt, Artificial Sequence
  targeting sequence with GTCN PAM
caugcucacccugcagccca

SEQ ID NO: 8000 - RNA, 20 nt, Artificial Sequence
  targeting sequence with GTCN PAM
agccacgugcccagaaaaca

SEQ ID NO: 8001 - RNA, 20 nt, Artificial Sequence
  targeting sequence with GTCN PAM
cugagaugaugagggaggga

SEQ ID NO: 8002 - RNA, 20 nt, Artificial Sequence
  targeting sequence with GTCN PAM
cgaaggucucacccuuuguu

SEQ ID NO: 8003 - RNA, 20 nt, Artificial Sequence
  targeting sequence with GTCN PAM
cacccuuuguuuuggaugcu

SEQ ID NO: 8004 - RNA, 20 nt, Artificial Sequence
  targeting sequence with GTCN PAM
cacccacugccacccuggcc

SEQ ID NO: 8005 - RNA, 20 nt, Artificial Sequence
  targeting sequence with GTCN PAM
gggcagcuaagaugccacug

SEQ ID NO: 8006 - RNA, 20 nt, Artificial Sequence
  targeting sequence with GTCN PAM
agaggaaaauuuuacucuaa

SEQ ID NO: 8007 - RNA, 20 nt, Artificial Sequence
  targeting sequence with GTCN PAM
ugauagacaagaaagccucc

SEQ ID NO: 8008 - RNA, 20 nt, Artificial Sequence
  targeting sequence with GTCN PAM
aucaggacaaaccagagaau

SEQ ID NO: 8009 - RNA, 20 nt, Artificial Sequence
  targeting sequence with GTCN PAM
uuuguaaauuaaggaggugg

SEQ ID NO: 8010 - RNA, 20 nt, Artificial Sequence
  targeting sequence with GTCN PAM
agucauuuguaaauuaagga

SEQ ID NO: 8011 - RNA, 20 nt, Artificial Sequence
  targeting sequence with GTCN PAM
gcuugcucagguuugguuga

SEQ ID NO: 8012 - RNA, 20 nt, Artificial Sequence
  targeting sequence with GTCN PAM
ccagugcauucuggcauggg

SEQ ID NO: 8013 - RNA, 20 nt, Artificial Sequence
  targeting sequence with GTCN PAM
cuaggcuccaauucaucucc

SEQ ID NO: 8014 - RNA, 20 nt, Artificial Sequence
  targeting sequence with GTCN PAM
cuaggcuaugaccugggcug

SEQ ID NO: 8015 - RNA, 20 nt, Artificial Sequence
  targeting sequence with GTCN PAM
uagccuagagacuuggucuc

SEQ ID NO: 8016 - RNA, 20 nt, Artificial Sequence
  targeting sequence with GTCN PAM
cgccaagggagagaugcacc

SEQ ID NO: 8017 - RNA, 20 nt, Artificial Sequence
  targeting sequence with GTCN PAM
cacuuugucacccagacugg

SEQ ID NO: 8018 - RNA, 20 nt, Artificial Sequence
  targeting sequence with GTCN PAM
cccagacuggaguacagugg

SEQ ID NO: 8019 - RNA, 20 nt, Artificial Sequence
  targeting sequence with GTCN PAM
gggugacaaagugagacccc

SEQ ID NO: 8020 - RNA, 20 nt, Artificial Sequence
  targeting sequence with GTCN PAM
aggcuacagugagcuaugag

SEQ ID NO: 8021 - RNA, 20 nt, Artificial Sequence
  targeting sequence with GTCN PAM
cagccucucaaguagccagg

SEQ ID NO: 8022 - RNA, 20 nt, Artificial Sequence
  targeting sequence with GTCN PAM
uggcuacuugagaggcugag

SEQ ID NO: 8023 - RNA, 20 nt, Artificial Sequence
  targeting sequence with GTCN PAM
cccuauguugcccaggcugg

SEQ ID NO: 8024 - RNA, 20 nt, Artificial Sequence
  targeting sequence with GTCN PAM
cagcacuuugagaggccaag

SEQ ID NO: 8025 - RNA, 20 nt, Artificial Sequence
  targeting sequence with GTCN PAM
uugaauuacuccaagacuca

SEQ ID NO: 8026 - RNA, 20 nt, Artificial Sequence
  targeting sequence with GTCN PAM
uggaguaauucaaggacuug

SEQ ID NO: 8027 - RNA, 20 nt, Artificial Sequence
  targeting sequence with GTCN PAM
auagggacuaauaagauuaa

SEQ ID NO: 8028 - RNA, 20 nt, Artificial Sequence
  targeting sequence with GTCN PAM
cuauagacaauucuaccaag

SEQ ID NO: 8029 - RNA, 20 nt, Artificial Sequence
  targeting sequence with GTCN PAM
acugugcacagcacccuuua

SEQ ID NO: 8030 - RNA, 20 nt, Artificial Sequence
  targeting sequence with GTCN PAM
cugggaagggaauucacauu

SEQ ID NO: 8031 - RNA, 20 nt, Artificial Sequence
  targeting sequence with GTCN PAM
auuucccaccacacaagcgg

SEQ ID NO: 8032 - RNA, 20 nt, Artificial Sequence
  targeting sequence with GTCN PAM
ugcaaaaguggggaagcaag

SEQ ID NO: 8033 - RNA, 20 nt, Artificial Sequence
  targeting sequence with GTCN PAM
uguguugagcaaccaggugc

SEQ ID NO: 8034 - RNA, 20 nt, Artificial Sequence
  targeting sequence with GTCN PAM
agucauuguaggguacucag

SEQ ID NO: 8035 - RNA, 20 nt, Artificial Sequence
  targeting sequence with GTCN PAM
uuguaggguacucagaaaug

SEQ ID NO: 8036 - RNA, 20 nt, Artificial Sequence
  targeting sequence with GTCN PAM
cuagguugugcauuuuggag

SEQ ID NO: 8037 - RNA, 20 nt, Artificial Sequence
  targeting sequence with GTCN PAM
ugaugacuggagcuuccgca

SEQ ID NO: 8038 - RNA, 20 nt, Artificial Sequence
  targeting sequence with GTCN PAM
ucaugacugcuuuccagcca

SEQ ID NO: 8039 - RNA, 20 nt, Artificial Sequence
  targeting sequence with GTCN PAM
ucagauucuaucucaugauc

SEQ ID NO: 8040 - RNA, 20 nt, Artificial Sequence
  targeting sequence with GTCN PAM
caccaugguucccccaugcu

SEQ ID NO: 8041 - RNA, 20 nt, Artificial Sequence
  targeting sequence with GTCN PAM
cuugugauuuuggaguuaua

SEQ ID NO: 8042 - RNA, 20 nt, Artificial Sequence
  targeting sequence with GTCN PAM
cagaaaagaaagaaggaaag

SEQ ID NO: 8043 - RNA, 20 nt, Artificial Sequence
  targeting sequence with GTCN PAM
ugcucuauugcccaggcugg

SEQ ID NO: 8044 - RNA, 20 nt, Artificial Sequence
  targeting sequence with GTCN PAM
cuacuaaaaauacaaaaaau

SEQ ID NO: 8045 - RNA, 20 nt, Artificial Sequence
  targeting sequence with GTCN PAM
ucucugaacuucagcuucuc

SEQ ID NO: 8046 - RNA, 20 nt, Artificial Sequence
  targeting sequence with GTCN PAM
aauguggcagccauuacuau

SEQ ID NO: 8047 - RNA, 20 nt, Artificial Sequence
  targeting sequence with GTCN PAM
auaaauauauaaagggcggg

SEQ ID NO: 8048 - RNA, 20 nt, Artificial Sequence
  targeting sequence with GTCN PAM
ggaaagaaaagucacaaaug

SEQ ID NO: 8049 - RNA, 20 nt, Artificial Sequence
  targeting sequence with GTCN PAM
caaauguccugauguuacag

SEQ ID NO: 8050 - RNA, 20 nt, Artificial Sequence
  targeting sequence with GTCN PAM
ugauguuacaggggcuggag

SEQ ID NO: 8051 - RNA, 20 nt, Artificial Sequence
  targeting sequence with GTCN PAM
gcuuuguguaacuccagccc

SEQ ID NO: 8052 - RNA, 20 nt, Artificial Sequence
  targeting sequence with GTCN PAM
gccuacaugugaacugcccu

SEQ ID NO: 8053 - RNA, 20 nt, Artificial Sequence
  targeting sequence with GTCN PAM
cugcagucugaugcucagaa

SEQ ID NO: 8054 - RNA, 20 nt, Artificial Sequence
  targeting sequence with GTCN PAM
gaugcucagaauuaccauuu

SEQ ID NO: 8055 - RNA, 20 nt, Artificial Sequence
  targeting sequence with GTCN PAM
cauaaaugugaucaaaauug

SEQ ID NO: 8056 - RNA, 20 nt, Artificial Sequence
  targeting sequence with GTCN PAM
ucugcuccagcauagucccg

SEQ ID NO: 8057 - RNA, 20 nt, Artificial Sequence
  targeting sequence with GTCN PAM
cggaagaggguuuucaggcc

SEQ ID NO: 8058 - RNA, 20 nt, Artificial Sequence
  targeting sequence with GTCN PAM
cagugcuggaggccugaaaa

SEQ ID NO: 8059 - RNA, 20 nt, Artificial Sequence
  targeting sequence with GTCN PAM
gugcucaguacccauuacug

SEQ ID NO: 8060 - RNA, 20 nt, Artificial Sequence
  targeting sequence with GTCN PAM
uguuccuggugguaucccug

SEQ ID NO: 8061 - RNA, 20 nt, Artificial Sequence
  targeting sequence with GTCN PAM
ccagccuuugcgcucugguu

SEQ ID NO: 8062 - RNA, 20 nt, Artificial Sequence
  targeting sequence with GTCN PAM
agagaagggggggcagugca

SEQ ID NO: 8063 - RNA, 20 nt, Artificial Sequence
  targeting sequence with GTCN PAM
auugauacacuuggccuuag

SEQ ID NO: 8064 - RNA, 20 nt, Artificial Sequence
  targeting sequence with GTCN PAM
ugccguacaagucaauugau

SEQ ID NO: 8065 - RNA, 20 nt, Artificial Sequence
  targeting sequence with GTCN PAM
gucuugccguacaagucaau

SEQ ID NO: 8066 - RNA, 20 nt, Artificial Sequence
  targeting sequence with GTCN PAM
ugaaugauaugcagcuuguu

SEQ ID NO: 8067 - RNA, 20 nt, Artificial Sequence
  targeting sequence with GTCN PAM
auuucggcuggguucauuca

SEQ ID NO: 8068 - RNA, 20 nt, Artificial Sequence
  targeting sequence with GTCN PAM
acuggaggguuggcugggga

SEQ ID NO: 8069 - RNA, 20 nt, Artificial Sequence
  targeting sequence with GTCN PAM
ccagccaacccuccaguuga

SEQ ID NO: 8070 - RNA, 20 nt, Artificial Sequence
  targeting sequence with GTCN PAM
accagccaguccccagccaa

SEQ ID NO: 8071 - RNA, 20 nt, Artificial Sequence
  targeting sequence with GTCN PAM
cauugccauguuaacuagcu

SEQ ID NO: 8072 - RNA, 20 nt, Artificial Sequence
  targeting sequence with GTCN PAM
aagcaagucauaagauuuaa

SEQ ID NO: 8073 - RNA, 20 nt, Artificial Sequence
  targeting sequence with GTCN PAM
uaagauuuaaggaauccacu

SEQ ID NO: 8074 - RNA, 20 nt, Artificial Sequence
  targeting sequence with GTCN PAM
gaguggauuccuuaaaucuu

SEQ ID NO: 8075 - RNA, 20 nt, Artificial Sequence
  targeting sequence with GTCN PAM
cuugaggccaggaguucaag

SEQ ID NO: 8076 - RNA, 20 nt, Artificial Sequence
  targeting sequence with GTCN PAM
ugaacuccuggccucaagug

SEQ ID NO: 8077 - RNA, 20 nt, Artificial Sequence
  targeting sequence with GTCN PAM
ugccauguugcccaggcugg

SEQ ID NO: 8078 - RNA, 20 nt, Artificial Sequence
  targeting sequence with GTCN PAM
uagccacuuggaagacugaa

SEQ ID NO: 8079 - RNA, 20 nt, Artificial Sequence
  targeting sequence with GTCN PAM
uccaaguggcuaggacucag

SEQ ID NO: 8080 - RNA, 20 nt, Artificial Sequence
  targeting sequence with GTCN PAM
aggcugcagugagcuaugau

SEQ ID NO: 8081 - RNA, 20 nt, Artificial Sequence
  targeting sequence with GTCN PAM
cccaggcuggagugcagugg

SEQ ID NO: 8082 - RNA, 20 nt, Artificial Sequence
  targeting sequence with GTCN PAM
caaaaaacaaacaaacaaac

SEQ ID NO: 8083 - RNA, 20 nt, Artificial Sequence
  targeting sequence with GTCN PAM
ccucuguguguguugaauug

SEQ ID NO: 8084 - RNA, 20 nt, Artificial Sequence
  targeting sequence with GTCN PAM
gacugaagagcaugaacuuu

SEQ ID NO: 8085 - RNA, 20 nt, Artificial Sequence
  targeting sequence with GTCN PAM
gacuuaaggagccuccuccc

SEQ ID NO: 8086 - RNA, 20 nt, Artificial Sequence
  targeting sequence with GTCN PAM
gauuucacucccccgcuuag

SEQ ID NO: 8087 - RNA, 20 nt, Artificial Sequence
  targeting sequence with GTCN PAM
ucaaaguguucuaaagugaa

SEQ ID NO: 8088 - RNA, 20 nt, Artificial Sequence
  targeting sequence with GTCN PAM
agaucucuggugauggagag

SEQ ID NO: 8089 - RNA, 20 nt, Artificial Sequence
  targeting sequence with GTCN PAM
cuuuauuguggaauuuuccc

SEQ ID NO: 8090 - RNA, 20 nt, Artificial Sequence
  targeting sequence with GTCN PAM
caagcaguagaaaaaaguuc

SEQ ID NO: 8091 - RNA, 20 nt, Artificial Sequence
  targeting sequence with GTCN PAM
ucucaguaguugggguguac

SEQ ID NO: 8092 - RNA, 20 nt, Artificial Sequence
  targeting sequence with GTCN PAM
cagaucuacgccuagagugg

SEQ ID NO: 8093 - RNA, 20 nt, Artificial Sequence
  targeting sequence with GTCN PAM
cuccuuaguuguaugaaaca

SEQ ID NO: 8094 - RNA, 20 nt, Artificial Sequence
  targeting sequence with GTCN PAM
cucacuauugauagacacuu

SEQ ID NO: 8095 - RNA, 20 nt, Artificial Sequence
  targeting sequence with GTCN PAM
aucaauagugagugacuagg

SEQ ID NO: 8096 - RNA, 20 nt, Artificial Sequence
  targeting sequence with GTCN PAM
uuuugcugagugugaaauac

SEQ ID NO: 8097 - RNA, 20 nt, Artificial Sequence
  targeting sequence with GTCN PAM
uacucuguagcccaggcugg

SEQ ID NO: 8098 - RNA, 20 nt, Artificial Sequence
  targeting sequence with GTCN PAM
aggcugcagggagcugugau

SEQ ID NO: 8099 - RNA, 20 nt, Artificial Sequence
  targeting sequence with GTCN PAM
cagcuaccugggaggccgag

SEQ ID NO: 8100 - RNA, 20 nt, Artificial Sequence
  targeting sequence with GTCN PAM
cuaccaaaaaauacaaaaau

SEQ ID NO: 8101 - RNA, 20 nt, Artificial Sequence
  targeting sequence with GTCN PAM
ugaacuccugggcucaagcg

SEQ ID NO: 8102 - RNA, 20 nt, Artificial Sequence
  targeting sequence with GTCN PAM
uuuuauauuauauuauauua

SEQ ID NO: 8103 - RNA, 20 nt, Artificial Sequence
  targeting sequence with GTCN PAM
caaaaauaaguaaauaaaaa

SEQ ID NO: 8104 - RNA, 20 nt, Artificial Sequence
  targeting sequence with GTCN PAM
ccagcucccagguucaagug

SEQ ID NO: 8105 - RNA, 20 nt, Artificial Sequence
  targeting sequence with GTCN PAM
cagcuacuugggaggcugag

SEQ ID NO: 8106 - RNA, 20 nt, Artificial Sequence
  targeting sequence with GTCN PAM
caaacuccugaccucaggug

SEQ ID NO: 8107 - RNA, 20 nt, Artificial Sequence
  targeting sequence with GTCN PAM
ggaguuugagaccagccugg

SEQ ID NO: 8108 - RNA, 20 nt, Artificial Sequence
  targeting sequence with GTCN PAM
uuuuagauggcugcagaaua

SEQ ID NO: 8109 - RNA, 20 nt, Artificial Sequence
  targeting sequence with GTCN PAM
gucaauuugaugggaaaaag

SEQ ID NO: 8110 - RNA, 20 nt, Artificial Sequence
  targeting sequence with GTCN PAM
auuugaugggaaaaaguagu

SEQ ID NO: 8111 - RNA, 20 nt, Artificial Sequence
  targeting sequence with GTCN PAM
auuuuccuguuucuguuccu

SEQ ID NO: 8112 - RNA, 20 nt, Artificial Sequence
  targeting sequence with GTCN PAM
auugucccaguggauguugu

SEQ ID NO: 8113 - RNA, 20 nt, Artificial Sequence
  targeting sequence with GTCN PAM
caguggauguuguccuuauc

SEQ ID NO: 8114 - RNA, 20 nt, Artificial Sequence
  targeting sequence with GTCN PAM
uuaucuaugaagacuuuugu

SEQ ID NO: 8115 - RNA, 20 nt, Artificial Sequence
  targeting sequence with GTCN PAM
ucauagauaaggacaacauc

SEQ ID NO: 8116 - RNA, 20 nt, Artificial Sequence
  targeting sequence with GTCN PAM
gggaggccgcugaggcggcc

SEQ ID NO: 8117 - RNA, 20 nt, Artificial Sequence
  targeting sequence with GTCN PAM
ccuguguugucagggaggcc

SEQ ID NO: 8118 - RNA, 20 nt, Artificial Sequence
  targeting sequence with GTCN PAM
ccauggugcaauguugggag

SEQ ID NO: 8119 - RNA, 20 nt, Artificial Sequence
  targeting sequence with GTCN PAM
caguccccauggugcaaugu

SEQ ID NO: 8120 - RNA, 20 nt, Artificial Sequence
  targeting sequence with GTCN PAM
agcgacacccccaagcuuac

SEQ ID NO: 8121 - RNA, 20 nt, Artificial Sequence
  targeting sequence with GTCN PAM
cuugacuucucugggucuca

SEQ ID NO: 8122 - RNA, 20 nt, Artificial Sequence
  targeting sequence with GTCN PAM
agcuggggcucccuacagaa

SEQ ID NO: 8123 - RNA, 20 nt, Artificial Sequence
  targeting sequence with GTCN PAM
gcagcuuggagcacucccag

SEQ ID NO: 8124 - RNA, 20 nt, Artificial Sequence
  targeting sequence with GTCN PAM
gcuggcugcaccugucgguc

SEQ ID NO: 8125 - RNA, 20 nt, Artificial Sequence
  targeting sequence with GTCN PAM
gucucauggcuccugggagc

SEQ ID NO: 8126 - RNA, 20 nt, Artificial Sequence
  targeting sequence with GTCN PAM
cauggcuccugggagcguca

SEQ ID NO: 8127 - RNA, 20 nt, Artificial Sequence
  targeting sequence with GTCN PAM
ccagcgacaucucacccucc

SEQ ID NO: 8128 - RNA, 20 nt, Artificial Sequence
  targeting sequence with GTCN PAM
cuggugacgcucccaggagc

SEQ ID NO: 8129 - RNA, 20 nt, Artificial Sequence
  targeting sequence with GTCN PAM
aggagggugagaugucgcug

SEQ ID NO: 8130 - RNA, 20 nt, Artificial Sequence
  targeting sequence with GTCN PAM
ccugaaucugaaaagccagg

SEQ ID NO: 8131 - RNA, 20 nt, Artificial Sequence
  targeting sequence with GTCN PAM
cagcaggaaacgggcuccag

SEQ ID NO: 8132 - RNA, 20 nt, Artificial Sequence
  targeting sequence with GTCN PAM
cuccaacuagcugcccacag

SEQ ID NO: 8133 - RNA, 20 nt, Artificial Sequence
  targeting sequence with GTCN PAM
agauaaacccugagguguuu

SEQ ID NO: 8134 - RNA, 20 nt, Artificial Sequence
  targeting sequence with GTCN PAM
ucgagggagugaacugggcc

SEQ ID NO: 8135 - RNA, 20 nt, Artificial Sequence
  targeting sequence with GTCN PAM
gauggggaagccuggcccau

SEQ ID NO: 8136 - RNA, 20 nt, Artificial Sequence
  targeting sequence with GTCN PAM
ucuaacccacucugggaggu

SEQ ID NO: 8137 - RNA, 20 nt, Artificial Sequence
  targeting sequence with GTCN PAM
gggaaagcuuccuagaagag

SEQ ID NO: 8138 - RNA, 20 nt, Artificial Sequence
  targeting sequence with GTCN PAM
ccucuucuaggaagcuuucc

SEQ ID NO: 8139 - RNA, 20 nt, Artificial Sequence
  targeting sequence with GTCN PAM
uggcaaauagaacacuuccc

SEQ ID NO: 8140 - RNA, 20 nt, Artificial Sequence
  targeting sequence with GTCN PAM
aggugccgagaaguaaaagg

SEQ ID NO: 8141 - RNA, 20 nt, Artificial Sequence
  targeting sequence with GTCN PAM
gagguguccaaaccaaggug

SEQ ID NO: 8142 - RNA, 20 nt, Artificial Sequence
  targeting sequence with GTCN PAM
aaaccaaggugcauuuugag

SEQ ID NO: 8143 - RNA, 20 nt, Artificial Sequence
  targeting sequence with GTCN PAM
ugcaggcugcucucacucau

SEQ ID NO: 8144 - RNA, 20 nt, Artificial Sequence
  targeting sequence with GTCN PAM
cggaagcugcaucuuccuuc

SEQ ID NO: 8145 - RNA, 20 nt, Artificial Sequence
  targeting sequence with GTCN PAM
ucaguuaggucaacuuuuau

SEQ ID NO: 8146 - RNA, 20 nt, Artificial Sequence
  targeting sequence with GTCN PAM
acuuuuaucuugaacaggga

SEQ ID NO: 8147 - RNA, 20 nt, Artificial Sequence
  targeting sequence with GTCN PAM
auggcucccuguucaagaua

SEQ ID NO: 8148 - RNA, 20 nt, Artificial Sequence
  targeting sequence with GTCN PAM
agaacagagcucagcccccc

SEQ ID NO: 8149 - RNA, 20 nt, Artificial Sequence
  targeting sequence with GTCN PAM
guucccucucaucccagccc

SEQ ID NO: 8150 - RNA, 20 nt, Artificial Sequence
  targeting sequence with GTCN PAM
ucccucaggucuguucccuc

SEQ ID NO: 8151 - RNA, 20 nt, Artificial Sequence
  targeting sequence with GTCN PAM
cagagagccacccccaggag

SEQ ID NO: 8152 - RNA, 20 nt, Artificial Sequence
  targeting sequence with GTCN PAM
gucccagagagccaccccca

SEQ ID NO: 8153 - RNA, 20 nt, Artificial Sequence
  targeting sequence with GTCN PAM
gggggaagcagaggaggggu

SEQ ID NO: 8154 - RNA, 20 nt, Artificial Sequence
  targeting sequence with GTCN PAM
ggccaagcgaagacccuugg

SEQ ID NO: 8155 - RNA, 20 nt, Artificial Sequence
  targeting sequence with GTCN PAM
ucgcuuggccugacuucacg

SEQ ID NO: 8156 - RNA, 20 nt, Artificial Sequence
  targeting sequence with GTCN PAM
gagcccucccagcugcagug

SEQ ID NO: 8157 - RNA, 20 nt, Artificial Sequence
  targeting sequence with GTCN PAM
ccacuguacggaugggaaga

SEQ ID NO: 8158 - RNA, 20 nt, Artificial Sequence
  targeting sequence with GTCN PAM
ucccauccguacagugggga

SEQ ID NO: 8159 - RNA, 20 nt, Artificial Sequence
  targeting sequence with GTCN PAM
cucccggguucucgggaguu

SEQ ID NO: 8160 - RNA, 20 nt, Artificial Sequence
  targeting sequence with GTCN PAM
ugggucacucccggguucuc

SEQ ID NO: 8161 - RNA, 20 nt, Artificial Sequence
  targeting sequence with GTCN PAM
uggccaggacccaacagggg

SEQ ID NO: 8162 - RNA, 20 nt, Artificial Sequence
  targeting sequence with GTCN PAM
uggccaugacgagcccagug

SEQ ID NO: 8163 - RNA, 20 nt, Artificial Sequence
  targeting sequence with GTCN PAM
aagugauuaggucucuuuau

SEQ ID NO: 8164 - RNA, 20 nt, Artificial Sequence
  targeting sequence with GTCN PAM
cuuuauaauuuugcucuaga

SEQ ID NO: 8165 - RNA, 20 nt, Artificial Sequence
  targeting sequence with GTCN PAM
caaaaaaaaaaaaaaaauug

SEQ ID NO: 8166 - RNA, 20 nt, Artificial Sequence
  targeting sequence with GTCN PAM
ugcuuugucacccaggcugg

SEQ ID NO: 8167 - RNA, 20 nt, Artificial Sequence
  targeting sequence with GTCN PAM
cccaggcuggagugcagugg

SEQ ID NO: 8168 - RNA, 20 nt, Artificial Sequence
  targeting sequence with GTCN PAM
ccacuucccaggcucaagca

SEQ ID NO: 8169 - RNA, 20 nt, Artificial Sequence
  targeting sequence with GTCN PAM
aggucucacgauauugccca

SEQ ID NO: 8170 - RNA, 20 nt, Artificial Sequence
  targeting sequence with GTCN PAM
cacgauauugcccagaauuu

SEQ ID NO: 8171 - RNA, 20 nt, Artificial Sequence
  targeting sequence with GTCN PAM
uuaaauucugcagauugauc

SEQ ID NO: 8172 - RNA, 20 nt, Artificial Sequence
  targeting sequence with GTCN PAM
ccaugaaaugcauaaaaggg

SEQ ID NO: 8173 - RNA, 20 nt, Artificial Sequence
  targeting sequence with GTCN PAM
gucaccaugaaaugcauaaa

SEQ ID NO: 8174 - RNA, 20 nt, Artificial Sequence
  targeting sequence with GTCN PAM
cucuccacccccacucccca

SEQ ID NO: 8175 - RNA, 20 nt, Artificial Sequence
  targeting sequence with GTCN PAM
auagaugcagaaagcagauu

SEQ ID NO: 8176 - RNA, 20 nt, Artificial Sequence
  targeting sequence with GTCN PAM
agaauaagaaguccauagau

SEQ ID NO: 8177 - RNA, 20 nt, Artificial Sequence
  targeting sequence with GTCN PAM
gauuccauuuauaugaaaug

SEQ ID NO: 8178 - RNA, 20 nt, Artificial Sequence
  targeting sequence with GTCN PAM
gaaaaagccacauacugucu

SEQ ID NO: 8179 - RNA, 20 nt, Artificial Sequence
  targeting sequence with GTCN PAM
uagccagggcuucacuccuu

SEQ ID NO: 8180 - RNA, 20 nt, Artificial Sequence
  targeting sequence with GTCN PAM
cuacccaucccguggaauau

SEQ ID NO: 8181 - RNA, 20 nt, Artificial Sequence
  targeting sequence with GTCN PAM
aucauucaucauggauguuu

SEQ ID NO: 8182 - RNA, 20 nt, Artificial Sequence
  targeting sequence with GTCN PAM
gcccaaagauggaaccagcc

SEQ ID NO: 8183 - RNA, 20 nt, Artificial Sequence
  targeting sequence with GTCN PAM
acacaaaaauguacacauga

SEQ ID NO: 8184 - RNA, 20 nt, Artificial Sequence
  targeting sequence with GTCN PAM
cccaaagugcuaggauuaca

SEQ ID NO: 8185 - RNA, 20 nt, Artificial Sequence
  targeting sequence with GTCN PAM
caaacuccugaguucaagcu

SEQ ID NO: 8186 - RNA, 20 nt, Artificial Sequence
  targeting sequence with GTCN PAM
cacuacauugcucaguuuag

SEQ ID NO: 8187 - RNA, 20 nt, Artificial Sequence
  targeting sequence with GTCN PAM
aauaacaauaacaauaauaa

SEQ ID NO: 8188 - RNA, 20 nt, Artificial Sequence
  targeting sequence with GTCN PAM
cagcuacuucggagacugag

SEQ ID NO: 8189 - RNA, 20 nt, Artificial Sequence
  targeting sequence with GTCN PAM
ccgaaguagcugggaccaca

SEQ ID NO: 8190 - RNA, 20 nt, Artificial Sequence
  targeting sequence with GTCN PAM
aggcugcagugagccaugau

SEQ ID NO: 8191 - RNA, 20 nt, Artificial Sequence
  targeting sequence with GTCN PAM
cccaagcuggagugcagugc

SEQ ID NO: 8192 - RNA, 20 nt, Artificial Sequence
  targeting sequence with GTCN PAM
caaucugucacccaagcugg

SEQ ID NO: 8193 - RNA, 20 nt, Artificial Sequence
  targeting sequence with GTCN PAM
ccauaaaacaaaacaaaaaa

SEQ ID NO: 8194 - RNA, 20 nt, Artificial Sequence
  targeting sequence with GTCN PAM
acuuuuguauccauuugaaa

SEQ ID NO: 8195 - RNA, 20 nt, Artificial Sequence
  targeting sequence with GTCN PAM
guaacucccuuccacuguac

SEQ ID NO: 8196 - RNA, 20 nt, Artificial Sequence
  targeting sequence with GTCN PAM
cccagcuccaacagucacca

SEQ ID NO: 8197 - RNA, 20 nt, Artificial Sequence
  targeting sequence with GTCN PAM
ccaucuuguggacacucuug

SEQ ID NO: 8198 - RNA, 20 nt, Artificial Sequence
  targeting sequence with GTCN PAM
acaagauggugacuguugga

SEQ ID NO: 8199 - RNA, 20 nt, Artificial Sequence
  targeting sequence with GTCN PAM
uuaggaaaccucucaaccaa

SEQ ID NO: 8200 - RNA, 20 nt, Artificial Sequence
  targeting sequence with GTCN PAM
auagggugccccucccacuu

SEQ ID NO: 8201 - RNA, 20 nt, Artificial Sequence
  targeting sequence with GTCN PAM
cucagucugggugccucuga

SEQ ID NO: 8202 - RNA, 20 nt, Artificial Sequence
  targeting sequence with GTCN PAM
gggugccucugagaaugugc

SEQ ID NO: 8203 - RNA, 20 nt, Artificial Sequence
  targeting sequence with GTCN PAM
uguaaacccacaguuacgaa

SEQ ID NO: 8204 - RNA, 20 nt, Artificial Sequence
  targeting sequence with GTCN PAM
ugaggucaggaguucaagac

SEQ ID NO: 8205 - RNA, 20 nt, Artificial Sequence
  targeting sequence with GTCN PAM
ggaguucaagaccagccugg

SEQ ID NO: 8206 - RNA, 20 nt, Artificial Sequence
  targeting sequence with GTCN PAM
ugaacuccugaccucaugac

SEQ ID NO: 8207 - RNA, 20 nt, Artificial Sequence
  targeting sequence with GTCN PAM
cuacuaaaaauacaaaaauc

SEQ ID NO: 8208 - RNA, 20 nt, Artificial Sequence
  targeting sequence with GTCN PAM
ccaggcuggagugcaauggc

SEQ ID NO: 8209 - RNA, 20 nt, Artificial Sequence
  targeting sequence with GTCN PAM
cucuauguccccaggcugga

SEQ ID NO: 8210 - RNA, 20 nt, Artificial Sequence
  targeting sequence with GTCN PAM
caaagaaaaaaagagagaga

SEQ ID NO: 8211 - RNA, 20 nt, Artificial Sequence
  targeting sequence with GTCN PAM
cucucucuuuuuuucuuuga

SEQ ID NO: 8212 - RNA, 20 nt, Artificial Sequence
  targeting sequence with GTCN PAM
ccccucaaggcucacugagu

SEQ ID NO: 8213 - RNA, 20 nt, Artificial Sequence
  targeting sequence with GTCN PAM
gugucuuggggagagggggg

SEQ ID NO: 8214 - RNA, 20 nt, Artificial Sequence
  targeting sequence with GTCN PAM
uggggagaggggggcaucug

SEQ ID NO: 8215 - RNA, 20 nt, Artificial Sequence
  targeting sequence with GTCN PAM
agcaaggaucagaugccccc

SEQ ID NO: 8216 - RNA, 20 nt, Artificial Sequence
  targeting sequence with GTCN PAM
caacucaguggcaggcauca

SEQ ID NO: 8217 - RNA, 20 nt, Artificial Sequence
  targeting sequence with GTCN PAM
caccaggaggcccgagccac

SEQ ID NO: 8218 - RNA, 20 nt, Artificial Sequence
  targeting sequence with GTCN PAM
caccgggaggcugcuguggc

SEQ ID NO: 8219 - RNA, 20 nt, Artificial Sequence
  targeting sequence with GTCN PAM
guggcagcuaucaagcucua

SEQ ID NO: 8220 - RNA, 20 nt, Artificial Sequence
  targeting sequence with GTCN PAM
acuguuggguacuugugcag

SEQ ID NO: 8221 - RNA, 20 nt, Artificial Sequence
  targeting sequence with GTCN PAM
uccgcuucaaguaccugcug

SEQ ID NO: 8222 - RNA, 20 nt, Artificial Sequence
  targeting sequence with GTCN PAM
ucccucaggggcgcuuacuu

SEQ ID NO: 8223 - RNA, 20 nt, Artificial Sequence
  targeting sequence with GTCN PAM
uggccucugugagugcugcg

SEQ ID NO: 8224 - RNA, 20 nt, Artificial Sequence
  targeting sequence with GTCN PAM
ccuguccuuguuccuccugu

SEQ ID NO: 8225 - RNA, 20 nt, Artificial Sequence
  targeting sequence with GTCN PAM
uuguuccuccuguggucuca

SEQ ID NO: 8226 - RNA, 20 nt, Artificial Sequence
  targeting sequence with GTCN PAM
cagccgagaugcccucuccu

SEQ ID NO: 8227 - RNA, 20 nt, Artificial Sequence
  targeting sequence with GTCN PAM
cccuguugguguccaggaca

SEQ ID NO: 8228 - RNA, 20 nt, Artificial Sequence
  targeting sequence with GTCN PAM
aggacaggugaacuguugca

SEQ ID NO: 8229 - RNA, 20 nt, Artificial Sequence
  targeting sequence with GTCN PAM
uggacaccaacagggugacu

SEQ ID NO: 8230 - RNA, 20 nt, Artificial Sequence
  targeting sequence with GTCN PAM
gcugugcuaacuucuggguc

SEQ ID NO: 8231 - RNA, 20 nt, Artificial Sequence
  targeting sequence with GTCN PAM
ugggcacguagccccuuccu

SEQ ID NO: 8232 - RNA, 20 nt, Artificial Sequence
  targeting sequence with GTCN PAM
uccguuucaaaggggagagu

SEQ ID NO: 8233 - RNA, 20 nt, Artificial Sequence
  targeting sequence with GTCN PAM
ccuuuuggagccuccuuaua

SEQ ID NO: 8234 - RNA, 20 nt, Artificial Sequence
  targeting sequence with GTCN PAM
cucagagcugaggcaggucu

SEQ ID NO: 8235 - RNA, 20 nt, Artificial Sequence
  targeting sequence with GTCN PAM
gggacaaaacugcaccccaa

SEQ ID NO: 8236 - RNA, 20 nt, Artificial Sequence
  targeting sequence with GTCN PAM
cagaccugccucagcucuga

SEQ ID NO: 8237 - RNA, 20 nt, Artificial Sequence
  targeting sequence with GTCN PAM
ugauguuggggugcaguuuu

SEQ ID NO: 8238 - RNA, 20 nt, Artificial Sequence
  targeting sequence with GTCN PAM
ucagccaccaggaauaccuc

SEQ ID NO: 8239 - RNA, 20 nt, Artificial Sequence
  targeting sequence with GTCN PAM
cugagguauuccugguggcu

SEQ ID NO: 8240 - RNA, 20 nt, Artificial Sequence
  targeting sequence with GTCN PAM
ggucccugagguauuccugg

SEQ ID NO: 8241 - RNA, 20 nt, Artificial Sequence
  targeting sequence with GTCN PAM
ggccgugggucuggucccug

SEQ ID NO: 8242 - RNA, 20 nt, Artificial Sequence
  targeting sequence with GTCN PAM
uugcuggguccccugcaucu

SEQ ID NO: 8243 - RNA, 20 nt, Artificial Sequence
  targeting sequence with GTCN PAM
ccugcaucuugccuaacuuc

SEQ ID NO: 8244 - RNA, 20 nt, Artificial Sequence
  targeting sequence with GTCN PAM
uggcagcugcuacaugcagg

SEQ ID NO: 8245 - RNA, 20 nt, Artificial Sequence
  targeting sequence with GTCN PAM
cugugguuaccuggugacag

SEQ ID NO: 8246 - RNA, 20 nt, Artificial Sequence
  targeting sequence with GTCN PAM
ccagguaaccacagggaccg

SEQ ID NO: 8247 - RNA, 20 nt, Artificial Sequence
  targeting sequence with GTCN PAM
cacccugguagaacuccugg

SEQ ID NO: 8248 - RNA, 20 nt, Artificial Sequence
  targeting sequence with GTCN PAM
gagccuggacuugcgucaca

SEQ ID NO: 8249 - RNA, 20 nt, Artificial Sequence
  targeting sequence with GTCN PAM
aggcucugacccacgcccag

SEQ ID NO: 8250 - RNA, 20 nt, Artificial Sequence
  targeting sequence with GTCN PAM
cagcaggaccaggcggcuaa

SEQ ID NO: 8251 - RNA, 20 nt, Artificial Sequence
  targeting sequence with GTCN PAM
ugcugugacgcaaguccagg

SEQ ID NO: 8252 - RNA, 20 nt, Artificial Sequence
  targeting sequence with GTCN PAM
ggugucugaugcggugugcu

SEQ ID NO: 8253 - RNA, 20 nt, Artificial Sequence
  targeting sequence with GTCN PAM
gaugcggugugcuggcaguu

SEQ ID NO: 8254 - RNA, 20 nt, Artificial Sequence
  targeting sequence with GTCN PAM
uggugauggggagcccugag

SEQ ID NO: 8255 - RNA, 20 nt, Artificial Sequence
  targeting sequence with GTCN PAM
cccaacccucagggcucccc

SEQ ID NO: 8256 - RNA, 20 nt, Artificial Sequence
  targeting sequence with GTCN PAM
ugcuguaaagaugagaagac

SEQ ID NO: 8257 - RNA, 20 nt, Artificial Sequence
  targeting sequence with GTCN PAM
ucucaucuuuacagcaggac

SEQ ID NO: 8258 - RNA, 20 nt, Artificial Sequence
  targeting sequence with GTCN PAM
gauggcucugggcucacagc

SEQ ID NO: 8259 - RNA, 20 nt, Artificial Sequence
  targeting sequence with GTCN PAM
aggggcgagguggugggggc

SEQ ID NO: 8260 - RNA, 20 nt, Artificial Sequence
  targeting sequence with GTCN PAM
agaggcacaaucugugggaa

SEQ ID NO: 8261 - RNA, 20 nt, Artificial Sequence
  targeting sequence with GTCN PAM
acuaugauucuaggaucuca

SEQ ID NO: 8262 - RNA, 20 nt, Artificial Sequence
  targeting sequence with GTCN PAM
uuggaggcacugucuacuau

SEQ ID NO: 8263 - RNA, 20 nt, Artificial Sequence
  targeting sequence with GTCN PAM
uacgggggguggggggcgug

SEQ ID NO: 8264 - RNA, 20 nt, Artificial Sequence
  targeting sequence with GTCN PAM
uucuccaguuaguucccaag

SEQ ID NO: 8265 - RNA, 20 nt, Artificial Sequence
  targeting sequence with GTCN PAM
cgggggccaucuuccugggc

SEQ ID NO: 8266 - RNA, 20 nt, Artificial Sequence
  targeting sequence with GTCN PAM
uccuuggccucacuugguuu

SEQ ID NO: 8267 - RNA, 20 nt, Artificial Sequence
  targeting sequence with GTCN PAM
uuggccgcgccgccuugcuu

SEQ ID NO: 8268 - RNA, 20 nt, Artificial Sequence
  targeting sequence with GTCN PAM
ggagaggcuaggaaggugcc

SEQ ID NO: 8269 - RNA, 20 nt, Artificial Sequence
  targeting sequence with GTCN PAM
ggcuuggggggcaccuuccu

SEQ ID NO: 8270 - RNA, 20 nt, Artificial Sequence
  targeting sequence with GTCN PAM
cacaacuaccuuggcugcuc

SEQ ID NO: 8271 - RNA, 20 nt, Artificial Sequence
  targeting sequence with GTCN PAM
ugacagccacuggagcgggg

SEQ ID NO: 8272 - RNA, 20 nt, Artificial Sequence
  targeting sequence with GTCN PAM
agacccccauccccacacca

SEQ ID NO: 8273 - RNA, 20 nt, Artificial Sequence
  targeting sequence with GTCN PAM
ugagugcugggcuugaccug

SEQ ID NO: 8274 - RNA, 20 nt, Artificial Sequence
  targeting sequence with GTCN PAM
agcccagcacucaggacaca

SEQ ID NO: 8275 - RNA, 20 nt, Artificial Sequence
  targeting sequence with GTCN PAM
gccuccuucccccaaccagc

SEQ ID NO: 8276 - RNA, 20 nt, Artificial Sequence
  targeting sequence with GTCN PAM
cugcuucccccuucauaacc

SEQ ID NO: 8277 - RNA, 20 nt, Artificial Sequence
  targeting sequence with GTCN PAM
ccuggucucugcuucccccu

SEQ ID NO: 8278 - RNA, 20 nt, Artificial Sequence
  targeting sequence with GTCN PAM
gucuccuggucucugcuucc

SEQ ID NO: 8279 - RNA, 20 nt, Artificial Sequence
  targeting sequence with GTCN PAM
caagcaggggaagggccugu

SEQ ID NO: 8280 - RNA, 20 nt, Artificial Sequence
  targeting sequence with GTCN PAM
ggaguuugagaccaaccugg

SEQ ID NO: 8281 - RNA, 20 nt, Artificial Sequence
  targeting sequence with GTCN PAM
caaacuccugaccucaaggg

SEQ ID NO: 8282 - RNA, 20 nt, Artificial Sequence
  targeting sequence with GTCN PAM
acauggugaacccccgucuc

SEQ ID NO: 8283 - RNA, 20 nt, Artificial Sequence
  targeting sequence with GTCN PAM
cugcuaaaaauacaaaaauu

SEQ ID NO: 8284 - RNA, 20 nt, Artificial Sequence
  targeting sequence with GTCN PAM
cccacgcuggaguacagugg

SEQ ID NO: 8285 - RNA, 20 nt, Artificial Sequence
  targeting sequence with GTCN PAM
cucugucacccacgcuggag

SEQ ID NO: 8286 - RNA, 20 nt, Artificial Sequence
  targeting sequence with GTCN PAM
caaaacaaaacacaaaaaga

SEQ ID NO: 8287 - RNA, 20 nt, Artificial Sequence
  targeting sequence with GTCN PAM
accuacaguuuuggcaagga

SEQ ID NO: 8288 - RNA, 20 nt, Artificial Sequence
  targeting sequence with GTCN PAM
uccagauaaagcccugauuc

SEQ ID NO: 8289 - RNA, 20 nt, Artificial Sequence
  targeting sequence with GTCN PAM
gaauccuuccacagcucugc

SEQ ID NO: 8290 - RNA, 20 nt, Artificial Sequence
  targeting sequence with GTCN PAM
cuaaaagagagagaggaaaa

SEQ ID NO: 8291 - RNA, 20 nt, Artificial Sequence
  targeting sequence with GTCN PAM
cacaggugagugcugagccc

SEQ ID NO: 8292 - RNA, 20 nt, Artificial Sequence
  targeting sequence with GTCN PAM
cuaauuccugggcucagcac

SEQ ID NO: 8293 - RNA, 20 nt, Artificial Sequence
  targeting sequence with GTCN PAM
aggcugcaguaaacugagau

SEQ ID NO: 8294 - RNA, 20 nt, Artificial Sequence
  targeting sequence with GTCN PAM
cugugcuggagugugguggg

SEQ ID NO: 8295 - RNA, 20 nt, Artificial Sequence
  targeting sequence with GTCN PAM
cgcucugucacugugcugga

SEQ ID NO: 8296 - RNA, 20 nt, Artificial Sequence
  targeting sequence with GTCN PAM
uaaaaguaaaaaaaaguauc

SEQ ID NO: 8297 - RNA, 20 nt, Artificial Sequence
  targeting sequence with GTCN PAM
uccaccuggcagccaggaua

SEQ ID NO: 8298 - RNA, 20 nt, Artificial Sequence
  targeting sequence with GTCN PAM
gcucgagccuuuaguuuguc

SEQ ID NO: 8299 - RNA, 20 nt, Artificial Sequence
  targeting sequence with GTCN PAM
aacgggccugucagcucgag

SEQ ID NO: 8300 - RNA, 20 nt, Artificial Sequence
  targeting sequence with GTCN PAM
ucaaacuaggucacugaggc

SEQ ID NO: 8301 - RNA, 20 nt, Artificial Sequence
  targeting sequence with GTCN PAM
cugaggcucagaguggcuaa

SEQ ID NO: 8302 - RNA, 20 nt, Artificial Sequence
  targeting sequence with GTCN PAM
cauaacugagugaagaccua

SEQ ID NO: 8303 - RNA, 20 nt, Artificial Sequence
  targeting sequence with GTCN PAM
ucacucaguuaugugacaug

SEQ ID NO: 8304 - RNA, 20 nt, Artificial Sequence
  targeting sequence with GTCN PAM
uaggucuucacucaguuaug

SEQ ID NO: 8305 - RNA, 20 nt, Artificial Sequence
  targeting sequence with GTCN PAM
uccagggauggggcucaauu

SEQ ID NO: 8306 - RNA, 20 nt, Artificial Sequence
  targeting sequence with GTCN PAM
accaccuucucucugguccc

SEQ ID NO: 8307 - RNA, 20 nt, Artificial Sequence
  targeting sequence with GTCN PAM
ccuggcacccuggggguguu

SEQ ID NO: 8308 - RNA, 20 nt, Artificial Sequence
  targeting sequence with GTCN PAM
cuuaucuguaagauggggau

SEQ ID NO: 8309 - RNA, 20 nt, Artificial Sequence
  targeting sequence with GTCN PAM
cuuugcuccugguuugcuuu

SEQ ID NO: 8310 - RNA, 20 nt, Artificial Sequence
  targeting sequence with GTCN PAM
agaauggugcugcuuccccg

SEQ ID NO: 8311 - RNA, 20 nt, Artificial Sequence
  targeting sequence with GTCN PAM
gggaagcagcaccauucuug

SEQ ID NO: 8312 - RNA, 20 nt, Artificial Sequence
  targeting sequence with GTCN PAM
aaggugguaccugcacauuu

SEQ ID NO: 8313 - RNA, 20 nt, Artificial Sequence
  targeting sequence with GTCN PAM
aggaagacagaggcccccaa

SEQ ID NO: 8314 - RNA, 20 nt, Artificial Sequence
  targeting sequence with GTCN PAM
uccuggacaaaugugcaggu

SEQ ID NO: 8315 - RNA, 20 nt, Artificial Sequence
  targeting sequence with GTCN PAM
agccagagggcugaagcuua

SEQ ID NO: 8316 - RNA, 20 nt, Artificial Sequence
  targeting sequence with GTCN PAM
cucuccgccccugccucugg

SEQ ID NO: 8317 - RNA, 20 nt, Artificial Sequence
  targeting sequence with GTCN PAM
uuauugauaaauagcuuaca

SEQ ID NO: 8318 - RNA, 20 nt, Artificial Sequence
  targeting sequence with GTCN PAM
uucaugaacauccgcugagc

SEQ ID NO: 8319 - RNA, 20 nt, Artificial Sequence
  targeting sequence with GTCN PAM
ugccucagggauacagacug

SEQ ID NO: 8320 - RNA, 20 nt, Artificial Sequence
  targeting sequence with GTCN PAM
guaucccugaggcaggaccu

SEQ ID NO: 8321 - RNA, 20 nt, Artificial Sequence
  targeting sequence with GTCN PAM
ggcagaugaggcagaggaug

SEQ ID NO: 8322 - RNA, 20 nt, Artificial Sequence
  targeting sequence with GTCN PAM
ucucagcuacucuaauccuu

SEQ ID NO: 8323 - RNA, 20 nt, Artificial Sequence
  targeting sequence with GTCN PAM
cccugucuucucagcuacuc

SEQ ID NO: 8324 - RNA, 20 nt, Artificial Sequence
  targeting sequence with GTCN PAM
cagugccuggcccaggagca

SEQ ID NO: 8325 - RNA, 20 nt, Artificial Sequence
  targeting sequence with GTCN PAM
gccugucgcagugccuggcc

SEQ ID NO: 8326 - RNA, 20 nt, Artificial Sequence
  targeting sequence with GTCN PAM
uacucugcagccagcgccug

SEQ ID NO: 8327 - RNA, 20 nt, Artificial Sequence
  targeting sequence with GTCN PAM
aaacuagcagccagcccuac

SEQ ID NO: 8328 - RNA, 20 nt, Artificial Sequence
  targeting sequence with GTCN PAM
aacccugucuaaacuagcag

SEQ ID NO: 8329 - RNA, 20 nt, Artificial Sequence
  targeting sequence with GTCN PAM
gagcaaggaucucugucugg

SEQ ID NO: 8330 - RNA, 20 nt, Artificial Sequence
  targeting sequence with GTCN PAM
ggaggggguaccauuucagc

SEQ ID NO: 8331 - RNA, 20 nt, Artificial Sequence
  targeting sequence with GTCN PAM
guguggcuagagcccaguaa

SEQ ID NO: 8332 - RNA, 20 nt, Artificial Sequence
  targeting sequence with GTCN PAM
cccaucccugugcuccucuu

SEQ ID NO: 8333 - RNA, 20 nt, Artificial Sequence
  targeting sequence with GTCN PAM
aaggugcuuuaaaaacaucu

SEQ ID NO: 8334 - RNA, 20 nt, Artificial Sequence
  targeting sequence with GTCN PAM
cuccgugugaggagugccgc

SEQ ID NO: 8335 - RNA, 20 nt, Artificial Sequence
  targeting sequence with GTCN PAM
cuaccucuugacucugggcu

SEQ ID NO: 8336 - RNA, 20 nt, Artificial Sequence
  targeting sequence with GTCN PAM
agagguagggacacagagcc

SEQ ID NO: 8337 - RNA, 20 nt, Artificial Sequence
  targeting sequence with GTCN PAM
aguaaucauggagcccagag

SEQ ID NO: 8338 - RNA, 20 nt, Artificial Sequence
  targeting sequence with GTCN PAM
ccaaauucuacuggucaagu

SEQ ID NO: 8339 - RNA, 20 nt, Artificial Sequence
  targeting sequence with GTCN PAM
uugucaccaaauucuacugg

SEQ ID NO: 8340 - RNA, 20 nt, Artificial Sequence
  targeting sequence with GTCN PAM
ucaaacacaagaaguagaag

SEQ ID NO: 8341 - RNA, 20 nt, Artificial Sequence
  targeting sequence with GTCN PAM
ucaguuccucuccacaagcu

SEQ ID NO: 8342 - RNA, 20 nt, Artificial Sequence
  targeting sequence with GTCN PAM
gagaguucagcaggagcuga

SEQ ID NO: 8343 - RNA, 20 nt, Artificial Sequence
  targeting sequence with GTCN PAM
cuguuccaccagguuucugc

SEQ ID NO: 8344 - RNA, 20 nt, Artificial Sequence
  targeting sequence with GTCN PAM
cuuauuuugcccacgaaucu

SEQ ID NO: 8345 - RNA, 20 nt, Artificial Sequence
  targeting sequence with GTCN PAM
cauagcaauauaucuuucua

SEQ ID NO: 8346 - RNA, 20 nt, Artificial Sequence
  targeting sequence with GTCN PAM
uaaggaaccauuagaggacg

SEQ ID NO: 8347 - RNA, 20 nt, Artificial Sequence
  targeting sequence with GTCN PAM
ucuaaugguuccuuaugaca

SEQ ID NO: 8348 - RNA, 20 nt, Artificial Sequence
  targeting sequence with GTCN PAM
cugcagggaugugggcgggc

SEQ ID NO: 8349 - RNA, 20 nt, Artificial Sequence
  targeting sequence with GTCN PAM
gcccgcccacaucccugcag

SEQ ID NO: 8350 - RNA, 20 nt, Artificial Sequence
  targeting sequence with GTCN PAM
ccacccccuucaucuggguu

SEQ ID NO: 8351 - RNA, 20 nt, Artificial Sequence
  targeting sequence with GTCN PAM
uggcuggucaccacccccuu

SEQ ID NO: 8352 - RNA, 20 nt, Artificial Sequence
  targeting sequence with GTCN PAM
cugaugagucaguccacaau

SEQ ID NO: 8353 - RNA, 20 nt, Artificial Sequence
  targeting sequence with GTCN PAM
guccacaauuuggggucuag

SEQ ID NO: 8354 - RNA, 20 nt, Artificial Sequence
  targeting sequence with GTCN PAM
acaauuuggggucuagauag

SEQ ID NO: 8355 - RNA, 20 nt, Artificial Sequence
  targeting sequence with GTCN PAM
agauagcuaagugacugcug

SEQ ID NO: 8356 - RNA, 20 nt, Artificial Sequence
  targeting sequence with GTCN PAM
cuuagcuaucuagaccccaa

SEQ ID NO: 8357 - RNA, 20 nt, Artificial Sequence
  targeting sequence with GTCN PAM
cccagcagucacuuagcuau

SEQ ID NO: 8358 - RNA, 20 nt, Artificial Sequence
  targeting sequence with GTCN PAM
ucaccucaggaaauggucac

SEQ ID NO: 8359 - RNA, 20 nt, Artificial Sequence
  targeting sequence with GTCN PAM
ugaugagagguggcagccua

SEQ ID NO: 8360 - RNA, 20 nt, Artificial Sequence
  targeting sequence with GTCN PAM
uccguggcuaggcugccacc

SEQ ID NO: 8361 - RNA, 20 nt, Artificial Sequence
  targeting sequence with GTCN PAM
accccuuccuucucucuguc

SEQ ID NO: 8362 - RNA, 20 nt, Artificial Sequence
  targeting sequence with GTCN PAM
gaggcaaacugcacaggacu

SEQ ID NO: 8363 - RNA, 20 nt, Artificial Sequence
  targeting sequence with GTCN PAM
ugugcaguuugccucugacu

SEQ ID NO: 8364 - RNA, 20 nt, Artificial Sequence
  targeting sequence with GTCN PAM
gcccccuucucaaguccugu

SEQ ID NO: 8365 - RNA, 20 nt, Artificial Sequence
  targeting sequence with GTCN PAM
gcacaucuaggcaaagccgg

SEQ ID NO: 8366 - RNA, 20 nt, Artificial Sequence
  targeting sequence with GTCN PAM
guaauguggcugccagcagg

SEQ ID NO: 8367 - RNA, 20 nt, Artificial Sequence
  targeting sequence with GTCN PAM
ugcuggcagccacauuacag

SEQ ID NO: 8368 - RNA, 20 nt, Artificial Sequence
  targeting sequence with GTCN PAM
gcuccugccacugcucauuc

SEQ ID NO: 8369 - RNA, 20 nt, Artificial Sequence
  targeting sequence with GTCN PAM
augagcuggggacaggggug

SEQ ID NO: 8370 - RNA, 20 nt, Artificial Sequence
  targeting sequence with GTCN PAM
ccagcucauggacgugagau

SEQ ID NO: 8371 - RNA, 20 nt, Artificial Sequence
  targeting sequence with GTCN PAM
agcauccaugaaaccuuggg

SEQ ID NO: 8372 - RNA, 20 nt, Artificial Sequence
  targeting sequence with GTCN PAM
cuagccuccuaugacccuca

SEQ ID NO: 8373 - RNA, 20 nt, Artificial Sequence
  targeting sequence with GTCN PAM
uaggaggcuagggaccccug

SEQ ID NO: 8374 - RNA, 20 nt, Artificial Sequence
  targeting sequence with GTCN PAM
ucagagccccagauaaggau

SEQ ID NO: 8375 - RNA, 20 nt, Artificial Sequence
  targeting sequence with GTCN PAM
uuucucagcgcagaaggugg

SEQ ID NO: 8376 - RNA, 20 nt, Artificial Sequence
  targeting sequence with GTCN PAM
aggaggaacugaauguuaau

SEQ ID NO: 8377 - RNA, 20 nt, Artificial Sequence
  targeting sequence with GTCN PAM
gauuaacauucaguuccucc

SEQ ID NO: 8378 - RNA, 20 nt, Artificial Sequence
  targeting sequence with GTCN PAM
uaaugucugauuaacauuca

SEQ ID NO: 8379 - RNA, 20 nt, Artificial Sequence
  targeting sequence with GTCN PAM
uuaaauauuccacagccugu

SEQ ID NO: 8380 - RNA, 20 nt, Artificial Sequence
  targeting sequence with GTCN PAM
guaacaucuuucuaugucau

SEQ ID NO: 8381 - RNA, 20 nt, Artificial Sequence
  targeting sequence with GTCN PAM
caugggggaaaaucagguug

SEQ ID NO: 8382 - RNA, 20 nt, Artificial Sequence
  targeting sequence with GTCN PAM
cugagaacgccagccgcacg

SEQ ID NO: 8383 - RNA, 20 nt, Artificial Sequence
  targeting sequence with GTCN PAM
uuaucuuucacauuuucuau

SEQ ID NO: 8384 - RNA, 20 nt, Artificial Sequence
  targeting sequence with GTCN PAM
uaguucuuacucuugauaaa

SEQ ID NO: 8385 - RNA, 20 nt, Artificial Sequence
  targeting sequence with GTCN PAM
gcaucagguucauuguucuu

SEQ ID NO: 8386 - RNA, 20 nt, Artificial Sequence
  targeting sequence with GTCN PAM
gagaaaugagcuuaaugcua

SEQ ID NO: 8387 - RNA, 20 nt, Artificial Sequence
  targeting sequence with GTCN PAM
guucccuuuccagggugguc

SEQ ID NO: 8388 - RNA, 20 nt, Artificial Sequence
  targeting sequence with GTCN PAM
ccuuuggccuccccgcccau

SEQ ID NO: 8389 - RNA, 20 nt, Artificial Sequence
  targeting sequence with GTCN PAM
ccaaaaugggcggggaggcc

SEQ ID NO: 8390 - RNA, 20 nt, Artificial Sequence
  targeting sequence with GTCN PAM
ccacagugguccccaaaaug

SEQ ID NO: 8391 - RNA, 20 nt, Artificial Sequence
  targeting sequence with GTCN PAM
uuccgggccagagucuccac

SEQ ID NO: 8392 - RNA, 20 nt, Artificial Sequence
  targeting sequence with GTCN PAM
caugguccuuccgggccaga

SEQ ID NO: 8393 - RNA, 20 nt, Artificial Sequence
  targeting sequence with GTCN PAM
uuauucugucccuuccuggu

SEQ ID NO: 8394 - RNA, 20 nt, Artificial Sequence
  targeting sequence with GTCN PAM
cuuccugguugugugaccuu

SEQ ID NO: 8395 - RNA, 20 nt, Artificial Sequence
  targeting sequence with GTCN PAM
cacaaccaggaagggacaga

SEQ ID NO: 8396 - RNA, 20 nt, Artificial Sequence
  targeting sequence with GTCN PAM
gucauacagggaugcuagca

SEQ ID NO: 8397 - RNA, 20 nt, Artificial Sequence
  targeting sequence with GTCN PAM
uacagggaugcuagcacauu

SEQ ID NO: 8398 - RNA, 20 nt, Artificial Sequence
  targeting sequence with GTCN PAM
ggaaugugcuagcaucccug

SEQ ID NO: 8399 - RNA, 20 nt, Artificial Sequence
  targeting sequence with GTCN PAM
cgggguguccucagagcuua

SEQ ID NO: 8400 - RNA, 20 nt, Artificial Sequence
  targeting sequence with GTCN PAM
ucagagcuuaaggaauggca

SEQ ID NO: 8401 - RNA, 20 nt, Artificial Sequence
  targeting sequence with GTCN PAM
cguuucaucuccuggccucu

SEQ ID NO: 8402 - RNA, 20 nt, Artificial Sequence
  targeting sequence with GTCN PAM
gaggccaggagaugaaacga

SEQ ID NO: 8403 - RNA, 20 nt, Artificial Sequence
  targeting sequence with GTCN PAM
ggugucugcccaaaccucaa

SEQ ID NO: 8404 - RNA, 20 nt, Artificial Sequence
  targeting sequence with GTCN PAM
gcccaaaccucaagagugca

SEQ ID NO: 8405 - RNA, 20 nt, Artificial Sequence
  targeting sequence with GTCN PAM
cagcugcacucuugagguuu

SEQ ID NO: 8406 - RNA, 20 nt, Artificial Sequence
  targeting sequence with GTCN PAM
cuccugucucagcugcacuc

SEQ ID NO: 8407 - RNA, 20 nt, Artificial Sequence
  targeting sequence with GTCN PAM
ugagauagccaagcgggaga

SEQ ID NO: 8408 - RNA, 20 nt, Artificial Sequence
  targeting sequence with GTCN PAM
guaaggcuuuuauuauaaag

SEQ ID NO: 8409 - RNA, 20 nt, Artificial Sequence
  targeting sequence with GTCN PAM
cagcugccccccuccagccc

SEQ ID NO: 8410 - RNA, 20 nt, Artificial Sequence
  targeting sequence with GTCN PAM
caacacuggcugaguuggcu

SEQ ID NO: 8411 - RNA, 20 nt, Artificial Sequence
  targeting sequence with GTCN PAM
uuucuggcaggaacggagug

SEQ ID NO: 8412 - RNA, 20 nt, Artificial Sequence
  targeting sequence with GTCN PAM
caggcgccaggggcgcucug

SEQ ID NO: 8413 - RNA, 20 nt, Artificial Sequence
  targeting sequence with GTCN PAM
gcccgcucucuggaacaguc

SEQ ID NO: 8414 - RNA, 20 nt, Artificial Sequence
  targeting sequence with GTCN PAM
uuuccaguguugcaugggga

SEQ ID NO: 8415 - RNA, 20 nt, Artificial Sequence
  targeting sequence with GTCN PAM
cgagaggcuccccaugcaac

SEQ ID NO: 8416 - RNA, 20 nt, Artificial Sequence
  targeting sequence with GTCN PAM
ucugcgcaagcggcagcuau

SEQ ID NO: 8417 - RNA, 20 nt, Artificial Sequence
  targeting sequence with GTCN PAM
ccaggaaaaggagagggguu

SEQ ID NO: 8418 - RNA, 20 nt, Artificial Sequence
  targeting sequence with GTCN PAM
guucaaggagggcucccugc

SEQ ID NO: 8419 - RNA, 20 nt, Artificial Sequence
  targeting sequence with GTCN PAM
ggcugcugcugggagaaaug

SEQ ID NO: 8420 - RNA, 20 nt, Artificial Sequence
  targeting sequence with GTCN PAM
caggccucacuguagcacuc

SEQ ID NO: 8421 - RNA, 20 nt, Artificial Sequence
  targeting sequence with GTCN PAM
uccaucaaagccaccaccug

SEQ ID NO: 8422 - RNA, 20 nt, Artificial Sequence
  targeting sequence with GTCN PAM
uccgggccgugggguuggcc

SEQ ID NO: 8423 - RNA, 20 nt, Artificial Sequence
  targeting sequence with GTCN PAM
gccgggccauggccgguagc

SEQ ID NO: 8424 - RNA, 20 nt, Artificial Sequence
  targeting sequence with GTCN PAM
accacgagugacauccgucc

SEQ ID NO: 8425 - RNA, 20 nt, Artificial Sequence
  targeting sequence with GTCN PAM
cucgugguagacguucaggg

SEQ ID NO: 8426 - RNA, 20 nt, Artificial Sequence
  targeting sequence with GTCN PAM
auuaggggcaagcacccuga

SEQ ID NO: 8427 - RNA, 20 nt, Artificial Sequence
  targeting sequence with GTCN PAM
uugaguaggaagcucaccua

SEQ ID NO: 8428 - RNA, 20 nt, Artificial Sequence
  targeting sequence with GTCN PAM
aagcugagccuagucccagc

SEQ ID NO: 8429 - RNA, 20 nt, Artificial Sequence
  targeting sequence with GTCN PAM
cagcaaagccagcugcuugc

SEQ ID NO: 8430 - RNA, 20 nt, Artificial Sequence
  targeting sequence with GTCN PAM
cauggacgaagacggcuucc

SEQ ID NO: 8431 - RNA, 20 nt, Artificial Sequence
  targeting sequence with GTCN PAM
augggacuugaggggccuca

SEQ ID NO: 8432 - RNA, 20 nt, Artificial Sequence
  targeting sequence with GTCN PAM
ucguccaugggacuugaggg

SEQ ID NO: 8433 - RNA, 20 nt, Artificial Sequence
  targeting sequence with GTCN PAM
gggaagccgucuucguccau

SEQ ID NO: 8434 - RNA, 20 nt, Artificial Sequence
  targeting sequence with GTCN PAM
aaucuccucuccauccagag

SEQ ID NO: 8435 - RNA, 20 nt, Artificial Sequence
  targeting sequence with GTCN PAM
ugcauuuucccagaguuuga

SEQ ID NO: 8436 - RNA, 20 nt, Artificial Sequence
  targeting sequence with GTCN PAM
ggggcugggccucaaugccu

SEQ ID NO: 8437 - RNA, 20 nt, Artificial Sequence
  targeting sequence with GTCN PAM
agggugcgguggcucggcgg

SEQ ID NO: 8438 - RNA, 20 nt, Artificial Sequence
  targeting sequence with GTCN PAM
uguccuggaucugcuuguag

SEQ ID NO: 8439 - RNA, 20 nt, Artificial Sequence
  targeting sequence with GTCN PAM
uggaucugcuuguaguagcg

SEQ ID NO: 8440 - RNA, 20 nt, Artificial Sequence
  targeting sequence with GTCN PAM
uuucuccagcagccaucuaa

SEQ ID NO: 8441 - RNA, 20 nt, Artificial Sequence
  targeting sequence with GTCN PAM
uuuucuggaugagcccucau

SEQ ID NO: 8442 - RNA, 20 nt, Artificial Sequence
  targeting sequence with GTCN PAM
cuuauguggcaggagggaug

SEQ ID NO: 8443 - RNA, 20 nt, Artificial Sequence
  targeting sequence with GTCN PAM
cacccggucacugaacgucc

SEQ ID NO: 8444 - RNA, 20 nt, Artificial Sequence
  targeting sequence with GTCN PAM
cugaacguccccgcacucag

SEQ ID NO: 8445 - RNA, 20 nt, Artificial Sequence
  targeting sequence with GTCN PAM
ccgcacucagccggccccag

SEQ ID NO: 8446 - RNA, 20 nt, Artificial Sequence
  targeting sequence with GTCN PAM
ggggccggcugagugcgggg

SEQ ID NO: 8447 - RNA, 20 nt, Artificial Sequence
  targeting sequence with GTCN PAM
gccccgccuacuuuccccag

SEQ ID NO: 8448 - RNA, 20 nt, Artificial Sequence
  targeting sequence with GTCN PAM
uggggaaaguaggcggggca

SEQ ID NO: 8449 - RNA, 20 nt, Artificial Sequence
  targeting sequence with GTCN PAM
uaacaguccuggggaaagua

SEQ ID NO: 8450 - RNA, 20 nt, Artificial Sequence
  targeting sequence with GTCN PAM
uucucagggugauaggucuu

SEQ ID NO: 8451 - RNA, 20 nt, Artificial Sequence
  targeting sequence with GTCN PAM
ugguggcuaggauuccugga

SEQ ID NO: 8452 - RNA, 20 nt, Artificial Sequence
  targeting sequence with GTCN PAM
gucacgggcacccugccuuc

SEQ ID NO: 8453 - RNA, 20 nt, Artificial Sequence
  targeting sequence with GTCN PAM
cgggcacccugccuucggag

SEQ ID NO: 8454 - RNA, 20 nt, Artificial Sequence
  targeting sequence with GTCN PAM
gucucugaaaugcgugggcu

SEQ ID NO: 8455 - RNA, 20 nt, Artificial Sequence
  targeting sequence with GTCN PAM
cugaaaugcgugggcuaaau

SEQ ID NO: 8456 - RNA, 20 nt, Artificial Sequence
  targeting sequence with GTCN PAM
cacacgaccuggaccaaucc

SEQ ID NO: 8457 - RNA, 20 nt, Artificial Sequence
  targeting sequence with GTCN PAM
ugugugacccugcauuuagc

SEQ ID NO: 8458 - RNA, 20 nt, Artificial Sequence
  targeting sequence with GTCN PAM
aggucgugugugacccugca

SEQ ID NO: 8459 - RNA, 20 nt, Artificial Sequence
  targeting sequence with GTCN PAM
uugccugcgccguucucucu

SEQ ID NO: 8460 - RNA, 20 nt, Artificial Sequence
  targeting sequence with GTCN PAM
ggcuuuagagguugaagaug

SEQ ID NO: 8461 - RNA, 20 nt, Artificial Sequence
  targeting sequence with GTCN PAM
aaagccauucaagcgagcau

SEQ ID NO: 8462 - RNA, 20 nt, Artificial Sequence
  targeting sequence with GTCN PAM
ggcacaacaucaucugaaaa

SEQ ID NO: 8463 - RNA, 20 nt, Artificial Sequence
  targeting sequence with GTCN PAM
aagcucauacuggcuuuccc

SEQ ID NO: 8464 - RNA, 20 nt, Artificial Sequence
  targeting sequence with GTCN PAM
gcagcgauacagaguuucug

SEQ ID NO: 8465 - RNA, 20 nt, Artificial Sequence
  targeting sequence with GTCN PAM
cccugucugaaugagucacu

SEQ ID NO: 8466 - RNA, 20 nt, Artificial Sequence
  targeting sequence with GTCN PAM
gaaugagucacucaucccac

SEQ ID NO: 8467 - RNA, 20 nt, Artificial Sequence
  targeting sequence with GTCN PAM
cucaucccacauccccuaga

SEQ ID NO: 8468 - RNA, 20 nt, Artificial Sequence
  targeting sequence with GTCN PAM
aggggaugugggaugaguga

SEQ ID NO: 8469 - RNA, 20 nt, Artificial Sequence
  targeting sequence with GTCN PAM
aggaggcuacccauggucgg

SEQ ID NO: 8470 - RNA, 20 nt, Artificial Sequence
  targeting sequence with GTCN PAM
gcaccccacucuggcccugu

SEQ ID NO: 8471 - RNA, 20 nt, Artificial Sequence
  targeting sequence with GTCN PAM
ugggaacagcugaccuugcc

SEQ ID NO: 8472 - RNA, 20 nt, Artificial Sequence
  targeting sequence with GTCN PAM
gcuguucccaggaccaggcc

SEQ ID NO: 8473 - RNA, 20 nt, Artificial Sequence
  targeting sequence with GTCN PAM
gagauggagcaggcgucgau

SEQ ID NO: 8474 - RNA, 20 nt, Artificial Sequence
  targeting sequence with GTCN PAM
augaaggccugcgcgaugac

SEQ ID NO: 8475 - RNA, 20 nt, Artificial Sequence
  targeting sequence with GTCN PAM
ucgcgcaggccuucaucgac

SEQ ID NO: 8476 - RNA, 20 nt, Artificial Sequence
  targeting sequence with GTCN PAM
auguggucugucuugucgau

SEQ ID NO: 8477 - RNA, 20 nt, Artificial Sequence
  targeting sequence with GTCN PAM
gucuugucgaugucaaagac

SEQ ID NO: 8478 - RNA, 20 nt, Artificial Sequence
  targeting sequence with GTCN PAM
ugucgaugucaaagacaaac

SEQ ID NO: 8479 - RNA, 20 nt, Artificial Sequence
  targeting sequence with GTCN PAM
augucaaagacaaacugggg

SEQ ID NO: 8480 - RNA, 20 nt, Artificial Sequence
  targeting sequence with GTCN PAM
aagacaaacuggggguucuu

SEQ ID NO: 8481 - RNA, 20 nt, Artificial Sequence
  targeting sequence with GTCN PAM
uugacaucgacaagacagac

SEQ ID NO: 8482 - RNA, 20 nt, Artificial Sequence
  targeting sequence with GTCN PAM
cccuaccccacagccuuccu

SEQ ID NO: 8483 - RNA, 20 nt, Artificial Sequence
  targeting sequence with GTCN PAM
uugucacccuaccccacagc

SEQ ID NO: 8484 - RNA, 20 nt, Artificial Sequence
  targeting sequence with GTCN PAM
agggacaguuguggaggaga

SEQ ID NO: 8485 - RNA, 20 nt, Artificial Sequence
  targeting sequence with GTCN PAM
cucgacugcuuccuacccca

SEQ ID NO: 8486 - RNA, 20 nt, Artificial Sequence
  targeting sequence with GTCN PAM
cucaagggccugagguugga

SEQ ID NO: 8487 - RNA, 20 nt, Artificial Sequence
  targeting sequence with GTCN PAM
caagaugugaccuuugggaa

SEQ ID NO: 8488 - RNA, 20 nt, Artificial Sequence
  targeting sequence with GTCN PAM
caucuugugacaaggcucca

SEQ ID NO: 8489 - RNA, 20 nt, Artificial Sequence
  targeting sequence with GTCN PAM
gguccugguucucauuagaa

SEQ ID NO: 8490 - RNA, 20 nt, Artificial Sequence
  targeting sequence with GTCN PAM
ugguucucauuagaaccagg

SEQ ID NO: 8491 - RNA, 20 nt, Artificial Sequence
  targeting sequence with GTCN PAM
gacauuagcagagcagcugu

SEQ ID NO: 8492 - RNA, 20 nt, Artificial Sequence
  targeting sequence with GTCN PAM
gacuuccugcugccugcaag

SEQ ID NO: 8493 - RNA, 20 nt, Artificial Sequence
  targeting sequence with GTCN PAM
ucaagaggccagagagggug

SEQ ID NO: 8494 - RNA, 20 nt, Artificial Sequence
  targeting sequence with GTCN PAM
cuggguggccugaggugggg

SEQ ID NO: 8495 - RNA, 20 nt, Artificial Sequence
  targeting sequence with GTCN PAM
ggcuggguuuccagcaacuu

SEQ ID NO: 8496 - RNA, 20 nt, Artificial Sequence
  targeting sequence with GTCN PAM
ugcacccccacaagaaguug

SEQ ID NO: 8497 - RNA, 20 nt, Artificial Sequence
  targeting sequence with GTCN PAM
gggucaugcacccccacaag

SEQ ID NO: 8498 - RNA, 20 nt, Artificial Sequence
  targeting sequence with GTCN PAM
caggcuguguggucuugagc

SEQ ID NO: 8499 - RNA, 20 nt, Artificial Sequence
  targeting sequence with GTCN PAM
ugagcaggugcugcuucucc

SEQ ID NO: 8500 - RNA, 20 nt, Artificial Sequence
  targeting sequence with GTCN PAM
agguguugcccuuacuauca

SEQ ID NO: 8501 - RNA, 20 nt, Artificial Sequence
  targeting sequence with GTCN PAM
cauuuuacaguggaggggaa

SEQ ID NO: 8502 - RNA, 20 nt, Artificial Sequence
  targeting sequence with GTCN PAM
cucauccgagaacacacagc

SEQ ID NO: 8503 - RNA, 20 nt, Artificial Sequence
  targeting sequence with GTCN PAM
agcccuccucugccauuucc

SEQ ID NO: 8504 - RNA, 20 nt, Artificial Sequence
  targeting sequence with GTCN PAM
ucuggccucgccugcuuggg

SEQ ID NO: 8505 - RNA, 20 nt, Artificial Sequence
  targeting sequence with GTCN PAM
agucuucuggccucgccugc

SEQ ID NO: 8506 - RNA, 20 nt, Artificial Sequence
  targeting sequence with GTCN PAM
acacggcccccccacccgcc

SEQ ID NO: 8507 - RNA, 20 nt, Artificial Sequence
  targeting sequence with GTCN PAM
uccagauguguagggugucg

SEQ ID NO: 8508 - RNA, 20 nt, Artificial Sequence
  targeting sequence with GTCN PAM
gggucggagauuccccucuu

SEQ ID NO: 8509 - RNA, 20 nt, Artificial Sequence
  targeting sequence with GTCN PAM
gagauuccccucuucucagc

SEQ ID NO: 8510 - RNA, 20 nt, Artificial Sequence
  targeting sequence with GTCN PAM
aaaaaguacuugacagccag

SEQ ID NO: 8511 - RNA, 20 nt, Artificial Sequence
  targeting sequence with GTCN PAM
aguacuuuuucgacuuccug

SEQ ID NO: 8512 - RNA, 20 nt, Artificial Sequence
  targeting sequence with GTCN PAM
ucacggauacucagaauggc

SEQ ID NO: 8513 - RNA, 20 nt, Artificial Sequence
  targeting sequence with GTCN PAM
uccagaaacuucugcaacgu

SEQ ID NO: 8514 - RNA, 20 nt, Artificial Sequence
  targeting sequence with GTCN PAM
gccccgggccacgugcagag

SEQ ID NO: 8515 - RNA, 20 nt, Artificial Sequence
  targeting sequence with GTCN PAM
ccgagccucucuggcucacu

SEQ ID NO: 8516 - RNA, 20 nt, Artificial Sequence
  targeting sequence with GTCN PAM
uuucaacgccucugggaggc

SEQ ID NO: 8517 - RNA, 20 nt, Artificial Sequence
  targeting sequence with GTCN PAM
agaacuggaagugccagagu

SEQ ID NO: 8518 - RNA, 20 nt, Artificial Sequence
  targeting sequence with GTCN PAM
ccaaggccacguggcucagu

SEQ ID NO: 8519 - RNA, 20 nt, Artificial Sequence
  targeting sequence with GTCN PAM
cugucaggcauuuuuccugg

SEQ ID NO: 8520 - RNA, 20 nt, Artificial Sequence
  targeting sequence with GTCN PAM
ggcauuuuuccuggcuguga

SEQ ID NO: 8521 - RNA, 20 nt, Artificial Sequence
  targeting sequence with GTCN PAM
cacuugaggaggcauuucuc

SEQ ID NO: 8522 - RNA, 20 nt, Artificial Sequence
  targeting sequence with GTCN PAM
uugcucagggccagcugugc

SEQ ID NO: 8523 - RNA, 20 nt, Artificial Sequence
  targeting sequence with GTCN PAM
ccccucugugcaguggguac

SEQ ID NO: 8524 - RNA, 20 nt, Artificial Sequence
  targeting sequence with GTCN PAM
ggccucagucuccccucugu

SEQ ID NO: 8525 - RNA, 20 nt, Artificial Sequence
  targeting sequence with GTCN PAM
gguagauuuccgggagcacc

SEQ ID NO: 8526 - RNA, 20 nt, Artificial Sequence
  targeting sequence with GTCN PAM
caccggcagagccaucgcaa

SEQ ID NO: 8527 - RNA, 20 nt, Artificial Sequence
  targeting sequence with GTCN PAM
guaggcagcaccugggaggc

SEQ ID NO: 8528 - RNA, 20 nt, Artificial Sequence
  targeting sequence with GTCN PAM
guguccgcaccaggccccau

SEQ ID NO: 8529 - RNA, 20 nt, Artificial Sequence
  targeting sequence with GTCN PAM
gcaccaggccccauccucgg

SEQ ID NO: 8530 - RNA, 20 nt, Artificial Sequence
  targeting sequence with GTCN PAM
ggcucugccaugcuucuuag

SEQ ID NO: 8531 - RNA, 20 nt, Artificial Sequence
  targeting sequence with GTCN PAM
aagucuuucacugugagagg

SEQ ID NO: 8532 - RNA, 20 nt, Artificial Sequence
  targeting sequence with GTCN PAM
uucacugugagaggaaaaac

SEQ ID NO: 8533 - RNA, 20 nt, Artificial Sequence
  targeting sequence with GTCN PAM
ucauuucuguuucucuccuc

SEQ ID NO: 8534 - RNA, 20 nt, Artificial Sequence
  targeting sequence with GTCN PAM
uguuucuguuucucacucca

SEQ ID NO: 8535 - RNA, 20 nt, Artificial Sequence
  targeting sequence with GTCN PAM
cugcuucuguuucucucccc

SEQ ID NO: 8536 - RNA, 20 nt, Artificial Sequence
  targeting sequence with GTCN PAM
ccguuucuguuucucucucc

SEQ ID NO: 8537 - RNA, 20 nt, Artificial Sequence
  targeting sequence with GTCN PAM
cuuuggaucucugucuccgu

SEQ ID NO: 8538 - RNA, 20 nt, Artificial Sequence
  targeting sequence with GTCN PAM
gagagaaugagacagagaug

SEQ ID NO: 8539 - RNA, 20 nt, Artificial Sequence
  targeting sequence with GTCN PAM
cauucucucugacugucucu

SEQ ID NO: 8540 - RNA, 20 nt, Artificial Sequence
  targeting sequence with GTCN PAM
cugcaucucugucucauucu

SEQ ID NO: 8541 - RNA, 20 nt, Artificial Sequence
  targeting sequence with GTCN PAM
ccccaugcgucucugcaucu

SEQ ID NO: 8542 - RNA, 20 nt, Artificial Sequence
  targeting sequence with GTCN PAM
gggagagacggagagagaga

SEQ ID NO: 8543 - RNA, 20 nt, Artificial Sequence
  targeting sequence with GTCN PAM
cucccagacucagucucccc

SEQ ID NO: 8544 - RNA, 20 nt, Artificial Sequence
  targeting sequence with GTCN PAM
cuggaucucacuuaucucuc

SEQ ID NO: 8545 - RNA, 20 nt, Artificial Sequence
  targeting sequence with GTCN PAM
cgcucgcugugugucucugg

SEQ ID NO: 8546 - RNA, 20 nt, Artificial Sequence
  targeting sequence with GTCN PAM
uucucucucugccucacucu

SEQ ID NO: 8547 - RNA, 20 nt, Artificial Sequence
  targeting sequence with GTCN PAM
cugugugugugucuuucucu

SEQ ID NO: 8548 - RNA, 20 nt, Artificial Sequence
  targeting sequence with GTCN PAM
cuccaucccgggucacugug

SEQ ID NO: 8549 - RNA, 20 nt, Artificial Sequence
  targeting sequence with GTCN PAM
cuccuuccaagucccuccau

SEQ ID NO: 8550 - RNA, 20 nt, Artificial Sequence
  targeting sequence with GTCN PAM
cucccagcagccugggaauc

SEQ ID NO: 8551 - RNA, 20 nt, Artificial Sequence
  targeting sequence with GTCN PAM
cagucucucccagcagccug

SEQ ID NO: 8552 - RNA, 20 nt, Artificial Sequence
  targeting sequence with GTCN PAM
ccuucuaagguugagagcag

SEQ ID NO: 8553 - RNA, 20 nt, Artificial Sequence
  targeting sequence with GTCN PAM
cgggguccccuucuaagguu

SEQ ID NO: 8554 - RNA, 20 nt, Artificial Sequence
  targeting sequence with GTCN PAM
gaggguguggagggggcacu

SEQ ID NO: 8555 - RNA, 20 nt, Artificial Sequence
  targeting sequence with GTCN PAM
cugccucaagugcccccucc

SEQ ID NO: 8556 - RNA, 20 nt, Artificial Sequence
  targeting sequence with GTCN PAM
cagccuugggccaugucccu

SEQ ID NO: 8557 - RNA, 20 nt, Artificial Sequence
  targeting sequence with GTCN PAM
gggcagcagccaggccagaa

SEQ ID NO: 8558 - RNA, 20 nt, Artificial Sequence
  targeting sequence with GTCN PAM
gaggaggcuggccccgccca

SEQ ID NO: 8559 - RNA, 20 nt, Artificial Sequence
  targeting sequence with GTCN PAM
acacgcagccugggcucccu

SEQ ID NO: 8560 - RNA, 20 nt, Artificial Sequence
  targeting sequence with GTCN PAM
uucuugucuaugagacucau

SEQ ID NO: 8561 - RNA, 20 nt, Artificial Sequence
  targeting sequence with GTCN PAM
augagacucauggccaggga

SEQ ID NO: 8562 - RNA, 20 nt, Artificial Sequence
  targeting sequence with GTCN PAM
cauagacaagaaggacaaca

SEQ ID NO: 8563 - RNA, 20 nt, Artificial Sequence
  targeting sequence with GTCN PAM
gaggccggagguuggggugg

SEQ ID NO: 8564 - RNA, 20 nt, Artificial Sequence
  targeting sequence with GTCN PAM
uccaccacugaggugucguc

SEQ ID NO: 8565 - RNA, 20 nt, Artificial Sequence
  targeting sequence with GTCN PAM
uccaggucccgaaggaugua

SEQ ID NO: 8566 - RNA, 20 nt, Artificial Sequence
  targeting sequence with GTCN PAM
aggucccgaaggauguagcu

SEQ ID NO: 8567 - RNA, 20 nt, Artificial Sequence
  targeting sequence with GTCN PAM
cgaaggauguagcucugugu

SEQ ID NO: 8568 - RNA, 20 nt, Artificial Sequence
  targeting sequence with GTCN PAM
cccagagugguucgccucca

SEQ ID NO: 8569 - RNA, 20 nt, Artificial Sequence
  targeting sequence with GTCN PAM
cuugucccccagagugguuc

SEQ ID NO: 8570 - RNA, 20 nt, Artificial Sequence
  targeting sequence with GTCN PAM
gggcagggagcugggccuga

SEQ ID NO: 8571 - RNA, 20 nt, Artificial Sequence
  targeting sequence with GTCN PAM
gcaaggcuguucauguuaca

SEQ ID NO: 8572 - RNA, 20 nt, Artificial Sequence
  targeting sequence with GTCN PAM
ugguuaggccaaggguuuca

SEQ ID NO: 8573 - RNA, 20 nt, Artificial Sequence
  targeting sequence with GTCN PAM
ugaacuccugggcucaagcg

SEQ ID NO: 8574 - RNA, 20 nt, Artificial Sequence
  targeting sequence with GTCN PAM
ugcugugcugcccaggcugg

SEQ ID NO: 8575 - RNA, 20 nt, Artificial Sequence
  targeting sequence with GTCN PAM
cagcuacucaggaggcugaa

SEQ ID NO: 8576 - RNA, 20 nt, Artificial Sequence
  targeting sequence with GTCN PAM
aggcugcagugagcugagau

SEQ ID NO: 8577 - RNA, 20 nt, Artificial Sequence
  targeting sequence with GTCN PAM
cccaggcuggagugcagugg

SEQ ID NO: 8578 - RNA, 20 nt, Artificial Sequence
  targeting sequence with GTCN PAM
caaaaacaaacaaacaaacc

SEQ ID NO: 8579 - RNA, 20 nt, Artificial Sequence
  targeting sequence with GTCN PAM
guaguucacucacacugcag

SEQ ID NO: 8580 - RNA, 20 nt, Artificial Sequence
  targeting sequence with GTCN PAM
ugcagugugagugaacuacg

SEQ ID NO: 8581 - RNA, 20 nt, Artificial Sequence
  targeting sequence with GTCN PAM
ccuacagaguaagagcuucu

SEQ ID NO: 8582 - RNA, 20 nt, Artificial Sequence
  targeting sequence with GTCN PAM
ccacauucaugcacccaugc

SEQ ID NO: 8583 - RNA, 20 nt, Artificial Sequence
  targeting sequence with GTCN PAM
aggcaggggccagccccggc

SEQ ID NO: 8584 - RNA, 20 nt, Artificial Sequence
  targeting sequence with GTCN PAM
ggcgcuucagccggggcugg

SEQ ID NO: 8585 - RNA, 20 nt, Artificial Sequence
  targeting sequence with GTCN PAM
cugcccccauucccacccac

SEQ ID NO: 8586 - RNA, 20 nt, Artificial Sequence
  targeting sequence with GTCN PAM
acguccucugcacgcggcca

SEQ ID NO: 8587 - RNA, 20 nt, Artificial Sequence
  targeting sequence with GTCN PAM
accuuggugggugggaaugg

SEQ ID NO: 8588 - RNA, 20 nt, Artificial Sequence
  targeting sequence with GTCN PAM
ucugcacgcggccacuggga

SEQ ID NO: 8589 - RNA, 20 nt, Artificial Sequence
  targeting sequence with GTCN PAM
aggagaagauccuggaggcc

SEQ ID NO: 8590 - RNA, 20 nt, Artificial Sequence
  targeting sequence with GTCN PAM
gcgugucgguguccauggcc

SEQ ID NO: 8591 - RNA, 20 nt, Artificial Sequence
  targeting sequence with GTCN PAM
guguccauggcccgcacgcu

SEQ ID NO: 8592 - RNA, 20 nt, Artificial Sequence
  targeting sequence with GTCN PAM
auggcccgcacgcucagcga

SEQ ID NO: 8593 - RNA, 20 nt, Artificial Sequence
  targeting sequence with GTCN PAM
augccacagcccuggaagga

SEQ ID NO: 8594 - RNA, 20 nt, Artificial Sequence
  targeting sequence with GTCN PAM
uuccagggcuguggcaugga

SEQ ID NO: 8595 - RNA, 20 nt, Artificial Sequence
  targeting sequence with GTCN PAM
gugaguugcugccaucacua

SEQ ID NO: 8596 - RNA, 20 nt, Artificial Sequence
  targeting sequence with GTCN PAM
gugcccaggcagcaaggccc

SEQ ID NO: 8597 - RNA, 20 nt, Artificial Sequence
  targeting sequence with GTCN PAM
cagggcugcugugucgccgc

SEQ ID NO: 8598 - RNA, 20 nt, Artificial Sequence
  targeting sequence with GTCN PAM
gcagggcggggaggguccca

SEQ ID NO: 8599 - RNA, 20 nt, Artificial Sequence
  targeting sequence with GTCN PAM
auggagcccuuguugauuug

SEQ ID NO: 8600 - RNA, 20 nt, Artificial Sequence
  targeting sequence with GTCN PAM
ccugaggggcacggggguau

SEQ ID NO: 8601 - RNA, 20 nt, Artificial Sequence
  targeting sequence with GTCN PAM
cuugcccucucugagccucg

SEQ ID NO: 8602 - RNA, 20 nt, Artificial Sequence
  targeting sequence with GTCN PAM
gccgagccagguccgauucc

SEQ ID NO: 8603 - RNA, 20 nt, Artificial Sequence
  targeting sequence with GTCN PAM
caggcuugggagucagccga

SEQ ID NO: 8604 - RNA, 20 nt, Artificial Sequence
  targeting sequence with GTCN PAM
accuaaacucacacuugggg

SEQ ID NO: 8605 - RNA, 20 nt, Artificial Sequence
  targeting sequence with GTCN PAM
aggccacaucgguguuucgg

SEQ ID NO: 8606 - RNA, 20 nt, Artificial Sequence
  targeting sequence with GTCN PAM
ucagccugcaaguggggucg

SEQ ID NO: 8607 - RNA, 20 nt, Artificial Sequence
  targeting sequence with GTCN PAM
caggaggaauggggcucaau

SEQ ID NO: 8608 - RNA, 20 nt, Artificial Sequence
  targeting sequence with GTCN PAM
cugcucuugcccaucuccaa

SEQ ID NO: 8609 - RNA, 20 nt, Artificial Sequence
  targeting sequence with GTCN PAM
agcagagccacugccuggag

SEQ ID NO: 8610 - RNA, 20 nt, Artificial Sequence
  targeting sequence with GTCN PAM
cuugcugggcaauggccuug

SEQ ID NO: 8611 - RNA, 20 nt, Artificial Sequence
  targeting sequence with GTCN PAM
ugguccaauucuccaggucu

SEQ ID NO: 8612 - RNA, 20 nt, Artificial Sequence
  targeting sequence with GTCN PAM
aauucuccaggucuggggcg

SEQ ID NO: 8613 - RNA, 20 nt, Artificial Sequence
  targeting sequence with GTCN PAM
ggggcgugggaggcacugau

SEQ ID NO: 8614 - RNA, 20 nt, Artificial Sequence
  targeting sequence with GTCN PAM
aggguccacaguggcccuug

SEQ ID NO: 8615 - RNA, 20 nt, Artificial Sequence
  targeting sequence with GTCN PAM
acaguggcccuugugguucc

SEQ ID NO: 8616 - RNA, 20 nt, Artificial Sequence
  targeting sequence with GTCN PAM
aauggggccucugccccuga

SEQ ID NO: 8617 - RNA, 20 nt, Artificial Sequence
  targeting sequence with GTCN PAM
cacagcugggcugugccaaa

SEQ ID NO: 8618 - RNA, 20 nt, Artificial Sequence
  targeting sequence with GTCN PAM
aaucuuuggcacagcccagc

SEQ ID NO: 8619 - RNA, 20 nt, Artificial Sequence
  targeting sequence with GTCN PAM
ugggcuugaguccaaucuuu

SEQ ID NO: 8620 - RNA, 20 nt, Artificial Sequence
  targeting sequence with GTCN PAM
caaacuccugagcucaagca

SEQ ID NO: 8621 - RNA, 20 nt, Artificial Sequence
  targeting sequence with GTCN PAM
ugcuuuguugcacaggcugg

SEQ ID NO: 8622 - RNA, 20 nt, Artificial Sequence
  targeting sequence with GTCN PAM
agcugcccuaugguggcaga

SEQ ID NO: 8623 - RNA, 20 nt, Artificial Sequence
  targeting sequence with GTCN PAM
cacuguccagcugcccuaug

SEQ ID NO: 8624 - RNA, 20 nt, Artificial Sequence
  targeting sequence with GTCN PAM
ugucccacuguccagcugcc

SEQ ID NO: 8625 - RNA, 20 nt, Artificial Sequence
  targeting sequence with GTCN PAM
uucuggcagagugcaggagg

SEQ ID NO: 8626 - RNA, 20 nt, Artificial Sequence
  targeting sequence with GTCN PAM
cagcacaggguugccugcuc

SEQ ID NO: 8627 - RNA, 20 nt, Artificial Sequence
  targeting sequence with GTCN PAM
gaaggcuucaagguggcuuc

SEQ ID NO: 8628 - RNA, 20 nt, Artificial Sequence
  targeting sequence with GTCN PAM
cgccuagccuagggcuggga

SEQ ID NO: 8629 - RNA, 20 nt, Artificial Sequence
  targeting sequence with GTCN PAM
uccacccuucccugcucugg

SEQ ID NO: 8630 - RNA, 20 nt, Artificial Sequence
  targeting sequence with GTCN PAM
caucugugguuuucucaguc

SEQ ID NO: 8631 - RNA, 20 nt, Artificial Sequence
  targeting sequence with GTCN PAM
ggggccuugucccaucugug

SEQ ID NO: 8632 - RNA, 20 nt, Artificial Sequence
  targeting sequence with GTCN PAM
uacgggccuggccugucuca

SEQ ID NO: 8633 - RNA, 20 nt, Artificial Sequence
  targeting sequence with GTCN PAM
caugcaacacucccuccugg

SEQ ID NO: 8634 - RNA, 20 nt, Artificial Sequence
  targeting sequence with GTCN PAM
cugccgcugagucccugcca

SEQ ID NO: 8635 - RNA, 20 nt, Artificial Sequence
  targeting sequence with GTCN PAM
cugccacgucccccgccugg

SEQ ID NO: 8636 - RNA, 20 nt, Artificial Sequence
  targeting sequence with GTCN PAM
cccgccugggcucugucugu

SEQ ID NO: 8637 - RNA, 20 nt, Artificial Sequence
  targeting sequence with GTCN PAM
guccccaggcagccucaccc

SEQ ID NO: 8638 - RNA, 20 nt, Artificial Sequence
  targeting sequence with GTCN PAM
ccaggcagccucacccgcag

SEQ ID NO: 8639 - RNA, 20 nt, Artificial Sequence
  targeting sequence with GTCN PAM
gcgggugaggcugccugggg

SEQ ID NO: 8640 - RNA, 20 nt, Artificial Sequence
  targeting sequence with GTCN PAM
aucugcauguacagcugucu

SEQ ID NO: 8641 - RNA, 20 nt, Artificial Sequence
  targeting sequence with GTCN PAM
gugguggagaagaugcucac

SEQ ID NO: 8642 - RNA, 20 nt, Artificial Sequence
  targeting sequence with GTCN PAM
augagguccaccagcagcuc

SEQ ID NO: 8643 - RNA, 20 nt, Artificial Sequence
  targeting sequence with GTCN PAM
accagcagcuccuucaugau

SEQ ID NO: 8644 - RNA, 20 nt, Artificial Sequence
  targeting sequence with GTCN PAM
gcagcgaggccaggcugcac

SEQ ID NO: 8645 - RNA, 20 nt, Artificial Sequence
  targeting sequence with GTCN PAM
acugcaccuugaggcccuag

SEQ ID NO: 8646 - RNA, 20 nt, Artificial Sequence
  targeting sequence with GTCN PAM
cagggucucagugccgccuc

SEQ ID NO: 8647 - RNA, 20 nt, Artificial Sequence
  targeting sequence with GTCN PAM
gucacagccugaccugucgc

SEQ ID NO: 8648 - RNA, 20 nt, Artificial Sequence
  targeting sequence with GTCN PAM
cagccugaccugucgcgcac

SEQ ID NO: 8649 - RNA, 20 nt, Artificial Sequence
  targeting sequence with GTCN PAM
ggcugugacagacuggggug

SEQ ID NO: 8650 - RNA, 20 nt, Artificial Sequence
  targeting sequence with GTCN PAM
cgcaccgcaaaguccuucug

SEQ ID NO: 8651 - RNA, 20 nt, Artificial Sequence
  targeting sequence with GTCN PAM
uucugcugcuccagcgcgug

SEQ ID NO: 8652 - RNA, 20 nt, Artificial Sequence
  targeting sequence with GTCN PAM
acgcgcuggagcagcagaag

SEQ ID NO: 8653 - RNA, 20 nt, Artificial Sequence
  targeting sequence with GTCN PAM
uuguccacgcgcuggagcag

SEQ ID NO: 8654 - RNA, 20 nt, Artificial Sequence
  targeting sequence with GTCN PAM
agaggggcccagugucccug

SEQ ID NO: 8655 - RNA, 20 nt, Artificial Sequence
  targeting sequence with GTCN PAM
uaagcacuggcuguuaggcu

SEQ ID NO: 8656 - RNA, 20 nt, Artificial Sequence
  targeting sequence with GTCN PAM
ugggguacucaccuuccacu

SEQ ID NO: 8657 - RNA, 20 nt, Artificial Sequence
  targeting sequence with GTCN PAM
gggagggcagcacguaacgc

SEQ ID NO: 8658 - RNA, 20 nt, Artificial Sequence
  targeting sequence with GTCN PAM
gccucugcaguguuccuccc

SEQ ID NO: 8659 - RNA, 20 nt, Artificial Sequence
  targeting sequence with GTCN PAM
agccccgcugagaugcuggg

SEQ ID NO: 8660 - RNA, 20 nt, Artificial Sequence
  targeting sequence with GTCN PAM
cucacacagaaaggggcacu

SEQ ID NO: 8661 - RNA, 20 nt, Artificial Sequence
  targeting sequence with GTCN PAM
uuuauggggagcuaauuccg

SEQ ID NO: 8662 - RNA, 20 nt, Artificial Sequence
  targeting sequence with GTCN PAM
uguguggccacaccccugga

SEQ ID NO: 8663 - RNA, 20 nt, Artificial Sequence
  targeting sequence with GTCN PAM
ugugcugucuuguguggcca

SEQ ID NO: 8664 - RNA, 20 nt, Artificial Sequence
  targeting sequence with GTCN PAM
gagcuuuagccugaggcugg

SEQ ID NO: 8665 - RNA, 20 nt, Artificial Sequence
  targeting sequence with GTCN PAM
aacaugggcuugcuuuggcc

SEQ ID NO: 8666 - RNA, 20 nt, Artificial Sequence
  targeting sequence with GTCN PAM
acaccauuccccacacagug

SEQ ID NO: 8667 - RNA, 20 nt, Artificial Sequence
  targeting sequence with GTCN PAM
acuacccucacucuaccucc

SEQ ID NO: 8668 - RNA, 20 nt, Artificial Sequence
  targeting sequence with GTCN PAM
aguggacaggaggagggagu

SEQ ID NO: 8669 - RNA, 20 nt, Artificial Sequence
  targeting sequence with GTCN PAM
acuggacuccugccccaucc

SEQ ID NO: 8670 - RNA, 20 nt, Artificial Sequence
  targeting sequence with GTCN PAM
cuacacucccuccuccuguc

SEQ ID NO: 8671 - RNA, 20 nt, Artificial Sequence
  targeting sequence with GTCN PAM
caggccagccucucuccuuc

SEQ ID NO: 8672 - RNA, 20 nt, Artificial Sequence
  targeting sequence with GTCN PAM
uggccagcugggccugccuc

SEQ ID NO: 8673 - RNA, 20 nt, Artificial Sequence
  targeting sequence with GTCN PAM
auauggaagccagcugcagc

SEQ ID NO: 8674 - RNA, 20 nt, Artificial Sequence
  targeting sequence with GTCN PAM
uucucugcucacuugauguu

SEQ ID NO: 8675 - RNA, 20 nt, Artificial Sequence
  targeting sequence with GTCN PAM
uggccacuugcccuggccug

SEQ ID NO: 8676 - RNA, 20 nt, Artificial Sequence
  targeting sequence with GTCN PAM
gcagccguccuggccacuug

SEQ ID NO: 8677 - RNA, 20 nt, Artificial Sequence
  targeting sequence with GTCN PAM
cuugagcagugccaaaccug

SEQ ID NO: 8678 - RNA, 20 nt, Artificial Sequence
  targeting sequence with GTCN PAM
aguugccuugagguggcugg

SEQ ID NO: 8679 - RNA, 20 nt, Artificial Sequence
  targeting sequence with GTCN PAM
gcccgagccugagccugccc

SEQ ID NO: 8680 - RNA, 20 nt, Artificial Sequence
  targeting sequence with GTCN PAM
cgaagugcuuauacuccagg

SEQ ID NO: 8681 - RNA, 20 nt, Artificial Sequence
  targeting sequence with GTCN PAM
ugucugucugcagcucagcg

SEQ ID NO: 8682 - RNA, 20 nt, Artificial Sequence
  targeting sequence with GTCN PAM
gucugcagcucagcgaagcc

SEQ ID NO: 8683 - RNA, 20 nt, Artificial Sequence
  targeting sequence with GTCN PAM
gcagcucagcgaagccuggc

SEQ ID NO: 8684 - RNA, 20 nt, Artificial Sequence
  targeting sequence with GTCN PAM
gccaggcuucgcugagcugc

SEQ ID NO: 8685 - RNA, 20 nt, Artificial Sequence
  targeting sequence with GTCN PAM
guguguccgccaggcuucgc

SEQ ID NO: 8686 - RNA, 20 nt, Artificial Sequence
  targeting sequence with GTCN PAM
ccgcccacuaccuuugcgga

SEQ ID NO: 8687 - RNA, 20 nt, Artificial Sequence
  targeting sequence with GTCN PAM
ucugccaguaacgcucagca

SEQ ID NO: 8688 - RNA, 20 nt, Artificial Sequence
  targeting sequence with GTCN PAM
gcucuugguacagaagacga

SEQ ID NO: 8689 - RNA, 20 nt, Artificial Sequence
  targeting sequence with GTCN PAM
ucuguaccaagagccgacgu

SEQ ID NO: 8690 - RNA, 20 nt, Artificial Sequence
  targeting sequence with GTCN PAM
ggccucuggugcccuuugga

SEQ ID NO: 8691 - RNA, 20 nt, Artificial Sequence
  targeting sequence with GTCN PAM
ucccuccugggcaggguugg

SEQ ID NO: 8692 - RNA, 20 nt, Artificial Sequence
  targeting sequence with GTCN PAM
acgggagagcuccccgcaac

SEQ ID NO: 8693 - RNA, 20 nt, Artificial Sequence
  targeting sequence with GTCN PAM
ucaggcauugcuuugcuggc

SEQ ID NO: 8694 - RNA, 20 nt, Artificial Sequence
  targeting sequence with GTCN PAM
uuagaaaaagaaguguguag

SEQ ID NO: 8695 - RNA, 20 nt, Artificial Sequence
  targeting sequence with GTCN PAM
agccccguuaaaaaaaaaaa

SEQ ID NO: 8696 - RNA, 20 nt, Artificial Sequence
  targeting sequence with GTCN PAM
cccagaauccucccacccag

SEQ ID NO: 8697 - RNA, 20 nt, Artificial Sequence
  targeting sequence with GTCN PAM
uuguagaaggaauagaaaau

SEQ ID NO: 8698 - RNA, 20 nt, Artificial Sequence
  targeting sequence with GTCN PAM
cagcacuuugggaggccaag

SEQ ID NO: 8699 - RNA, 20 nt, Artificial Sequence
  targeting sequence with GTCN PAM
ucuuggggcagcaaaaaugc

SEQ ID NO: 8700 - RNA, 20 nt, Artificial Sequence
  targeting sequence with GTCN PAM
cuccccauucguguucuccc

SEQ ID NO: 8701 - RNA, 20 nt, Artificial Sequence
  targeting sequence with GTCN PAM
cuggcaaucaccauucagcu

SEQ ID NO: 8702 - RNA, 20 nt, Artificial Sequence
  targeting sequence with GTCN PAM
cuaugaauuucccuauucua

SEQ ID NO: 8703 - RNA, 20 nt, Artificial Sequence
  targeting sequence with GTCN PAM
ggugggcuauaccacuguua

SEQ ID NO: 8704 - RNA, 20 nt, Artificial Sequence
  targeting sequence with GTCN PAM
auagagagcuacugaaggua

SEQ ID NO: 8705 - RNA, 20 nt, Artificial Sequence
  targeting sequence with GTCN PAM
cugaaucucaagcagagaaa

SEQ ID NO: 8706 - RNA, 20 nt, Artificial Sequence
  targeting sequence with GTCN PAM
ugaggguggggcuccuuacc

SEQ ID NO: 8707 - RNA, 20 nt, Artificial Sequence
  targeting sequence with GTCN PAM
ugcugcugcucuccguggug

SEQ ID NO: 8708 - RNA, 20 nt, Artificial Sequence
  targeting sequence with GTCN PAM
ucugcagcguccugcugcug

SEQ ID NO: 8709 - RNA, 20 nt, Artificial Sequence
  targeting sequence with GTCN PAM
aucgucaucugcagcguccu

SEQ ID NO: 8710 - RNA, 20 nt, Artificial Sequence
  targeting sequence with GTCN PAM
cgcugccccccagcugcagu

SEQ ID NO: 8711 - RNA, 20 nt, Artificial Sequence
  targeting sequence with GTCN PAM
gguugaaguucccuaccugg

SEQ ID NO: 8712 - RNA, 20 nt, Artificial Sequence
  targeting sequence with GTCN PAM
aggaaagcuacaacccccuu

SEQ ID NO: 8713 - RNA, 20 nt, Artificial Sequence
  targeting sequence with GTCN PAM
accuccuggggacacuggga

SEQ ID NO: 8714 - RNA, 20 nt, Artificial Sequence
  targeting sequence with GTCN PAM
ccaggagguggacauuguua

SEQ ID NO: 8715 - RNA, 20 nt, Artificial Sequence
  targeting sequence with GTCN PAM
agcccuugguccugggccug

SEQ ID NO: 8716 - RNA, 20 nt, Artificial Sequence
  targeting sequence with GTCN PAM
ugggccuggcacagaggugg

SEQ ID NO: 8717 - RNA, 20 nt, Artificial Sequence
  targeting sequence with GTCN PAM
ccaaguaucugcaaggcugc

SEQ ID NO: 8718 - RNA, 20 nt, Artificial Sequence
  targeting sequence with GTCN PAM
cagggcagccuugcagauac

SEQ ID NO: 8719 - RNA, 20 nt, Artificial Sequence
  targeting sequence with GTCN PAM
ucauaccucaccuacccccu

SEQ ID NO: 8720 - RNA, 20 nt, Artificial Sequence
  targeting sequence with GTCN PAM
ugcacucugaguccucauac

SEQ ID NO: 8721 - RNA, 20 nt, Artificial Sequence
  targeting sequence with GTCN PAM
caguccugcacucugagucc

SEQ ID NO: 8722 - RNA, 20 nt, Artificial Sequence
  targeting sequence with GTCN PAM
gagccauccugggguggcac

SEQ ID NO: 8723 - RNA, 20 nt, Artificial Sequence
  targeting sequence with GTCN PAM
ccugggauggggagcucacu

SEQ ID NO: 8724 - RNA, 20 nt, Artificial Sequence
  targeting sequence with GTCN PAM
auccuagagccugggcugcc

SEQ ID NO: 8725 - RNA, 20 nt, Artificial Sequence
  targeting sequence with GTCN PAM
cccuuggcgucuauccuaga

SEQ ID NO: 8726 - RNA, 20 nt, Artificial Sequence
  targeting sequence with GTCN PAM
cugucccccuuggcgucuau

SEQ ID NO: 8727 - RNA, 20 nt, Artificial Sequence
  targeting sequence with GTCN PAM
agguccagauggggcccauc

SEQ ID NO: 8728 - RNA, 20 nt, Artificial Sequence
  targeting sequence with GTCN PAM
agauggggcccaucacugac

SEQ ID NO: 8729 - RNA, 20 nt, Artificial Sequence
  targeting sequence with GTCN PAM
gugaugggccccaucuggac

SEQ ID NO: 8730 - RNA, 20 nt, Artificial Sequence
  targeting sequence with GTCN PAM
cuaaguucuugggccucagu

SEQ ID NO: 8731 - RNA, 20 nt, Artificial Sequence
  targeting sequence with GTCN PAM
aguggggauguaaagcucug

SEQ ID NO: 8732 - RNA, 20 nt, Artificial Sequence
  targeting sequence with GTCN PAM
agcaaagcagagcuuuacau

SEQ ID NO: 8733 - RNA, 20 nt, Artificial Sequence
  targeting sequence with GTCN PAM
gcccugcuccggcgccccau

SEQ ID NO: 8734 - RNA, 20 nt, Artificial Sequence
  targeting sequence with GTCN PAM
cugggcgcggccguggggca

SEQ ID NO: 8735 - RNA, 20 nt, Artificial Sequence
  targeting sequence with GTCN PAM
acgagucccugggcgcggcc

SEQ ID NO: 8736 - RNA, 20 nt, Artificial Sequence
  targeting sequence with GTCN PAM
gagacaaucuggaugucgca

SEQ ID NO: 8737 - RNA, 20 nt, Artificial Sequence
  targeting sequence with GTCN PAM
cugacagaaucauccacugc

SEQ ID NO: 8738 - RNA, 20 nt, Artificial Sequence
  targeting sequence with GTCN PAM
cagcuuacuuggccuaucuu

SEQ ID NO: 8739 - RNA, 20 nt, Artificial Sequence
  targeting sequence with GTCN PAM
agauaggccaaguaagcugc

SEQ ID NO: 8740 - RNA, 20 nt, Artificial Sequence
  targeting sequence with GTCN PAM
cgaguaccgggucaagauag

SEQ ID NO: 8741 - RNA, 20 nt, Artificial Sequence
  targeting sequence with GTCN PAM
ugcuccuucugugggugcaa

SEQ ID NO: 8742 - RNA, 20 nt, Artificial Sequence
  targeting sequence with GTCN PAM
aggcggaaccugcugccccg

SEQ ID NO: 8743 - RNA, 20 nt, Artificial Sequence
  targeting sequence with GTCN PAM
aguagcuccucagccacagc

SEQ ID NO: 8744 - RNA, 20 nt, Artificial Sequence
  targeting sequence with GTCN PAM
gcguaggcccgcccauugau

SEQ ID NO: 8745 - RNA, 20 nt, Artificial Sequence
  targeting sequence with GTCN PAM
acuggcgcugaugcguugcu

SEQ ID NO: 8746 - RNA, 20 nt, Artificial Sequence
  targeting sequence with GTCN PAM
cccggggcccugagcaacgc

SEQ ID NO: 8747 - RNA, 20 nt, Artificial Sequence
  targeting sequence with GTCN PAM
auccugcaucccggccuggg

SEQ ID NO: 8748 - RNA, 20 nt, Artificial Sequence
  targeting sequence with GTCN PAM
ccucaaaccccacuccccac

SEQ ID NO: 8749 - RNA, 20 nt, Artificial Sequence
  targeting sequence with GTCN PAM
ccucuuccucccucugccuc

SEQ ID NO: 8750 - RNA, 20 nt, Artificial Sequence
  targeting sequence with GTCN PAM
guuagggcccuggcugugcc

SEQ ID NO: 8751 - RNA, 20 nt, Artificial Sequence
  targeting sequence with GTCN PAM
accacauuggccgggagccc

SEQ ID NO: 8752 - RNA, 20 nt, Artificial Sequence
  targeting sequence with GTCN PAM
auggccguccaccacauugg

SEQ ID NO: 8753 - RNA, 20 nt, Artificial Sequence
  targeting sequence with GTCN PAM
ugccgccacugcgggggaca

SEQ ID NO: 8754 - RNA, 20 nt, Artificial Sequence
  targeting sequence with GTCN PAM
cccgcaguggcggcaggacc

SEQ ID NO: 8755 - RNA, 20 nt, Artificial Sequence
  targeting sequence with GTCN PAM
caccugacagggcugcggcg

SEQ ID NO: 8756 - RNA, 20 nt, Artificial Sequence
  targeting sequence with GTCN PAM
ggugagacuggcaccccgcc

SEQ ID NO: 8757 - RNA, 20 nt, Artificial Sequence
  targeting sequence with GTCN PAM
ccgccgcagcccugucaggu

SEQ ID NO: 8758 - RNA, 20 nt, Artificial Sequence
  targeting sequence with GTCN PAM
ucacggccaucaguccccgc

SEQ ID NO: 8759 - RNA, 20 nt, Artificial Sequence
  targeting sequence with GTCN PAM
gggcugcgugcacggcaacc

SEQ ID NO: 8760 - RNA, 20 nt, Artificial Sequence
  targeting sequence with GTCN PAM
caggggcauuggcggugggu

SEQ ID NO: 8761 - RNA, 20 nt, Artificial Sequence
  targeting sequence with GTCN PAM
acgcacuuggccugggguuc

SEQ ID NO: 8762 - RNA, 20 nt, Artificial Sequence
  targeting sequence with GTCN PAM
aggaggccuugaaccccagg

SEQ ID NO: 8763 - RNA, 20 nt, Artificial Sequence
  targeting sequence with GTCN PAM
caacucaucuucugcccagu

SEQ ID NO: 8764 - RNA, 20 nt, Artificial Sequence
  targeting sequence with GTCN PAM
ucucucccgccuccaacccu

SEQ ID NO: 8765 - RNA, 20 nt, Artificial Sequence
  targeting sequence with GTCN PAM
cucuccccagaucccugaag

SEQ ID NO: 8766 - RNA, 20 nt, Artificial Sequence
  targeting sequence with GTCN PAM
gugccuucagggaucugggg

SEQ ID NO: 8767 - RNA, 20 nt, Artificial Sequence
  targeting sequence with GTCN PAM
gcccuucccuugaggucuau

SEQ ID NO: 8768 - RNA, 20 nt, Artificial Sequence
  targeting sequence with GTCN PAM
auguugugcuccucuuggug

SEQ ID NO: 8769 - RNA, 20 nt, Artificial Sequence
  targeting sequence with GTCN PAM
cagcaaugcccauuaguggg

SEQ ID NO: 8770 - RNA, 20 nt, Artificial Sequence
  targeting sequence with GTCN PAM
gguacacaauaagugcauaa

SEQ ID NO: 8771 - RNA, 20 nt, Artificial Sequence
  targeting sequence with GTCN PAM
uuauuaugcacuuauugugu

SEQ ID NO: 8772 - RNA, 20 nt, Artificial Sequence
  targeting sequence with GTCN PAM
guuggcgaaacaccuuuguc

SEQ ID NO: 8773 - RNA, 20 nt, Artificial Sequence
  targeting sequence with GTCN PAM
ccuaagccaagccccuucuc

SEQ ID NO: 8774 - RNA, 20 nt, Artificial Sequence
  targeting sequence with GTCN PAM
ucauuggcuguguccccuaa

SEQ ID NO: 8775 - RNA, 20 nt, Artificial Sequence
  targeting sequence with GTCN PAM
ccuccagcccgccagccccc

SEQ ID NO: 8776 - RNA, 20 nt, Artificial Sequence
  targeting sequence with GTCN PAM
gugucguucaccaggaccug

SEQ ID NO: 8777 - RNA, 20 nt, Artificial Sequence
  targeting sequence with GTCN PAM
uucaccaggaccuggagcuc

SEQ ID NO: 8778 - RNA, 20 nt, Artificial Sequence
  targeting sequence with GTCN PAM
uggugaacgacacagacccc

SEQ ID NO: 8779 - RNA, 20 nt, Artificial Sequence
  targeting sequence with GTCN PAM
uucccauggauggugauccu

SEQ ID NO: 8780 - RNA, 20 nt, Artificial Sequence
  targeting sequence with GTCN PAM
acucccuggagccuaccaug

SEQ ID NO: 8781 - RNA, 20 nt, Artificial Sequence
  targeting sequence with GTCN PAM
ggcccgcccagcacgcacac

SEQ ID NO: 8782 - RNA, 20 nt, Artificial Sequence
  targeting sequence with GTCN PAM
cgggacuugcccuccuuaga

SEQ ID NO: 8783 - RNA, 20 nt, Artificial Sequence
  targeting sequence with GTCN PAM
cgggaccgcuucuccuacgu

SEQ ID NO: 8784 - RNA, 20 nt, Artificial Sequence
  targeting sequence with GTCN PAM
ccacaccugagagugguccu

SEQ ID NO: 8785 - RNA, 20 nt, Artificial Sequence
  targeting sequence with GTCN PAM
uggggcuggcccugugacac

SEQ ID NO: 8786 - RNA, 20 nt, Artificial Sequence
  targeting sequence with GTCN PAM
cagggccagccccaggacca

SEQ ID NO: 8787 - RNA, 20 nt, Artificial Sequence
  targeting sequence with GTCN PAM
gccagcgguccuuggccccc

SEQ ID NO: 8788 - RNA, 20 nt, Artificial Sequence
  targeting sequence with GTCN PAM
uuggcccccacggccacccu

SEQ ID NO: 8789 - RNA, 20 nt, Artificial Sequence
  targeting sequence with GTCN PAM
uauaguugcagaacuguggg

SEQ ID NO: 8790 - RNA, 20 nt, Artificial Sequence
  targeting sequence with GTCN PAM
cacccccgugucuuauaguu

SEQ ID NO: 8791 - RNA, 20 nt, Artificial Sequence
  targeting sequence with GTCN PAM
cugaucaugagaacgucugc

SEQ ID NO: 8792 - RNA, 20 nt, Artificial Sequence
  targeting sequence with GTCN PAM
gcugggcugguagaugacgg

SEQ ID NO: 8793 - RNA, 20 nt, Artificial Sequence
  targeting sequence with GTCN PAM
ucuaccagcccagcagacgu

SEQ ID NO: 8794 - RNA, 20 nt, Artificial Sequence
  targeting sequence with GTCN PAM
cugcucacgcguauuuccua

SEQ ID NO: 8795 - RNA, 20 nt, Artificial Sequence
  targeting sequence with GTCN PAM
cagaucucuaaaccaugcca

SEQ ID NO: 8796 - RNA, 20 nt, Artificial Sequence
  targeting sequence with GTCN PAM
uccagaaagcagcagaguga

SEQ ID NO: 8797 - RNA, 20 nt, Artificial Sequence
  targeting sequence with GTCN PAM
ucacucugcugcuuucugga

SEQ ID NO: 8798 - RNA, 20 nt, Artificial Sequence
  targeting sequence with GTCN PAM
uccucacuccucccucccca

SEQ ID NO: 8799 - RNA, 20 nt, Artificial Sequence
  targeting sequence with GTCN PAM
gaggagugaguagccacggu

SEQ ID NO: 8800 - RNA, 20 nt, Artificial Sequence
  targeting sequence with GTCN PAM
ggcaguggcucacaggccac

SEQ ID NO: 8801 - RNA, 20 nt, Artificial Sequence
  targeting sequence with GTCN PAM
cugagccgccggcccagguu

SEQ ID NO: 8802 - RNA, 20 nt, Artificial Sequence
  targeting sequence with GTCN PAM
gcagggucccaccguccaac

SEQ ID NO: 8803 - RNA, 20 nt, Artificial Sequence
  targeting sequence with GTCN PAM
caccguccaacgggccacuc

SEQ ID NO: 8804 - RNA, 20 nt, Artificial Sequence
  targeting sequence with GTCN PAM
aacgggccacucaggggcuc

SEQ ID NO: 8805 - RNA, 20 nt, Artificial Sequence
  targeting sequence with GTCN PAM
ccuggcagauugagccccug

SEQ ID NO: 8806 - RNA, 20 nt, Artificial Sequence
  targeting sequence with GTCN PAM
caggcacccagcagggcaca

SEQ ID NO: 8807 - RNA, 20 nt, Artificial Sequence
  targeting sequence with GTCN PAM
gcacggcugugcccugcugg

SEQ ID NO: 8808 - RNA, 20 nt, Artificial Sequence
  targeting sequence with GTCN PAM
ggaggcucagguggggcugg

SEQ ID NO: 8809 - RNA, 20 nt, Artificial Sequence
  targeting sequence with GTCN PAM
cagccccaccugagccucca

SEQ ID NO: 8810 - RNA, 20 nt, Artificial Sequence
  targeting sequence with GTCN PAM
cugugcuggcaaggaggaug

SEQ ID NO: 8811 - RNA, 20 nt, Artificial Sequence
  targeting sequence with GTCN PAM
ccaggcccacgugggcucag

SEQ ID NO: 8812 - RNA, 20 nt, Artificial Sequence
  targeting sequence with GTCN PAM
ccuggaggaugcugagguca

SEQ ID NO: 8813 - RNA, 20 nt, Artificial Sequence
  targeting sequence with GTCN PAM
gcuuccaggagcaauguuug

SEQ ID NO: 8814 - RNA, 20 nt, Artificial Sequence
  targeting sequence with GTCN PAM
uugguggcuuuagugaucau

SEQ ID NO: 8815 - RNA, 20 nt, Artificial Sequence
  targeting sequence with GTCN PAM
ccugugcauguggagugaug

SEQ ID NO: 8816 - RNA, 20 nt, Artificial Sequence
  targeting sequence with GTCN PAM
ucgcggcccaggcacuggga

SEQ ID NO: 8817 - RNA, 20 nt, Artificial Sequence
  targeting sequence with GTCN PAM
gggcugcccauggcacaguu

SEQ ID NO: 8818 - RNA, 20 nt, Artificial Sequence
  targeting sequence with GTCN PAM
auaacugugccaugggcagc

SEQ ID NO: 8819 - RNA, 20 nt, Artificial Sequence
  targeting sequence with GTCN PAM
uggucuauaacugugccaug

SEQ ID NO: 8820 - RNA, 20 nt, Artificial Sequence
  targeting sequence with GTCN PAM
ccccagucauggucuauaac

SEQ ID NO: 8821 - RNA, 20 nt, Artificial Sequence
  targeting sequence with GTCN PAM
gccccgcucugcggugcaug

SEQ ID NO: 8822 - RNA, 20 nt, Artificial Sequence
  targeting sequence with GTCN PAM
ugggcucagggcuguccagg

SEQ ID NO: 8823 - RNA, 20 nt, Artificial Sequence
  targeting sequence with GTCN PAM
aggaaucgggcuggccgccc

SEQ ID NO: 8824 - RNA, 20 nt, Artificial Sequence
  targeting sequence with GTCN PAM
ugugcagcugcaaaagggca

SEQ ID NO: 8825 - RNA, 20 nt, Artificial Sequence
  targeting sequence with GTCN PAM
ccccacucaccaccaccugg

SEQ ID NO: 8826 - RNA, 20 nt, Artificial Sequence
  targeting sequence with GTCN PAM
cagcguacaacagacucauu

SEQ ID NO: 8827 - RNA, 20 nt, Artificial Sequence
  targeting sequence with GTCN PAM
guuguacgcugugaccaggu

SEQ ID NO: 8828 - RNA, 20 nt, Artificial Sequence
  targeting sequence with GTCN PAM
guuuacucagcaaauaugua

SEQ ID NO: 8829 - RNA, 20 nt, Artificial Sequence
  targeting sequence with GTCN PAM
cuguggcuggcagaugugac

SEQ ID NO: 8830 - RNA, 20 nt, Artificial Sequence
  targeting sequence with GTCN PAM
caucugccagccacagggac

SEQ ID NO: 8831 - RNA, 20 nt, Artificial Sequence
  targeting sequence with GTCN PAM
ggaagccucguggcaggggc

SEQ ID NO: 8832 - RNA, 20 nt, Artificial Sequence
  targeting sequence with GTCN PAM
cacgugguggccacgugccg

SEQ ID NO: 8833 - RNA, 20 nt, Artificial Sequence
  targeting sequence with GTCN PAM
uggaggcgugccagccaccc

SEQ ID NO: 8834 - RNA, 20 nt, Artificial Sequence
  targeting sequence with GTCN PAM
acgcuucccacccaggacgc

SEQ ID NO: 8835 - RNA, 20 nt, Artificial Sequence
  targeting sequence with GTCN PAM
ugggugggaagcguugacga

SEQ ID NO: 8836 - RNA, 20 nt, Artificial Sequence
  targeting sequence with GTCN PAM
agaaaggagcugcgucccca

SEQ ID NO: 8837 - RNA, 20 nt, Artificial Sequence
  targeting sequence with GTCN PAM
uugcaacuagccccgccccc

SEQ ID NO: 8838 - RNA, 20 nt, Artificial Sequence
  targeting sequence with GTCN PAM
agagcuaagcacaaguccag

SEQ ID NO: 8839 - RNA, 20 nt, Artificial Sequence
  targeting sequence with GTCN PAM
agcccuguguugugugaucu

SEQ ID NO: 8840 - RNA, 20 nt, Artificial Sequence
  targeting sequence with GTCN PAM
gggggcaguccugagggcuc

SEQ ID NO: 8841 - RNA, 20 nt, Artificial Sequence
  targeting sequence with GTCN PAM
ugagggcucugcagaggaaa

SEQ ID NO: 8842 - RNA, 20 nt, Artificial Sequence
  targeting sequence with GTCN PAM
cccucuccuucuguuuccuc

SEQ ID NO: 8843 - RNA, 20 nt, Artificial Sequence
  targeting sequence with GTCN PAM
cugggccucaccuuucccaa

SEQ ID NO: 8844 - RNA, 20 nt, Artificial Sequence
  targeting sequence with GTCN PAM
cugccccucccccaggccuc

SEQ ID NO: 8845 - RNA, 20 nt, Artificial Sequence
  targeting sequence with GTCN PAM
accuuagugaucgcucugag

SEQ ID NO: 8846 - RNA, 20 nt, Artificial Sequence
  targeting sequence with GTCN PAM
auaccucccagcucagagcg

SEQ ID NO: 8847 - RNA, 20 nt, Artificial Sequence
  targeting sequence with GTCN PAM
cauauuuugucccaaggccu

SEQ ID NO: 8848 - RNA, 20 nt, Artificial Sequence
  targeting sequence with GTCN PAM
ugcucucaucugguguagaa

SEQ ID NO: 8849 - RNA, 20 nt, Artificial Sequence
  targeting sequence with GTCN PAM
cuguccugcucucaucuggu

SEQ ID NO: 8850 - RNA, 20 nt, Artificial Sequence
  targeting sequence with GTCN PAM
cugaggggaaucagucccug

SEQ ID NO: 8851 - RNA, 20 nt, Artificial Sequence
  targeting sequence with GTCN PAM
agaccauuugcugaccacga

SEQ ID NO: 8852 - RNA, 20 nt, Artificial Sequence
  targeting sequence with GTCN PAM
ggacaacuggagccuuccug

SEQ ID NO: 8853 - RNA, 20 nt, Artificial Sequence
  targeting sequence with GTCN PAM
gcaaauggucuggacaacug

SEQ ID NO: 8854 - RNA, 20 nt, Artificial Sequence
  targeting sequence with GTCN PAM
gcuuugcggcuggcuggggc

SEQ ID NO: 8855 - RNA, 20 nt, Artificial Sequence
  targeting sequence with GTCN PAM
uccuggccccagcccacccg

SEQ ID NO: 8856 - RNA, 20 nt, Artificial Sequence
  targeting sequence with GTCN PAM
cugugugaacagcaggcagc

SEQ ID NO: 8857 - RNA, 20 nt, Artificial Sequence
  targeting sequence with GTCN PAM
uaguggugccguggucucug

SEQ ID NO: 8858 - RNA, 20 nt, Artificial Sequence
  targeting sequence with GTCN PAM
gagaauuacaguaacuagcc

SEQ ID NO: 8859 - RNA, 20 nt, Artificial Sequence
  targeting sequence with GTCN PAM
cauuuuauagauggggaaac

SEQ ID NO: 8860 - RNA, 20 nt, Artificial Sequence
  targeting sequence with GTCN PAM
cggugcgaggccucaccaaa

SEQ ID NO: 8861 - RNA, 20 nt, Artificial Sequence
  targeting sequence with GTCN PAM
gcacaguggcccuguuucug

SEQ ID NO: 8862 - RNA, 20 nt, Artificial Sequence
  targeting sequence with GTCN PAM
uccagcuguaccagcugccu

SEQ ID NO: 8863 - RNA, 20 nt, Artificial Sequence
  targeting sequence with GTCN PAM
uuaagguagugagcugccug

SEQ ID NO: 8864 - RNA, 20 nt, Artificial Sequence
  targeting sequence with GTCN PAM
uagauggugaaauuggccuu

SEQ ID NO: 8865 - RNA, 20 nt, Artificial Sequence
  targeting sequence with GTCN PAM
aggccaauuucaccaucuac

SEQ ID NO: 8866 - RNA, 20 nt, Artificial Sequence
  targeting sequence with GTCN PAM
augggcggaacaucgucaag

SEQ ID NO: 8867 - RNA, 20 nt, Artificial Sequence
  targeting sequence with GTCN PAM
gugagggucaaugggcggaa

SEQ ID NO: 8868 - RNA, 20 nt, Artificial Sequence
  targeting sequence with GTCN PAM
cguggucuggaauggauggg

SEQ ID NO: 8869 - RNA, 20 nt, Artificial Sequence
  targeting sequence with GTCN PAM
ggaauggaugggggagccag

SEQ ID NO: 8870 - RNA, 20 nt, Artificial Sequence
  targeting sequence with GTCN PAM
uccccuggcucccccaucca

SEQ ID NO: 8871 - RNA, 20 nt, Artificial Sequence
  targeting sequence with GTCN PAM
cucggcaggagguugcagua

SEQ ID NO: 8872 - RNA, 20 nt, Artificial Sequence
  targeting sequence with GTCN PAM
ccagauugccuacugcaacc

SEQ ID NO: 8873 - RNA, 20 nt, Artificial Sequence
  targeting sequence with GTCN PAM
caggcccugccuuuggucac

SEQ ID NO: 8874 - RNA, 20 nt, Artificial Sequence
  targeting sequence with GTCN PAM
caggccaucuccaugccacu

SEQ ID NO: 8875 - RNA, 20 nt, Artificial Sequence
  targeting sequence with GTCN PAM
aggcuaugcuccucacagcc

SEQ ID NO: 8876 - RNA, 20 nt, Artificial Sequence
  targeting sequence with GTCN PAM
cgagcugggucuugccuccc

SEQ ID NO: 8877 - RNA, 20 nt, Artificial Sequence
  targeting sequence with GTCN PAM
ugccucccccaggacucacu

SEQ ID NO: 8878 - RNA, 20 nt, Artificial Sequence
  targeting sequence with GTCN PAM
ugggggaggcaagacccagc

SEQ ID NO: 8879 - RNA, 20 nt, Artificial Sequence
  targeting sequence with GTCN PAM
ugccuuccgagaucgaugug

SEQ ID NO: 8880 - RNA, 20 nt, Artificial Sequence
  targeting sequence with GTCN PAM
uggcaggacagcggcugggg

SEQ ID NO: 8881 - RNA, 20 nt, Artificial Sequence
  targeting sequence with GTCN PAM
ugccaugaccguccugccuu

SEQ ID NO: 8882 - RNA, 20 nt, Artificial Sequence
  targeting sequence with GTCN PAM
agaaaugcugcuggcuggaa

SEQ ID NO: 8883 - RNA, 20 nt, Artificial Sequence
  targeting sequence with GTCN PAM
ugcugcaaggugcaccuggg

SEQ ID NO: 8884 - RNA, 20 nt, Artificial Sequence
  targeting sequence with GTCN PAM
ggacccaggucagcuccucc

SEQ ID NO: 8885 - RNA, 20 nt, Artificial Sequence
  targeting sequence with GTCN PAM
ugacccugcggugccacccc

SEQ ID NO: 8886 - RNA, 20 nt, Artificial Sequence
  targeting sequence with GTCN PAM
gcuccucccacccccacagc

SEQ ID NO: 8887 - RNA, 20 nt, Artificial Sequence
  targeting sequence with GTCN PAM
agcuguugcugguguccagc

SEQ ID NO: 8888 - RNA, 20 nt, Artificial Sequence
  targeting sequence with GTCN PAM
agccucaccgcgucuccagg

SEQ ID NO: 8889 - RNA, 20 nt, Artificial Sequence
  targeting sequence with GTCN PAM
ccagggcacaccagccgcag

SEQ ID NO: 8890 - RNA, 20 nt, Artificial Sequence
  targeting sequence with GTCN PAM
gccgcacccacgcagucccc

SEQ ID NO: 8891 - RNA, 20 nt, Artificial Sequence
  targeting sequence with GTCN PAM
ccacagguggagugcacguu

SEQ ID NO: 8892 - RNA, 20 nt, Artificial Sequence
  targeting sequence with GTCN PAM
ccgccugcaacgugcacucc

SEQ ID NO: 8893 - RNA, 20 nt, Artificial Sequence
  targeting sequence with GTCN PAM
cauugagcugggcccccacc

SEQ ID NO: 8894 - RNA, 20 nt, Artificial Sequence
  targeting sequence with GTCN PAM
caccaggugaggccagagcc

SEQ ID NO: 8895 - RNA, 20 nt, Artificial Sequence
  targeting sequence with GTCN PAM
ucagguaaagguaaccggag

SEQ ID NO: 8896 - RNA, 20 nt, Artificial Sequence
  targeting sequence with GTCN PAM
gcugggucaaacugcaugac

SEQ ID NO: 8897 - RNA, 20 nt, Artificial Sequence
  targeting sequence with GTCN PAM
aacugcaugacauggugcac

SEQ ID NO: 8898 - RNA, 20 nt, Artificial Sequence
  targeting sequence with GTCN PAM
ugcaguuugacccagcagac

SEQ ID NO: 8899 - RNA, 20 nt, Artificial Sequence
  targeting sequence with GTCN PAM
ccacccgccugcucaccacc

SEQ ID NO: 8900 - RNA, 20 nt, Artificial Sequence
  targeting sequence with GTCN PAM
ccuggguuuggccuccccug

SEQ ID NO: 8901 - RNA, 20 nt, Artificial Sequence
  targeting sequence with GTCN PAM
gggggcucugccuccccauc

SEQ ID NO: 8902 - RNA, 20 nt, Artificial Sequence
  targeting sequence with GTCN PAM
uggacccuucaggaggggug

SEQ ID NO: 8903 - RNA, 20 nt, Artificial Sequence
  targeting sequence with GTCN PAM
aagacaggauggggaggcag

SEQ ID NO: 8904 - RNA, 20 nt, Artificial Sequence
  targeting sequence with GTCN PAM
cgggcgugcaggggagggca

SEQ ID NO: 8905 - RNA, 20 nt, Artificial Sequence
  targeting sequence with GTCN PAM
ccaaggcaucccgcccugug

SEQ ID NO: 8906 - RNA, 20 nt, Artificial Sequence
  targeting sequence with GTCN PAM
aagccagaauccaaacccaa

SEQ ID NO: 8907 - RNA, 20 nt, Artificial Sequence
  targeting sequence with GTCN PAM
uauuuaaugcucauggcccg

SEQ ID NO: 8908 - RNA, 20 nt, Artificial Sequence
  targeting sequence with GTCN PAM
ggcccggggaagcugcuagg

SEQ ID NO: 8909 - RNA, 20 nt, Artificial Sequence
  targeting sequence with GTCN PAM
cauuccuccccccgacgccc

SEQ ID NO: 8910 - RNA, 20 nt, Artificial Sequence
  targeting sequence with GTCN PAM
gggggaggaaugagacgugc

SEQ ID NO: 8911 - RNA, 20 nt, Artificial Sequence
  targeting sequence with GTCN PAM
ggcaggccugguauugcauu

SEQ ID NO: 8912 - RNA, 20 nt, Artificial Sequence
  targeting sequence with GTCN PAM
aaggcuuaaggcuaggggug

SEQ ID NO: 8913 - RNA, 20 nt, Artificial Sequence
  targeting sequence with GTCN PAM
uccuccucccugcaccuugg

SEQ ID NO: 8914 - RNA, 20 nt, Artificial Sequence
  targeting sequence with GTCN PAM
cucagagccagagaagcuuc

SEQ ID NO: 8915 - RNA, 20 nt, Artificial Sequence
  targeting sequence with GTCN PAM
uccugaggaugacaauaccg

SEQ ID NO: 8916 - RNA, 20 nt, Artificial Sequence
  targeting sequence with GTCN PAM
uccucaggaggacacgcaga

SEQ ID NO: 8917 - RNA, 20 nt, Artificial Sequence
  targeting sequence with GTCN PAM
gagccccaccaaacucugcu

SEQ ID NO: 8918 - RNA, 20 nt, Artificial Sequence
  targeting sequence with GTCN PAM
ugucugggcccugccaggcc

SEQ ID NO: 8919 - RNA, 20 nt, Artificial Sequence
  targeting sequence with GTCN PAM
gggcccugccaggccccagg

SEQ ID NO: 8920 - RNA, 20 nt, Artificial Sequence
  targeting sequence with GTCN PAM
ggacaccucccaggccaguu

SEQ ID NO: 8921 - RNA, 20 nt, Artificial Sequence
  targeting sequence with GTCN PAM
ggaccacuggccccaucuca

SEQ ID NO: 8922 - RNA, 20 nt, Artificial Sequence
  targeting sequence with GTCN PAM
uggugaucuaacccggacaa

SEQ ID NO: 8923 - RNA, 20 nt, Artificial Sequence
  targeting sequence with GTCN PAM
ggguuagaucaccaggaccu

SEQ ID NO: 8924 - RNA, 20 nt, Artificial Sequence
  targeting sequence with GTCN PAM
cagccugagacacuccuguc

SEQ ID NO: 8925 - RNA, 20 nt, Artificial Sequence
  targeting sequence with GTCN PAM
caggcugggacaaagcccau

SEQ ID NO: 8926 - RNA, 20 nt, Artificial Sequence
  targeting sequence with GTCN PAM
cacguggccucuuggcggag

SEQ ID NO: 8927 - RNA, 20 nt, Artificial Sequence
  targeting sequence with GTCN PAM
aggcguccaguggacacuca

SEQ ID NO: 8928 - RNA, 20 nt, Artificial Sequence
  targeting sequence with GTCN PAM
aguggacacucaagucauuu

SEQ ID NO: 8929 - RNA, 20 nt, Artificial Sequence
  targeting sequence with GTCN PAM
acuggacgccuggacauagg

SEQ ID NO: 8930 - RNA, 20 nt, Artificial Sequence
  targeting sequence with GTCN PAM
uuuccacuccuucaaucauu

SEQ ID NO: 8931 - RNA, 20 nt, Artificial Sequence
  targeting sequence with GTCN PAM
ccagccaacccugcccugcu

SEQ ID NO: 8932 - RNA, 20 nt, Artificial Sequence
  targeting sequence with GTCN PAM
cacagcaggagcuggcccau

SEQ ID NO: 8933 - RNA, 20 nt, Artificial Sequence
  targeting sequence with GTCN PAM
acccagagccuaaagggcau

SEQ ID NO: 8934 - RNA, 20 nt, Artificial Sequence
  targeting sequence with GTCN PAM
gcccaggcaguggguugggg

SEQ ID NO: 8935 - RNA, 20 nt, Artificial Sequence
  targeting sequence with GTCN PAM
cccccaacccacugccuggg

SEQ ID NO: 8936 - RNA, 20 nt, Artificial Sequence
  targeting sequence with GTCN PAM
cccaagagggagcaggagag

SEQ ID NO: 8937 - RNA, 20 nt, Artificial Sequence
  targeting sequence with GTCN PAM
agggcugcaccugggggucu

SEQ ID NO: 8938 - RNA, 20 nt, Artificial Sequence
  targeting sequence with GTCN PAM
ggcccaggcuccgccauguc

SEQ ID NO: 8939 - RNA, 20 nt, Artificial Sequence
  targeting sequence with GTCN PAM
guccugccccagagcaggga

SEQ ID NO: 8940 - RNA, 20 nt, Artificial Sequence
  targeting sequence with GTCN PAM
ugccccagagcagggaaacu

SEQ ID NO: 8941 - RNA, 20 nt, Artificial Sequence
  targeting sequence with GTCN PAM
agggcuguaagcuguugugg

SEQ ID NO: 8942 - RNA, 20 nt, Artificial Sequence
  targeting sequence with GTCN PAM
aagggccagcaaauggcaga

SEQ ID NO: 8943 - RNA, 20 nt, Artificial Sequence
  targeting sequence with GTCN PAM
ggcuggaccuguagcagccc

SEQ ID NO: 8944 - RNA, 20 nt, Artificial Sequence
  targeting sequence with GTCN PAM
agccugacccuuuguuuucu

SEQ ID NO: 8945 - RNA, 20 nt, Artificial Sequence
  targeting sequence with GTCN PAM
guacacagggcugcuacagg

SEQ ID NO: 8946 - RNA, 20 nt, Artificial Sequence
  targeting sequence with GTCN PAM
gucuguacacagggcugcua

SEQ ID NO: 8947 - RNA, 20 nt, Artificial Sequence
  targeting sequence with GTCN PAM
acgggaggcuucucaaggua

SEQ ID NO: 8948 - RNA, 20 nt, Artificial Sequence
  targeting sequence with GTCN PAM
uccugggcacggucaacggg

SEQ ID NO: 8949 - RNA, 20 nt, Artificial Sequence
  targeting sequence with GTCN PAM
acaacuacacagcggucuuc

SEQ ID NO: 8950 - RNA, 20 nt, Artificial Sequence
  targeting sequence with GTCN PAM
auccugcagccccugaaggc

SEQ ID NO: 8951 - RNA, 20 nt, Artificial Sequence
  targeting sequence with GTCN PAM
agcugcucuggcuggagcug

SEQ ID NO: 8952 - RNA, 20 nt, Artificial Sequence
  targeting sequence with GTCN PAM
gaucccagcuccagaaccuu

SEQ ID NO: 8953 - RNA, 20 nt, Artificial Sequence
  targeting sequence with GTCN PAM
uguuccuacuuuauauccuc

SEQ ID NO: 8954 - RNA, 20 nt, Artificial Sequence
  targeting sequence with GTCN PAM
cguuuguguuugggccucag

SEQ ID NO: 8955 - RNA, 20 nt, Artificial Sequence
  targeting sequence with GTCN PAM
gggcaggccugggcuugggg

SEQ ID NO: 8956 - RNA, 20 nt, Artificial Sequence
  targeting sequence with GTCN PAM
gguuugauuuuaaagagucc

SEQ ID NO: 8957 - RNA, 20 nt, Artificial Sequence
  targeting sequence with GTCN PAM
agggaggccggccaggguga

SEQ ID NO: 8958 - RNA, 20 nt, Artificial Sequence
  targeting sequence with GTCN PAM
acaccagaugaccggaggcc

SEQ ID NO: 8959 - RNA, 20 nt, Artificial Sequence
  targeting sequence with GTCN PAM
ucugguguggacuccucugc

SEQ ID NO: 8960 - RNA, 20 nt, Artificial Sequence
  targeting sequence with GTCN PAM
gccucagcuuaacccgcugg

SEQ ID NO: 8961 - RNA, 20 nt, Artificial Sequence
  targeting sequence with GTCN PAM
cucuugccucggcuguuuuc

SEQ ID NO: 8962 - RNA, 20 nt, Artificial Sequence
  targeting sequence with GTCN PAM
ccacagcaaccaugggcuuu

SEQ ID NO: 8963 - RNA, 20 nt, Artificial Sequence
  targeting sequence with GTCN PAM
gcucugacccuaggaccacc

SEQ ID NO: 8964 - RNA, 20 nt, Artificial Sequence
  targeting sequence with GTCN PAM
gagcagacacccggcaggag

SEQ ID NO: 8965 - RNA, 20 nt, Artificial Sequence
  targeting sequence with GTCN PAM
uagggucagagcagacaccc

SEQ ID NO: 8966 - RNA, 20 nt, Artificial Sequence
  targeting sequence with GTCN PAM
ugcaagcugcuggggcuuug

SEQ ID NO: 8967 - RNA, 20 nt, Artificial Sequence
  targeting sequence with GTCN PAM
cccuguaaugugggcagaug

SEQ ID NO: 8968 - RNA, 20 nt, Artificial Sequence
  targeting sequence with GTCN PAM
gaaugcacagucccaugucc

SEQ ID NO: 8969 - RNA, 20 nt, Artificial Sequence
  targeting sequence with GTCN PAM
cauguccacaacagcccagc

SEQ ID NO: 8970 - RNA, 20 nt, Artificial Sequence
  targeting sequence with GTCN PAM
acaacagcccagcaucaccc

SEQ ID NO: 8971 - RNA, 20 nt, Artificial Sequence
  targeting sequence with GTCN PAM
gggcuguucccugaacuugc

SEQ ID NO: 8972 - RNA, 20 nt, Artificial Sequence
  targeting sequence with GTCN PAM
ugguauguucaaagguuccu

SEQ ID NO: 8973 - RNA, 20 nt, Artificial Sequence
  targeting sequence with GTCN PAM
cuuccuggaggccuguuuuc

SEQ ID NO: 8974 - RNA, 20 nt, Artificial Sequence
  targeting sequence with GTCN PAM
cagggucacuuccuggaggc

SEQ ID NO: 8975 - RNA, 20 nt, Artificial Sequence
  targeting sequence with GTCN PAM
uugcggaguugcacaguuau

SEQ ID NO: 8976 - RNA, 20 nt, Artificial Sequence
  targeting sequence with GTCN PAM
ccuuuucacuccucugcacc

SEQ ID NO: 8977 - RNA, 20 nt, Artificial Sequence
  targeting sequence with GTCN PAM
gaugggacugagugcgucca

SEQ ID NO: 8978 - RNA, 20 nt, Artificial Sequence
  targeting sequence with GTCN PAM
cauccgacacaugugugugu

SEQ ID NO: 8979 - RNA, 20 nt, Artificial Sequence
  targeting sequence with GTCN PAM
aucauggcuuaucauccagg

SEQ ID NO: 8980 - RNA, 20 nt, Artificial Sequence
  targeting sequence with GTCN PAM
cugcgggaugggggcugcuc

SEQ ID NO: 8981 - RNA, 20 nt, Artificial Sequence
  targeting sequence with GTCN PAM
caggaugucaugggcccauu

SEQ ID NO: 8982 - RNA, 20 nt, Artificial Sequence
  targeting sequence with GTCN PAM
ugggcccauuuugguaaaac

SEQ ID NO: 8983 - RNA, 20 nt, Artificial Sequence
  targeting sequence with GTCN PAM
caacaguaaacauaauaaca

SEQ ID NO: 8984 - RNA, 20 nt, Artificial Sequence
  targeting sequence with GTCN PAM
guucccaguaaauguggccu

SEQ ID NO: 8985 - RNA, 20 nt, Artificial Sequence
  targeting sequence with GTCN PAM
gugcacuggccugguacagu

SEQ ID NO: 8986 - RNA, 20 nt, Artificial Sequence
  targeting sequence with GTCN PAM
uaucucacagauggggaaac

SEQ ID NO: 8987 - RNA, 20 nt, Artificial Sequence
  targeting sequence with GTCN PAM
cgcccccagggcugacccag

SEQ ID NO: 8988 - RNA, 20 nt, Artificial Sequence
  targeting sequence with GTCN PAM
gcccugggggcgugacauug

SEQ ID NO: 8989 - RNA, 20 nt, Artificial Sequence
  targeting sequence with GTCN PAM
gcuaccugggucagcccugg

SEQ ID NO: 8990 - RNA, 20 nt, Artificial Sequence
  targeting sequence with GTCN PAM
aaaugcagcugaggcauggg

SEQ ID NO: 8991 - RNA, 20 nt, Artificial Sequence
  targeting sequence with GTCN PAM
ugcucugagccucugauguc

SEQ ID NO: 8992 - RNA, 20 nt, Artificial Sequence
  targeting sequence with GTCN PAM
ccggaaggcagcauuggaac

SEQ ID NO: 8993 - RNA, 20 nt, Artificial Sequence
  targeting sequence with GTCN PAM
cccgccgucauccuccggaa

SEQ ID NO: 8994 - RNA, 20 nt, Artificial Sequence
  targeting sequence with GTCN PAM
aggaguucuaggcuguagug

SEQ ID NO: 8995 - RNA, 20 nt, Artificial Sequence
  targeting sequence with GTCN PAM
acacuaaguucagcaucaau

SEQ ID NO: 8996 - RNA, 20 nt, Artificial Sequence
  targeting sequence with GTCN PAM
ccauauugaugcugaacuua

SEQ ID NO: 8997 - RNA, 20 nt, Artificial Sequence
  targeting sequence with GTCN PAM
cccgcucccgggaggucacc

SEQ ID NO: 8998 - RNA, 20 nt, Artificial Sequence
  targeting sequence with GTCN PAM
gaaacggagcagguuaaagu

SEQ ID NO: 8999 - RNA, 20 nt, Artificial Sequence
  targeting sequence with GTCN PAM
aggaaguguuagccgauacu

SEQ ID NO: 9000 - RNA, 20 nt, Artificial Sequence
  targeting sequence with GTCN PAM
gaaacacaauaguaucggcu

SEQ ID NO: 9001 - RNA, 20 nt, Artificial Sequence
  targeting sequence with GTCN PAM
ugucugaaacacaauaguau

SEQ ID NO: 9002 - RNA, 20 nt, Artificial Sequence
  targeting sequence with GTCN PAM
aggugagaggauggcugcuc

SEQ ID NO: 9003 - RNA, 20 nt, Artificial Sequence
  targeting sequence with GTCN PAM
uggaaaaugaagagggcugg

SEQ ID NO: 9004 - RNA, 20 nt, Artificial Sequence
  targeting sequence with GTCN PAM
guguagggggcaagaguggu

SEQ ID NO: 9005 - RNA, 20 nt, Artificial Sequence
  targeting sequence with GTCN PAM
cccccgauucaagcccuccc

SEQ ID NO: 9006 - RNA, 20 nt, Artificial Sequence
  targeting sequence with GTCN PAM
uggaaaccaugggagggcuu

SEQ ID NO: 9007 - RNA, 20 nt, Artificial Sequence
  targeting sequence with GTCN PAM
ccucaucuucuaacuccauu

SEQ ID NO: 9008 - RNA, 20 nt, Artificial Sequence
  targeting sequence with GTCN PAM
ugaggcaggaacgagcuugu

SEQ ID NO: 9009 - RNA, 20 nt, Artificial Sequence
  targeting sequence with GTCN PAM
gggcuggcacugagaggagg

SEQ ID NO: 9010 - RNA, 20 nt, Artificial Sequence
  targeting sequence with GTCN PAM
gguaggucagggcuggcacu

SEQ ID NO: 9011 - RNA, 20 nt, Artificial Sequence
  targeting sequence with GTCN PAM
ccaacuguaacacacacagg

SEQ ID NO: 9012 - RNA, 20 nt, Artificial Sequence
  targeting sequence with GTCN PAM
ccccagcugccccaaccagg

SEQ ID NO: 9013 - RNA, 20 nt, Artificial Sequence
  targeting sequence with GTCN PAM
caccccucagcaauccugca

SEQ ID NO: 9014 - RNA, 20 nt, Artificial Sequence
  targeting sequence with GTCN PAM
ccuuccagaacuuauguucc

SEQ ID NO: 9015 - RNA, 20 nt, Artificial Sequence
  targeting sequence with GTCN PAM
ucuggggccucccagguguc

SEQ ID NO: 9016 - RNA, 20 nt, Artificial Sequence
  targeting sequence with GTCN PAM
ggguaugcccaaagguguca

SEQ ID NO: 9017 - RNA, 20 nt, Artificial Sequence
  targeting sequence with GTCN PAM
ugggaaaaggcggaccaggc

SEQ ID NO: 9018 - RNA, 20 nt, Artificial Sequence
  targeting sequence with GTCN PAM
gccuuuucccaggaccccac

SEQ ID NO: 9019 - RNA, 20 nt, Artificial Sequence
  targeting sequence with GTCN PAM
gcgcggggugggggaggggg

SEQ ID NO: 9020 - RNA, 20 nt, Artificial Sequence
  targeting sequence with GTCN PAM
gcugcuccgaaugaucugug

SEQ ID NO: 9021 - RNA, 20 nt, Artificial Sequence
  targeting sequence with GTCN PAM
cccucccccagccugcaucc

SEQ ID NO: 9022 - RNA, 20 nt, Artificial Sequence
  targeting sequence with GTCN PAM
cgugucccccucccccagcc

SEQ ID NO: 9023 - RNA, 20 nt, Artificial Sequence
  targeting sequence with GTCN PAM
ccgagucccgugucccccuc

SEQ ID NO: 9024 - RNA, 20 nt, Artificial Sequence
  targeting sequence with GTCN PAM
aguccccgagucccgugucc

SEQ ID NO: 9025 - RNA, 20 nt, Artificial Sequence
  targeting sequence with GTCN PAM
ugagcaugcuggccucggcu

SEQ ID NO: 9026 - RNA, 20 nt, Artificial Sequence
  targeting sequence with GTCN PAM
ccagggacaguuagccucac

SEQ ID NO: 9027 - RNA, 20 nt, Artificial Sequence
  targeting sequence with GTCN PAM
cuggagaccaaguucagccg

SEQ ID NO: 9028 - RNA, 20 nt, Artificial Sequence
  targeting sequence with GTCN PAM
ggggguauuuugggccugug

SEQ ID NO: 9029 - RNA, 20 nt, Artificial Sequence
  targeting sequence with GTCN PAM
uccuuaaaggcuaaugagca

SEQ ID NO: 9030 - RNA, 20 nt, Artificial Sequence
  targeting sequence with GTCN PAM
uucaaaacucaaguucuccu

SEQ ID NO: 9031 - RNA, 20 nt, Artificial Sequence
  targeting sequence with GTCN PAM
cagggccaucuuucucucac

SEQ ID NO: 9032 - RNA, 20 nt, Artificial Sequence
  targeting sequence with GTCN PAM
gacccucccuaccuacaacc

SEQ ID NO: 9033 - RNA, 20 nt, Artificial Sequence
  targeting sequence with GTCN PAM
gaccagcuuugugugagaga

SEQ ID NO: 9034 - RNA, 20 nt, Artificial Sequence
  targeting sequence with GTCN PAM
ucgggaucaagccccagcag

SEQ ID NO: 9035 - RNA, 20 nt, Artificial Sequence
  targeting sequence with GTCN PAM
agccucgcauucaaggccuu

SEQ ID NO: 9036 - RNA, 20 nt, Artificial Sequence
  targeting sequence with GTCN PAM
cccuccucccucugccccac

SEQ ID NO: 9037 - RNA, 20 nt, Artificial Sequence
  targeting sequence with GTCN PAM
ccacagguccuggaaugugc

SEQ ID NO: 9038 - RNA, 20 nt, Artificial Sequence
  targeting sequence with GTCN PAM
uggaaugugcccacaccuca

SEQ ID NO: 9039 - RNA, 20 nt, Artificial Sequence
  targeting sequence with GTCN PAM
cuucagcagccaaugcccau

SEQ ID NO: 9040 - RNA, 20 nt, Artificial Sequence
  targeting sequence with GTCN PAM
ggacccaugcuguucccucu

SEQ ID NO: 9041 - RNA, 20 nt, Artificial Sequence
  targeting sequence with GTCN PAM
agacaccgggggcgcugaag

SEQ ID NO: 9042 - RNA, 20 nt, Artificial Sequence
  targeting sequence with GTCN PAM
gggcaugccuggagagggaa

SEQ ID NO: 9043 - RNA, 20 nt, Artificial Sequence
  targeting sequence with GTCN PAM
cacauuucccauggcagcac

SEQ ID NO: 9044 - RNA, 20 nt, Artificial Sequence
  targeting sequence with GTCN PAM
ugcaugugcugccaugggaa

SEQ ID NO: 9045 - RNA, 20 nt, Artificial Sequence
  targeting sequence with GTCN PAM
aaauuagguuccuuucuuuu

SEQ ID NO: 9046 - RNA, 20 nt, Artificial Sequence
  targeting sequence with GTCN PAM
uucacacuuuagucaaaauu

SEQ ID NO: 9047 - RNA, 20 nt, Artificial Sequence
  targeting sequence with GTCN PAM
gcugcuuucucucuaagucg

SEQ ID NO: 9048 - RNA, 20 nt, Artificial Sequence
  targeting sequence with GTCN PAM
agugacugagagcaacacgg

SEQ ID NO: 9049 - RNA, 20 nt, Artificial Sequence
  targeting sequence with GTCN PAM
cucgacuuagagagaaagca

SEQ ID NO: 9050 - RNA, 20 nt, Artificial Sequence
  targeting sequence with GTCN PAM
gaguuuuaaugggagagugg

SEQ ID NO: 9051 - RNA, 20 nt, Artificial Sequence
  targeting sequence with GTCN PAM
acacaauuacagcugguagu

SEQ ID NO: 9052 - RNA, 20 nt, Artificial Sequence
  targeting sequence with GTCN PAM
gcggcaggaugugaggccug

SEQ ID NO: 9053 - RNA, 20 nt, Artificial Sequence
  targeting sequence with GTCN PAM
cagguacagacugcauggcu

SEQ ID NO: 9054 - RNA, 20 nt, Artificial Sequence
  targeting sequence with GTCN PAM
guaccugugacggaaccgcu

SEQ ID NO: 9055 - RNA, 20 nt, Artificial Sequence
  targeting sequence with GTCN PAM
gguuuccuugccacagagcu

SEQ ID NO: 9056 - RNA, 20 nt, Artificial Sequence
  targeting sequence with GTCN PAM
uaauaccccaaagugaucau

SEQ ID NO: 9057 - RNA, 20 nt, Artificial Sequence
  targeting sequence with GTCN PAM
accucccaaagcgcugggau

SEQ ID NO: 9058 - RNA, 20 nt, Artificial Sequence
  targeting sequence with GTCN PAM
aggcugcagugagcuauaau

SEQ ID NO: 9059 - RNA, 20 nt, Artificial Sequence
  targeting sequence with GTCN PAM
gggugacagagacccugucu

SEQ ID NO: 9060 - RNA, 20 nt, Artificial Sequence
  targeting sequence with GTCN PAM
cccagacuggagugcggugg

SEQ ID NO: 9061 - RNA, 20 nt, Artificial Sequence
  targeting sequence with GTCN PAM
cugucacccagacuggagug

SEQ ID NO: 9062 - RNA, 20 nt, Artificial Sequence
  targeting sequence with GTCN PAM
cgaaaaaauaaaaauaaaaa

SEQ ID NO: 9063 - RNA, 20 nt, Artificial Sequence
  targeting sequence with GTCN PAM
ccuugcaguuuuuuuauuuu

SEQ ID NO: 9064 - RNA, 20 nt, Artificial Sequence
  targeting sequence with GTCN PAM
ccggccaggauguagugagc

SEQ ID NO: 9065 - RNA, 20 nt, Artificial Sequence
  targeting sequence with GTCN PAM
ggaccccccagcuccuccca

SEQ ID NO: 9066 - RNA, 20 nt, Artificial Sequence
  targeting sequence with GTCN PAM
agacagcccaguccccggcc

SEQ ID NO: 9067 - RNA, 20 nt, Artificial Sequence
  targeting sequence with GTCN PAM
gcuuucuuuuccaggagccc

SEQ ID NO: 9068 - RNA, 20 nt, Artificial Sequence
  targeting sequence with GTCN PAM
ggaguuuaguugggaguaaa

SEQ ID NO: 9069 - RNA, 20 nt, Artificial Sequence
  targeting sequence with GTCN PAM
aaacuaagaagccaacauuu

SEQ ID NO: 9070 - RNA, 20 nt, Artificial Sequence
  targeting sequence with GTCN PAM
ccuaguuucucccauugcua

SEQ ID NO: 9071 - RNA, 20 nt, Artificial Sequence
  targeting sequence with GTCN PAM
guacuaucuuuguaacuuuc

SEQ ID NO: 9072 - RNA, 20 nt, Artificial Sequence
  targeting sequence with GTCN PAM
caucuccugugcagcucaac

SEQ ID NO: 9073 - RNA, 20 nt, Artificial Sequence
  targeting sequence with GTCN PAM
acacaaacccaaacuuugcu

SEQ ID NO: 9074 - RNA, 20 nt, Artificial Sequence
  targeting sequence with GTCN PAM
gggccagauugaguggggcu

SEQ ID NO: 9075 - RNA, 20 nt, Artificial Sequence
  targeting sequence with GTCN PAM
ccgccaacuccucccucagc

SEQ ID NO: 9076 - RNA, 20 nt, Artificial Sequence
  targeting sequence with GTCN PAM
aagcugagggaggaguuggc

SEQ ID NO: 9077 - RNA, 20 nt, Artificial Sequence
  targeting sequence with GTCN PAM
uccugggcuccccugagugg

SEQ ID NO: 9078 - RNA, 20 nt, Artificial Sequence
  targeting sequence with GTCN PAM
acaggccaccacugagcccg

SEQ ID NO: 9079 - RNA, 20 nt, Artificial Sequence
  targeting sequence with GTCN PAM
agucucaguccagcagccca

SEQ ID NO: 9080 - RNA, 20 nt, Artificial Sequence
  targeting sequence with GTCN PAM
caguccagcagcccagccgc

SEQ ID NO: 9081 - RNA, 20 nt, Artificial Sequence
  targeting sequence with GTCN PAM
agcagcccagccgcacacag

SEQ ID NO: 9082 - RNA, 20 nt, Artificial Sequence
  targeting sequence with GTCN PAM
cagguguggcuucauacccu

SEQ ID NO: 9083 - RNA, 20 nt, Artificial Sequence
  targeting sequence with GTCN PAM
gggagucacagguguggcuu

SEQ ID NO: 9084 - RNA, 20 nt, Artificial Sequence
  targeting sequence with GTCN PAM
gcuugcacaguguucugaga

SEQ ID NO: 9085 - RNA, 20 nt, Artificial Sequence
  targeting sequence with GTCN PAM
ugcccccucccagggcuggc

SEQ ID NO: 9086 - RNA, 20 nt, Artificial Sequence
  targeting sequence with GTCN PAM
guccugcccccucccagggc

SEQ ID NO: 9087 - RNA, 20 nt, Artificial Sequence
  targeting sequence with GTCN PAM
uggguggccucuggcagcag

SEQ ID NO: 9088 - RNA, 20 nt, Artificial Sequence
  targeting sequence with GTCN PAM
ccucccuggcaugggggcug

SEQ ID NO: 9089 - RNA, 20 nt, Artificial Sequence
  targeting sequence with GTCN PAM
ccccugaaggcgcugguauu

SEQ ID NO: 9090 - RNA, 20 nt, Artificial Sequence
  targeting sequence with GTCN PAM
ggaagccuggccuuagccac

SEQ ID NO: 9091 - RNA, 20 nt, Artificial Sequence
  targeting sequence with GTCN PAM
gaagccucugcucuucucug

SEQ ID NO: 9092 - RNA, 20 nt, Artificial Sequence
  targeting sequence with GTCN PAM
uuugccguuugucugaagcc

SEQ ID NO: 9093 - RNA, 20 nt, Artificial Sequence
  targeting sequence with GTCN PAM
gccagagcugcuguguccuu

SEQ ID NO: 9094 - RNA, 20 nt, Artificial Sequence
  targeting sequence with GTCN PAM
gggaaaccaaggcaggccuc

SEQ ID NO: 9095 - RNA, 20 nt, Artificial Sequence
  targeting sequence with GTCN PAM
cccagcuccagggcuuugag

SEQ ID NO: 9096 - RNA, 20 nt, Artificial Sequence
  targeting sequence with GTCN PAM
ggauaaccucaaagcccugg

SEQ ID NO: 9097 - RNA, 20 nt, Artificial Sequence
  targeting sequence with GTCN PAM
agcuggucuggauaaccuca

SEQ ID NO: 9098 - RNA, 20 nt, Artificial Sequence
  targeting sequence with GTCN PAM
guguguuggcccucagggcg

SEQ ID NO: 9099 - RNA, 20 nt, Artificial Sequence
  targeting sequence with GTCN PAM
uuccaggccaugccuguuug

SEQ ID NO: 9100 - RNA, 20 nt, Artificial Sequence
  targeting sequence with GTCN PAM
caagccuggcuggauuaagg

SEQ ID NO: 9101 - RNA, 20 nt, Artificial Sequence
  targeting sequence with GTCN PAM
uuaauccagccaggcuugug

SEQ ID NO: 9102 - RNA, 20 nt, Artificial Sequence
  targeting sequence with GTCN PAM
cacaguagguccuuaaucca

SEQ ID NO: 9103 - RNA, 20 nt, Artificial Sequence
  targeting sequence with GTCN PAM
ggagccucagcuuucucauc

SEQ ID NO: 9104 - RNA, 20 nt, Artificial Sequence
  targeting sequence with GTCN PAM
cacagcucuuaccucacuau

SEQ ID NO: 9105 - RNA, 20 nt, Artificial Sequence
  targeting sequence with GTCN PAM
gagguucagaggggauggug

SEQ ID NO: 9106 - RNA, 20 nt, Artificial Sequence
  targeting sequence with GTCN PAM
uauuuuacagauguggaguc

SEQ ID NO: 9107 - RNA, 20 nt, Artificial Sequence
  targeting sequence with GTCN PAM
uuccauaagcccuagguggu

SEQ ID NO: 9108 - RNA, 20 nt, Artificial Sequence
  targeting sequence with GTCN PAM
gcauagcuaauugggaacau

SEQ ID NO: 9109 - RNA, 20 nt, Artificial Sequence
  targeting sequence with GTCN PAM
ucgggagcucccgagccucu

SEQ ID NO: 9110 - RNA, 20 nt, Artificial Sequence
  targeting sequence with GTCN PAM
cuguccucgggagcucccga

SEQ ID NO: 9111 - RNA, 20 nt, Artificial Sequence
  targeting sequence with GTCN PAM
aagcauccgaggcuggaugg

SEQ ID NO: 9112 - RNA, 20 nt, Artificial Sequence
  targeting sequence with GTCN PAM
uuggugagggcgguguagcc

SEQ ID NO: 9113 - RNA, 20 nt, Artificial Sequence
  targeting sequence with GTCN PAM
cugacucaagcagccauugu

SEQ ID NO: 9114 - RNA, 20 nt, Artificial Sequence
  targeting sequence with GTCN PAM
gcgacuguggcggugguucc

SEQ ID NO: 9115 - RNA, 20 nt, Artificial Sequence
  targeting sequence with GTCN PAM
agcuaacuaaacaauggcug

SEQ ID NO: 9116 - RNA, 20 nt, Artificial Sequence
  targeting sequence with GTCN PAM
aggggcugcguccagcuaac

SEQ ID NO: 9117 - RNA, 20 nt, Artificial Sequence
  targeting sequence with GTCN PAM
cagaggagcacaguguggga

SEQ ID NO: 9118 - RNA, 20 nt, Artificial Sequence
  targeting sequence with GTCN PAM
uuccaagcccuggaacaguu

SEQ ID NO: 9119 - RNA, 20 nt, Artificial Sequence
  targeting sequence with GTCN PAM
cuucaggggaggaagcuggg

SEQ ID NO: 9120 - RNA, 20 nt, Artificial Sequence
  targeting sequence with GTCN PAM
ccccagccccaggagggaac

SEQ ID NO: 9121 - RNA, 20 nt, Artificial Sequence
  targeting sequence with GTCN PAM
ccucgggguccagcccauau

SEQ ID NO: 9122 - RNA, 20 nt, Artificial Sequence
  targeting sequence with GTCN PAM
agcccauaugccuggccgca

SEQ ID NO: 9123 - RNA, 20 nt, Artificial Sequence
  targeting sequence with GTCN PAM
ugcugcagagcacagccugc

SEQ ID NO: 9124 - RNA, 20 nt, Artificial Sequence
  targeting sequence with GTCN PAM
cagagucaucgcacgaccgc

SEQ ID NO: 9125 - RNA, 20 nt, Artificial Sequence
  targeting sequence with GTCN PAM
ucgcacgaccgcuguggaca

SEQ ID NO: 9126 - RNA, 20 nt, Artificial Sequence
  targeting sequence with GTCN PAM
ugcgaugacucugggaccag

SEQ ID NO: 9127 - RNA, 20 nt, Artificial Sequence
  targeting sequence with GTCN PAM
acagcggucgugcgaugacu

SEQ ID NO: 9128 - RNA, 20 nt, Artificial Sequence
  targeting sequence with GTCN PAM
ucuuggcuguguccacagcg

SEQ ID NO: 9129 - RNA, 20 nt, Artificial Sequence
  targeting sequence with GTCN PAM
ccagcucauggaauccagcc

SEQ ID NO: 9130 - RNA, 20 nt, Artificial Sequence
  targeting sequence with GTCN PAM
ccucuguguccccagcucau

SEQ ID NO: 9131 - RNA, 20 nt, Artificial Sequence
  targeting sequence with GTCN PAM
cucuaccgaacuguuacuau

SEQ ID NO: 9132 - RNA, 20 nt, Artificial Sequence
  targeting sequence with GTCN PAM
gcuuugugcugagaccucuu

SEQ ID NO: 9133 - RNA, 20 nt, Artificial Sequence
  targeting sequence with GTCN PAM
cagcacaaagcagacugcac

SEQ ID NO: 9134 - RNA, 20 nt, Artificial Sequence
  targeting sequence with GTCN PAM
ccucaaacaaagauagcggg

SEQ ID NO: 9135 - RNA, 20 nt, Artificial Sequence
  targeting sequence with GTCN PAM
cggcaaggccccaguggggc

SEQ ID NO: 9136 - RNA, 20 nt, Artificial Sequence
  targeting sequence with GTCN PAM
uuuacccugaaacuugauaa

SEQ ID NO: 9137 - RNA, 20 nt, Artificial Sequence
  targeting sequence with GTCN PAM
accguccuuuacccugaaac

SEQ ID NO: 9138 - RNA, 20 nt, Artificial Sequence
  targeting sequence with GTCN PAM
agaucugggggccagcgcca

SEQ ID NO: 9139 - RNA, 20 nt, Artificial Sequence
  targeting sequence with GTCN PAM
gggcggucuguuugguucgg

SEQ ID NO: 9140 - RNA, 20 nt, Artificial Sequence
  targeting sequence with GTCN PAM
guuugguucggcccuggcuc

SEQ ID NO: 9141 - RNA, 20 nt, Artificial Sequence
  targeting sequence with GTCN PAM
gagccagggccgaaccaaac

SEQ ID NO: 9142 - RNA, 20 nt, Artificial Sequence
  targeting sequence with GTCN PAM
acguggcuggcacucagaga

SEQ ID NO: 9143 - RNA, 20 nt, Artificial Sequence
  targeting sequence with GTCN PAM
cugagugccagccacgugga

SEQ ID NO: 9144 - RNA, 20 nt, Artificial Sequence
  targeting sequence with GTCN PAM
ccacucgggaaccggcuggu

SEQ ID NO: 9145 - RNA, 20 nt, Artificial Sequence
  targeting sequence with GTCN PAM
gagcuggagaggcccucggg

SEQ ID NO: 9146 - RNA, 20 nt, Artificial Sequence
  targeting sequence with GTCN PAM
agccacagugggggcuccgg

SEQ ID NO: 9147 - RNA, 20 nt, Artificial Sequence
  targeting sequence with GTCN PAM
guauuggcccugccaggugc

SEQ ID NO: 9148 - RNA, 20 nt, Artificial Sequence
  targeting sequence with GTCN PAM
cuuccggaaccagaucagcc

SEQ ID NO: 9149 - RNA, 20 nt, Artificial Sequence
  targeting sequence with GTCN PAM
cuccuuuccccaaagcccug

SEQ ID NO: 9150 - RNA, 20 nt, Artificial Sequence
  targeting sequence with GTCN PAM
ugugggcugcggggagccag

SEQ ID NO: 9151 - RNA, 20 nt, Artificial Sequence
  targeting sequence with GTCN PAM
uuagccugcaggcaaggccc

SEQ ID NO: 9152 - RNA, 20 nt, Artificial Sequence
  targeting sequence with GTCN PAM
agugcugcuccaaccucccc

SEQ ID NO: 9153 - RNA, 20 nt, Artificial Sequence
  targeting sequence with GTCN PAM
gaugucaugaccuccucccu

SEQ ID NO: 9154 - RNA, 20 nt, Artificial Sequence
  targeting sequence with GTCN PAM
ugaccuccucccucaccauu

SEQ ID NO: 9155 - RNA, 20 nt, Artificial Sequence
  targeting sequence with GTCN PAM
ugacaucagacagaugccac

SEQ ID NO: 9156 - RNA, 20 nt, Artificial Sequence
  targeting sequence with GTCN PAM
aauuugucucucuugggggc

SEQ ID NO: 9157 - RNA, 20 nt, Artificial Sequence
  targeting sequence with GTCN PAM
cucuugggggcuguccugua

SEQ ID NO: 9158 - RNA, 20 nt, Artificial Sequence
  targeting sequence with GTCN PAM
uguagcaagcugagccuccu

SEQ ID NO: 9159 - RNA, 20 nt, Artificial Sequence
  targeting sequence with GTCN PAM
aagcucuggguggggagcuc

SEQ ID NO: 9160 - RNA, 20 nt, Artificial Sequence
  targeting sequence with GTCN PAM
ccacccacacauaccagagg

SEQ ID NO: 9161 - RNA, 20 nt, Artificial Sequence
  targeting sequence with GTCN PAM
acaccagggggucauccuaa

SEQ ID NO: 9162 - RNA, 20 nt, Artificial Sequence
  targeting sequence with GTCN PAM
uccuaaccccagcccgcgac

SEQ ID NO: 9163 - RNA, 20 nt, Artificial Sequence
  targeting sequence with GTCN PAM
cgggcugggguuaggaugac

SEQ ID NO: 9164 - RNA, 20 nt, Artificial Sequence
  targeting sequence with GTCN PAM
gccgaggccccugugagaag

SEQ ID NO: 9165 - RNA, 20 nt, Artificial Sequence
  targeting sequence with GTCN PAM
caguuuccucaccuuuaaaa

SEQ ID NO: 9166 - RNA, 20 nt, Artificial Sequence
  targeting sequence with GTCN PAM
gaaggggugaaugggcccau

SEQ ID NO: 9167 - RNA, 20 nt, Artificial Sequence
  targeting sequence with GTCN PAM
aagauuuuggaggaaugagg

SEQ ID NO: 9168 - RNA, 20 nt, Artificial Sequence
  targeting sequence with GTCN PAM
caggcgcuacagccagaagc

SEQ ID NO: 9169 - RNA, 20 nt, Artificial Sequence
  targeting sequence with GTCN PAM
cacaccacggugugaccuca

SEQ ID NO: 9170 - RNA, 20 nt, Artificial Sequence
  targeting sequence with GTCN PAM
caccguggugugugacugug

SEQ ID NO: 9171 - RNA, 20 nt, Artificial Sequence
  targeting sequence with GTCN PAM
agaaggguuaagcaucuugc

SEQ ID NO: 9172 - RNA, 20 nt, Artificial Sequence
  targeting sequence with GTCN PAM
auggaaggggaaacagaggu

SEQ ID NO: 9173 - RNA, 20 nt, Artificial Sequence
  targeting sequence with GTCN PAM
ugucauucagguucugggga

SEQ ID NO: 9174 - RNA, 20 nt, Artificial Sequence
  targeting sequence with GTCN PAM
uucagguucuggggagauua

SEQ ID NO: 9175 - RNA, 20 nt, Artificial Sequence
  targeting sequence with GTCN PAM
uaauuacugugguuguugcu

SEQ ID NO: 9176 - RNA, 20 nt, Artificial Sequence
  targeting sequence with GTCN PAM
gagggaaggcuuccuugcca

SEQ ID NO: 9177 - RNA, 20 nt, Artificial Sequence
  targeting sequence with GTCN PAM
gagaacggaggcccagguag

SEQ ID NO: 9178 - RNA, 20 nt, Artificial Sequence
  targeting sequence with GTCN PAM
caguacacgccacgcgucuu

SEQ ID NO: 9179 - RNA, 20 nt, Artificial Sequence
  targeting sequence with GTCN PAM
uuguucacggcagcaaccag

SEQ ID NO: 9180 - RNA, 20 nt, Artificial Sequence
  targeting sequence with GTCN PAM
ugguugcugccgugaacaaa

SEQ ID NO: 9181 - RNA, 20 nt, Artificial Sequence
  targeting sequence with GTCN PAM
ccauggagauuaaggaaacc

SEQ ID NO: 9182 - RNA, 20 nt, Artificial Sequence
  targeting sequence with GTCN PAM
caggcgggugaaucggacuu

SEQ ID NO: 9183 - RNA, 20 nt, Artificial Sequence
  targeting sequence with GTCN PAM
gauucacccgccugugacuc

SEQ ID NO: 9184 - RNA, 20 nt, Artificial Sequence
  targeting sequence with GTCN PAM
ucccugcgcucagcccacuu

SEQ ID NO: 9185 - RNA, 20 nt, Artificial Sequence
  targeting sequence with GTCN PAM
cauccguucuuggagccucc

SEQ ID NO: 9186 - RNA, 20 nt, Artificial Sequence
  targeting sequence with GTCN PAM
ugcacucaccuagcgaugug

SEQ ID NO: 9187 - RNA, 20 nt, Artificial Sequence
  targeting sequence with GTCN PAM
gcgcccuggauacgcccaca

SEQ ID NO: 9188 - RNA, 20 nt, Artificial Sequence
  targeting sequence with GTCN PAM
acccaggagggugagugggg

SEQ ID NO: 9189 - RNA, 20 nt, Artificial Sequence
  targeting sequence with GTCN PAM
gugugaaugaugguccaccc

SEQ ID NO: 9190 - RNA, 20 nt, Artificial Sequence
  targeting sequence with GTCN PAM
gaaaaugcgaucaucagccu

SEQ ID NO: 9191 - RNA, 20 nt, Artificial Sequence
  targeting sequence with GTCN PAM
ggggaggcaaggaacuucua

SEQ ID NO: 9192 - RNA, 20 nt, Artificial Sequence
  targeting sequence with GTCN PAM
gcccccaucccccagcaugu

SEQ ID NO: 9193 - RNA, 20 nt, Artificial Sequence
  targeting sequence with GTCN PAM
cugcuaucacaaugggcccu

SEQ ID NO: 9194 - RNA, 20 nt, Artificial Sequence
  targeting sequence with GTCN PAM
ucuuccugguggcuggugag

SEQ ID NO: 9195 - RNA, 20 nt, Artificial Sequence
  targeting sequence with GTCN PAM
ggauccgcagauagaagcag

SEQ ID NO: 9196 - RNA, 20 nt, Artificial Sequence
  targeting sequence with GTCN PAM
cuuccccucucuuggccuca

SEQ ID NO: 9197 - RNA, 20 nt, Artificial Sequence
  targeting sequence with GTCN PAM
ucaucauccccagcuuacag

SEQ ID NO: 9198 - RNA, 20 nt, Artificial Sequence
  targeting sequence with GTCN PAM
gccugaccaggggaggggca

SEQ ID NO: 9199 - RNA, 20 nt, Artificial Sequence
  targeting sequence with GTCN PAM
ggcagacagugcgucaucau

SEQ ID NO: 9200 - RNA, 20 nt, Artificial Sequence
  targeting sequence with GTCN PAM
accauguaggugcuuauaaa

SEQ ID NO: 9201 - RNA, 20 nt, Artificial Sequence
  targeting sequence with GTCN PAM
ccgagcucgcgcucugcagg

SEQ ID NO: 9202 - RNA, 20 nt, Artificial Sequence
  targeting sequence with GTCN PAM
ugaaggcaagaggccugugg

SEQ ID NO: 9203 - RNA, 20 nt, Artificial Sequence
  targeting sequence with GTCN PAM
agggcagcacugucuugaag

SEQ ID NO: 9204 - RNA, 20 nt, Artificial Sequence
  targeting sequence with GTCN PAM
cuagugcccgggcugaggag

SEQ ID NO: 9205 - RNA, 20 nt, Artificial Sequence
  targeting sequence with GTCN PAM
cugugcuggggcugggacag

SEQ ID NO: 9206 - RNA, 20 nt, Artificial Sequence
  targeting sequence with GTCN PAM
cagccccagcacagagacug

SEQ ID NO: 9207 - RNA, 20 nt, Artificial Sequence
  targeting sequence with GTCN PAM
cacccaccccugccugccuu

SEQ ID NO: 9208 - RNA, 20 nt, Artificial Sequence
  targeting sequence with GTCN PAM
gggccuuggaggagaugaga

SEQ ID NO: 9209 - RNA, 20 nt, Artificial Sequence
  targeting sequence with GTCN PAM
acugaggccaguuuuuucug

SEQ ID NO: 9210 - RNA, 20 nt, Artificial Sequence
  targeting sequence with GTCN PAM
uuucucccucuugauacuaa

SEQ ID NO: 9211 - RNA, 20 nt, Artificial Sequence
  targeting sequence with GTCN PAM
cucucagccuacucuggcuu

SEQ ID NO: 9212 - RNA, 20 nt, Artificial Sequence
  targeting sequence with GTCN PAM
uaugccucccuccuaggaug

SEQ ID NO: 9213 - RNA, 20 nt, Artificial Sequence
  targeting sequence with GTCN PAM
uuuacccucucugggccuca

SEQ ID NO: 9214 - RNA, 20 nt, Artificial Sequence
  targeting sequence with GTCN PAM
cagggccagucauuuacccu

SEQ ID NO: 9215 - RNA, 20 nt, Artificial Sequence
  targeting sequence with GTCN PAM
auaagcugugugucccaggg

SEQ ID NO: 9216 - RNA, 20 nt, Artificial Sequence
  targeting sequence with GTCN PAM
agacauucucagggcuggga

SEQ ID NO: 9217 - RNA, 20 nt, Artificial Sequence
  targeting sequence with GTCN PAM
cgacccccagguacaugggc

SEQ ID NO: 9218 - RNA, 20 nt, Artificial Sequence
  targeting sequence with GTCN PAM
ccugguccaagcccuaucug

SEQ ID NO: 9219 - RNA, 20 nt, Artificial Sequence
  targeting sequence with GTCN PAM
aagcccuaucuguuucucca

SEQ ID NO: 9220 - RNA, 20 nt, Artificial Sequence
  targeting sequence with GTCN PAM
ucucagccaauccuccuaga

SEQ ID NO: 9221 - RNA, 20 nt, Artificial Sequence
  targeting sequence with GTCN PAM
cugcuugcacccuucgucac

SEQ ID NO: 9222 - RNA, 20 nt, Artificial Sequence
  targeting sequence with GTCN PAM
cugggagaucacucccagcc

SEQ ID NO: 9223 - RNA, 20 nt, Artificial Sequence
  targeting sequence with GTCN PAM
ucuugacgacgugcacccac

SEQ ID NO: 9224 - RNA, 20 nt, Artificial Sequence
  targeting sequence with GTCN PAM
agaagacauuuuuuugcacc

SEQ ID NO: 9225 - RNA, 20 nt, Artificial Sequence
  targeting sequence with GTCN PAM
ucaagaagacauuuuuuugc

SEQ ID NO: 9226 - RNA, 20 nt, Artificial Sequence
  targeting sequence with GTCN PAM
uuuuauaguaaagguggaaa

SEQ ID NO: 9227 - RNA, 20 nt, Artificial Sequence
  targeting sequence with GTCN PAM
gugcagcauuuucaaggugu

SEQ ID NO: 9228 - RNA, 20 nt, Artificial Sequence
  targeting sequence with GTCN PAM
guauuccuuuuguuuuaaaa

SEQ ID NO: 9229 - RNA, 20 nt, Artificial Sequence
  targeting sequence with GTCN PAM
uucauagguuggggagaaag

SEQ ID NO: 9230 - RNA, 20 nt, Artificial Sequence
  targeting sequence with GTCN PAM
uucuccccaaccuaugaaug

SEQ ID NO: 9231 - RNA, 20 nt, Artificial Sequence
  targeting sequence with GTCN PAM
accuuccuuccccaagucuu

SEQ ID NO: 9232 - RNA, 20 nt, Artificial Sequence
  targeting sequence with GTCN PAM
gccccaccuuguugggugau

SEQ ID NO: 9233 - RNA, 20 nt, Artificial Sequence
  targeting sequence with GTCN PAM
cugauuguuuucaacguauu

SEQ ID NO: 9234 - RNA, 20 nt, Artificial Sequence
  targeting sequence with GTCN PAM
ccaaauuugucccugauugu

SEQ ID NO: 9235 - RNA, 20 nt, Artificial Sequence
  targeting sequence with GTCN PAM
ccgcagcccucagaaguccc

SEQ ID NO: 9236 - RNA, 20 nt, Artificial Sequence
  targeting sequence with GTCN PAM
ugucagcugggaacccggaa

SEQ ID NO: 9237 - RNA, 20 nt, Artificial Sequence
  targeting sequence with GTCN PAM
gcugggaacccggaaugucg

SEQ ID NO: 9238 - RNA, 20 nt, Artificial Sequence
  targeting sequence with GTCN PAM
ggaggccauccugacccagg

SEQ ID NO: 9239 - RNA, 20 nt, Artificial Sequence
  targeting sequence with GTCN PAM
ggauggccucccgacauucc

SEQ ID NO: 9240 - RNA, 20 nt, Artificial Sequence
  targeting sequence with GTCN PAM
cacgaagaacccugggcccu

SEQ ID NO: 9241 - RNA, 20 nt, Artificial Sequence
  targeting sequence with GTCN PAM
uucggcccugggguccugcc

SEQ ID NO: 9242 - RNA, 20 nt, Artificial Sequence
  targeting sequence with GTCN PAM
ugccccaugugcagccccac

SEQ ID NO: 9243 - RNA, 20 nt, Artificial Sequence
  targeting sequence with GTCN PAM
cuggcacuggguggccuggg

SEQ ID NO: 9244 - RNA, 20 nt, Artificial Sequence
  targeting sequence with GTCN PAM
caucuggcuggauuucucug

SEQ ID NO: 9245 - RNA, 20 nt, Artificial Sequence
  targeting sequence with GTCN PAM
ggggagaaccaggagccuag

SEQ ID NO: 9246 - RNA, 20 nt, Artificial Sequence
  targeting sequence with GTCN PAM
ggcucagcaacaggauagau

SEQ ID NO: 9247 - RNA, 20 nt, Artificial Sequence
  targeting sequence with GTCN PAM
agagcccaccugccacccuc

SEQ ID NO: 9248 - RNA, 20 nt, Artificial Sequence
  targeting sequence with GTCN PAM
gcagcagugcugagggcuug

SEQ ID NO: 9249 - RNA, 20 nt, Artificial Sequence
  targeting sequence with GTCN PAM
ccagagaacaaggccggccc

SEQ ID NO: 9250 - RNA, 20 nt, Artificial Sequence
  targeting sequence with GTCN PAM
caaauauaucuugagcacuu

SEQ ID NO: 9251 - RNA, 20 nt, Artificial Sequence
  targeting sequence with GTCN PAM
uugcaaacaggcgccaggua

SEQ ID NO: 9252 - RNA, 20 nt, Artificial Sequence
  targeting sequence with GTCN PAM
ccccgcugcagaaggggaau

SEQ ID NO: 9253 - RNA, 20 nt, Artificial Sequence
  targeting sequence with GTCN PAM
cagcaggcaccugagucucc

SEQ ID NO: 9254 - RNA, 20 nt, Artificial Sequence
  targeting sequence with GTCN PAM
ugggagccaugaaggguuuu

SEQ ID NO: 9255 - RNA, 20 nt, Artificial Sequence
  targeting sequence with GTCN PAM
agacucccaaggacggucuc

SEQ ID NO: 9256 - RNA, 20 nt, Artificial Sequence
  targeting sequence with GTCN PAM
ggacuuuauccugggguccu

SEQ ID NO: 9257 - RNA, 20 nt, Artificial Sequence
  targeting sequence with GTCN PAM
uugggagucuggacuuuauc

SEQ ID NO: 9258 - RNA, 20 nt, Artificial Sequence
  targeting sequence with GTCN PAM
ccccaggccucccuggcccu

SEQ ID NO: 9259 - RNA, 20 nt, Artificial Sequence
  targeting sequence with GTCN PAM
ugugcuucccacucuacucg

SEQ ID NO: 9260 - RNA, 20 nt, Artificial Sequence
  targeting sequence with GTCN PAM
gcguggccaggcgaguagag

SEQ ID NO: 9261 - RNA, 20 nt, Artificial Sequence
  targeting sequence with GTCN PAM
cacauccguccucggcucac

SEQ ID NO: 9262 - RNA, 20 nt, Artificial Sequence
  targeting sequence with GTCN PAM
ucggcucaccugcccagccc

SEQ ID NO: 9263 - RNA, 20 nt, Artificial Sequence
  targeting sequence with GTCN PAM
caugcugugcccuggggagc

SEQ ID NO: 9264 - RNA, 20 nt, Artificial Sequence
  targeting sequence with GTCN PAM
cuauugugagcccaguccca

SEQ ID NO: 9265 - RNA, 20 nt, Artificial Sequence
  targeting sequence with GTCN PAM
auggaggugucaucuggggc

SEQ ID NO: 9266 - RNA, 20 nt, Artificial Sequence
  targeting sequence with GTCN PAM
ucuggggcuagaaguaggag

SEQ ID NO: 9267 - RNA, 20 nt, Artificial Sequence
  targeting sequence with GTCN PAM
uggagagcaguugccuaauc

SEQ ID NO: 9268 - RNA, 20 nt, Artificial Sequence
  targeting sequence with GTCN PAM
cugcuugguccuggagagca

SEQ ID NO: 9269 - RNA, 20 nt, Artificial Sequence
  targeting sequence with GTCN PAM
cuuagaguaauaacaagaag

SEQ ID NO: 9270 - RNA, 20 nt, Artificial Sequence
  targeting sequence with GTCN PAM
uuaaaacaaugcuuugggau

SEQ ID NO: 9271 - RNA, 20 nt, Artificial Sequence
  targeting sequence with GTCN PAM
ccacuucacagaugaagaaa

SEQ ID NO: 9272 - RNA, 20 nt, Artificial Sequence
  targeting sequence with GTCN PAM
cacagcugggaagugacaaa

SEQ ID NO: 9273 - RNA, 20 nt, Artificial Sequence
  targeting sequence with GTCN PAM
cuucccagcugugugaccuu

SEQ ID NO: 9274 - RNA, 20 nt, Artificial Sequence
  targeting sequence with GTCN PAM
cacuuugucacuucccagcu

SEQ ID NO: 9275 - RNA, 20 nt, Artificial Sequence
  targeting sequence with GTCN PAM
agguucugaaucugucgcug

SEQ ID NO: 9276 - RNA, 20 nt, Artificial Sequence
  targeting sequence with GTCN PAM
cugcauagcuggcaacagcc

SEQ ID NO: 9277 - RNA, 20 nt, Artificial Sequence
  targeting sequence with GTCN PAM
gggccucuagcaugggcagg

SEQ ID NO: 9278 - RNA, 20 nt, Artificial Sequence
  targeting sequence with GTCN PAM
ccggucugggccucuagcau

SEQ ID NO: 9279 - RNA, 20 nt, Artificial Sequence
  targeting sequence with GTCN PAM
cccucccuguguuuuccaca

SEQ ID NO: 9280 - RNA, 20 nt, Artificial Sequence
  targeting sequence with GTCN PAM
uggggcugugucccuggaga

SEQ ID NO: 9281 - RNA, 20 nt, Artificial Sequence
  targeting sequence with GTCN PAM
cuggagaggcccuguccccu

SEQ ID NO: 9282 - RNA, 20 nt, Artificial Sequence
  targeting sequence with GTCN PAM
ccuuagguagagaagcucca

SEQ ID NO: 9283 - RNA, 20 nt, Artificial Sequence
  targeting sequence with GTCN PAM
cugcaccgagggagcggacc

SEQ ID NO: 9284 - RNA, 20 nt, Artificial Sequence
  targeting sequence with GTCN PAM
gcucccucggugcagugacu

SEQ ID NO: 9285 - RNA, 20 nt, Artificial Sequence
  targeting sequence with GTCN PAM
cggcccuuugguguaagcug

SEQ ID NO: 9286 - RNA, 20 nt, Artificial Sequence
  targeting sequence with GTCN PAM
acaggacacuucucuccauu

SEQ ID NO: 9287 - RNA, 20 nt, Artificial Sequence
  targeting sequence with GTCN PAM
uguggacugagggccuuccu

SEQ ID NO: 9288 - RNA, 20 nt, Artificial Sequence
  targeting sequence with GTCN PAM
cugaauggagagaagugucc

SEQ ID NO: 9289 - RNA, 20 nt, Artificial Sequence
  targeting sequence with GTCN PAM
caguggggagucgcugaaug

SEQ ID NO: 9290 - RNA, 20 nt, Artificial Sequence
  targeting sequence with GTCN PAM
aaagggugguggggcugcuu

SEQ ID NO: 9291 - RNA, 20 nt, Artificial Sequence
  targeting sequence with GTCN PAM
gcccugcucacccaccguga

SEQ ID NO: 9292 - RNA, 20 nt, Artificial Sequence
  targeting sequence with GTCN PAM
cggugggugagcagggcaga

SEQ ID NO: 9293 - RNA, 20 nt, Artificial Sequence
  targeting sequence with GTCN PAM
ugggagaccgaccucgaccu

SEQ ID NO: 9294 - RNA, 20 nt, Artificial Sequence
  targeting sequence with GTCN PAM
cccacgacugcccaccaucu

SEQ ID NO: 9295 - RNA, 20 nt, Artificial Sequence
  targeting sequence with GTCN PAM
gucucccacgacugcccacc

SEQ ID NO: 9296 - RNA, 20 nt, Artificial Sequence
  targeting sequence with GTCN PAM
aggucggucucccacgacug

SEQ ID NO: 9297 - RNA, 20 nt, Artificial Sequence
  targeting sequence with GTCN PAM
cagccauggagaagggacag

SEQ ID NO: 9298 - RNA, 20 nt, Artificial Sequence
  targeting sequence with GTCN PAM
cuucuccauggcugugacaa

SEQ ID NO: 9299 - RNA, 20 nt, Artificial Sequence
  targeting sequence with GTCN PAM
ccacaagaaggcugaguucu

SEQ ID NO: 9300 - RNA, 20 nt, Artificial Sequence
  targeting sequence with GTCN PAM
ggcgagcccacuucagcucc

SEQ ID NO: 9301 - RNA, 20 nt, Artificial Sequence
  targeting sequence with GTCN PAM
uucuggggccucauuccuca

SEQ ID NO: 9302 - RNA, 20 nt, Artificial Sequence
  targeting sequence with GTCN PAM
guugauccccauaguucacc

SEQ ID NO: 9303 - RNA, 20 nt, Artificial Sequence
  targeting sequence with GTCN PAM
ccucccgcacccuugucaug

SEQ ID NO: 9304 - RNA, 20 nt, Artificial Sequence
  targeting sequence with GTCN PAM
ugucaacacacaugcugauu

SEQ ID NO: 9305 - RNA, 20 nt, Artificial Sequence
  targeting sequence with GTCN PAM
acacacaugcugauuccguc

SEQ ID NO: 9306 - RNA, 20 nt, Artificial Sequence
  targeting sequence with GTCN PAM
accuggccccccuugcuacu

SEQ ID NO: 9307 - RNA, 20 nt, Artificial Sequence
  targeting sequence with GTCN PAM
gaggcuggguugggcaguag

SEQ ID NO: 9308 - RNA, 20 nt, Artificial Sequence
  targeting sequence with GTCN PAM
caggcagcuggggugggcag

SEQ ID NO: 9309 - RNA, 20 nt, Artificial Sequence
  targeting sequence with GTCN PAM
agaaggcagcaaaggcuggg

SEQ ID NO: 9310 - RNA, 20 nt, Artificial Sequence
  targeting sequence with GTCN PAM
ggccucagcaucuguguuuu

SEQ ID NO: 9311 - RNA, 20 nt, Artificial Sequence
  targeting sequence with GTCN PAM
caauucccaguucucagaac

SEQ ID NO: 9312 - RNA, 20 nt, Artificial Sequence
  targeting sequence with GTCN PAM
gggguaaacaauagcacuug

SEQ ID NO: 9313 - RNA, 20 nt, Artificial Sequence
  targeting sequence with GTCN PAM
guacucugaggaggcugcau

SEQ ID NO: 9314 - RNA, 20 nt, Artificial Sequence
  targeting sequence with GTCN PAM
ccugccacgcacaucccacu

SEQ ID NO: 9315 - RNA, 20 nt, Artificial Sequence
  targeting sequence with GTCN PAM
cguuguaccagugucugugc

SEQ ID NO: 9316 - RNA, 20 nt, Artificial Sequence
  targeting sequence with GTCN PAM
gugcaguacaccugucugcc

SEQ ID NO: 9317 - RNA, 20 nt, Artificial Sequence
  targeting sequence with GTCN PAM
gcccugugcgucuucaggcc

SEQ ID NO: 9318 - RNA, 20 nt, Artificial Sequence
  targeting sequence with GTCN PAM
ucaggccccagcuugcuggc

SEQ ID NO: 9319 - RNA, 20 nt, Artificial Sequence
  targeting sequence with GTCN PAM
augcagacaucugcagggcc

SEQ ID NO: 9320 - RNA, 20 nt, Artificial Sequence
  targeting sequence with GTCN PAM
gcauggacuugugugccagc

SEQ ID NO: 9321 - RNA, 20 nt, Artificial Sequence
  targeting sequence with GTCN PAM
gaguuaccauugcacguugg

SEQ ID NO: 9322 - RNA, 20 nt, Artificial Sequence
  targeting sequence with GTCN PAM
ggcaugcagucacuuacugc

SEQ ID NO: 9323 - RNA, 20 nt, Artificial Sequence
  targeting sequence with GTCN PAM
cuuacugcgcccucagcaug

SEQ ID NO: 9324 - RNA, 20 nt, Artificial Sequence
  targeting sequence with GTCN PAM
caggugcaugcugagggcgc

SEQ ID NO: 9325 - RNA, 20 nt, Artificial Sequence
  targeting sequence with GTCN PAM
aaguugccacagguacccag

SEQ ID NO: 9326 - RNA, 20 nt, Artificial Sequence
  targeting sequence with GTCN PAM
cugcacaugcccaccugggc

SEQ ID NO: 9327 - RNA, 20 nt, Artificial Sequence
  targeting sequence with GTCN PAM
cccgagggguacuacuggcg

SEQ ID NO: 9328 - RNA, 20 nt, Artificial Sequence
  targeting sequence with GTCN PAM
caggugggagcgcgcagaga

SEQ ID NO: 9329 - RNA, 20 nt, Artificial Sequence
  targeting sequence with GTCN PAM
ugagcugagugggucacagg

SEQ ID NO: 9330 - RNA, 20 nt, Artificial Sequence
  targeting sequence with GTCN PAM
cgugcccugcaccacgcugu

SEQ ID NO: 9331 - RNA, 20 nt, Artificial Sequence
  targeting sequence with GTCN PAM
agcaccgccaccacgucggg

SEQ ID NO: 9332 - RNA, 20 nt, Artificial Sequence
  targeting sequence with GTCN PAM
ggcgccgguuccacgaagca

SEQ ID NO: 9333 - RNA, 20 nt, Artificial Sequence
  targeting sequence with GTCN PAM
gcgaagcggaaggcgcagag

SEQ ID NO: 9334 - RNA, 20 nt, Artificial Sequence
  targeting sequence with GTCN PAM
cccgcggcccgcgcugcucc

SEQ ID NO: 9335 - RNA, 20 nt, Artificial Sequence
  targeting sequence with GTCN PAM
ucgagcggccccaggggucc

SEQ ID NO: 9336 - RNA, 20 nt, Artificial Sequence
  targeting sequence with GTCN PAM
ucccagcccgggagcggcuc

SEQ ID NO: 9337 - RNA, 20 nt, Artificial Sequence
  targeting sequence with GTCN PAM
gucuucccagcccgggagcg

SEQ ID NO: 9338 - RNA, 20 nt, Artificial Sequence
  targeting sequence with GTCN PAM
ccgcggcccgcgccgcccgc

SEQ ID NO: 9339 - RNA, 20 nt, Artificial Sequence
  targeting sequence with GTCN PAM
uacauccaguugggcuugca

SEQ ID NO: 9340 - RNA, 20 nt, Artificial Sequence
  targeting sequence with GTCN PAM
ccgccggcgccguggggcag

SEQ ID NO: 9341 - RNA, 20 nt, Artificial Sequence
  targeting sequence with GTCN PAM
cccgcgcgcgccucgcuguu

SEQ ID NO: 9342 - RNA, 20 nt, Artificial Sequence
  targeting sequence with GTCN PAM
uacgcguaccuggcgcucaa

SEQ ID NO: 9343 - RNA, 20 nt, Artificial Sequence
  targeting sequence with GTCN PAM
gacgggugcaggaaggcgcu

SEQ ID NO: 9344 - RNA, 20 nt, Artificial Sequence
  targeting sequence with GTCN PAM
gacccgccgccgggugcaca

SEQ ID NO: 9345 - RNA, 20 nt, Artificial Sequence
  targeting sequence with GTCN PAM
ucggagggguugaggucgaa

SEQ ID NO: 9346 - RNA, 20 nt, Artificial Sequence
  targeting sequence with GTCN PAM
gagggguugaggucgaaggu

SEQ ID NO: 9347 - RNA, 20 nt, Artificial Sequence
  targeting sequence with GTCN PAM
aaggugaagagcuuggccag

SEQ ID NO: 9348 - RNA, 20 nt, Artificial Sequence
  targeting sequence with GTCN PAM
ccgcgcguguccagggagcg

SEQ ID NO: 9349 - RNA, 20 nt, Artificial Sequence
  targeting sequence with GTCN PAM
agggagcggauggcgaucuc

SEQ ID NO: 9350 - RNA, 20 nt, Artificial Sequence
  targeting sequence with GTCN PAM
uccaggcugcgguugcgcgg

SEQ ID NO: 9351 - RNA, 20 nt, Artificial Sequence
  targeting sequence with GTCN PAM
accguggggcuaguucugcc

SEQ ID NO: 9352 - RNA, 20 nt, Artificial Sequence
  targeting sequence with GTCN PAM
cgguguuccccagcaugcug

SEQ ID NO: 9353 - RNA, 20 nt, Artificial Sequence
  targeting sequence with GTCN PAM
aucuaccagggcuucugcca

SEQ ID NO: 9354 - RNA, 20 nt, Artificial Sequence
  targeting sequence with GTCN PAM
ugugcggguccaucuaccag

SEQ ID NO: 9355 - RNA, 20 nt, Artificial Sequence
  targeting sequence with GTCN PAM
agcugcaggaucuuguugua

SEQ ID NO: 9356 - RNA, 20 nt, Artificial Sequence
  targeting sequence with GTCN PAM
gugaggcgccgcgggugcuc

SEQ ID NO: 9357 - RNA, 20 nt, Artificial Sequence
  targeting sequence with GTCN PAM
cgcuccgcagcugccgcagg

SEQ ID NO: 9358 - RNA, 20 nt, Artificial Sequence
  targeting sequence with GTCN PAM
ggcaccgggcccacggccgc

SEQ ID NO: 9359 - RNA, 20 nt, Artificial Sequence
  targeting sequence with GTCN PAM
ggcgccaaccugagccugga

SEQ ID NO: 9360 - RNA, 20 nt, Artificial Sequence
  targeting sequence with GTCN PAM
accgccucuaucagcugucg

SEQ ID NO: 9361 - RNA, 20 nt, Artificial Sequence
  targeting sequence with GTCN PAM
ccgccgcgccguccagggcg

SEQ ID NO: 9362 - RNA, 20 nt, Artificial Sequence
  targeting sequence with GTCN PAM
agggcgaaguuguugguggg

SEQ ID NO: 9363 - RNA, 20 nt, Artificial Sequence
  targeting sequence with GTCN PAM
guuccccucgcccacgccca

SEQ ID NO: 9364 - RNA, 20 nt, Artificial Sequence
  targeting sequence with GTCN PAM
ggaacggcggggggcuggcg

SEQ ID NO: 9365 - RNA, 20 nt, Artificial Sequence
  targeting sequence with GTCN PAM
ggggcggcuggcgcgggcag

SEQ ID NO: 9366 - RNA, 20 nt, Artificial Sequence
  targeting sequence with GTCN PAM
gccucgccgcgcagcccggg

SEQ ID NO: 9367 - RNA, 20 nt, Artificial Sequence
  targeting sequence with GTCN PAM
gcagcggagccgcccccgcc

SEQ ID NO: 9368 - RNA, 20 nt, Artificial Sequence
  targeting sequence with GTCN PAM
cgggggcgggcggggccggg

SEQ ID NO: 9369 - RNA, 20 nt, Artificial Sequence
  targeting sequence with GTCN PAM
gcgggucccgccgcccgcgc

SEQ ID NO: 9370 - RNA, 20 nt, Artificial Sequence
  targeting sequence with GTCN PAM
cgccgcccgcgcccuccagg

SEQ ID NO: 9371 - RNA, 20 nt, Artificial Sequence
  targeting sequence with GTCN PAM
uggagggcgcgggcggcggg

SEQ ID NO: 9372 - RNA, 20 nt, Artificial Sequence
  targeting sequence with GTCN PAM
cuccccguagccgccgccgc

SEQ ID NO: 9373 - RNA, 20 nt, Artificial Sequence
  targeting sequence with GTCN PAM
cucgcucuccucgcucuuuc

SEQ ID NO: 9374 - RNA, 20 nt, Artificial Sequence
  targeting sequence with GTCN PAM
cucccucucucugcgucucu

SEQ ID NO: 9375 - RNA, 20 nt, Artificial Sequence
  targeting sequence with GTCN PAM
cucggucucugcgucucucc

SEQ ID NO: 9376 - RNA, 20 nt, Artificial Sequence
  targeting sequence with GTCN PAM
cugcgucucuccgucucugu

SEQ ID NO: 9377 - RNA, 20 nt, Artificial Sequence
  targeting sequence with GTCN PAM
cuccgucucuguccccaccc

SEQ ID NO: 9378 - RNA, 20 nt, Artificial Sequence
  targeting sequence with GTCN PAM
cuguccccaccccaaacucc

SEQ ID NO: 9379 - RNA, 20 nt, Artificial Sequence
  targeting sequence with GTCN PAM
ccaccccaaacuccgcgcgu

SEQ ID NO: 9380 - RNA, 20 nt, Artificial Sequence
  targeting sequence with GTCN PAM
gagggagaaggagaagcaga

SEQ ID NO: 9381 - RNA, 20 nt, Artificial Sequence
  targeting sequence with GTCN PAM
cuggcagccccgcccccggc

SEQ ID NO: 9382 - RNA, 20 nt, Artificial Sequence
  targeting sequence with GTCN PAM
ccuucucucuccugcuccgu

SEQ ID NO: 9383 - RNA, 20 nt, Artificial Sequence
  targeting sequence with GTCN PAM
cugacgcucgcucccucucu

SEQ ID NO: 9384 - RNA, 20 nt, Artificial Sequence
  targeting sequence with GTCN PAM
gggacggaaaaacggagcag

SEQ ID NO: 9385 - RNA, 20 nt, Artificial Sequence
  targeting sequence with GTCN PAM
gagggggaggcagagggagc

SEQ ID NO: 9386 - RNA, 20 nt, Artificial Sequence
  targeting sequence with GTCN PAM
cucucucggucccucugagc

SEQ ID NO: 9387 - RNA, 20 nt, Artificial Sequence
  targeting sequence with GTCN PAM
cucugagcuccccuuuccuu

SEQ ID NO: 9388 - RNA, 20 nt, Artificial Sequence
  targeting sequence with GTCN PAM
ccccuccacacucagccucc

SEQ ID NO: 9389 - RNA, 20 nt, Artificial Sequence
  targeting sequence with GTCN PAM
aggccuucgcucccccggug

SEQ ID NO: 9390 - RNA, 20 nt, Artificial Sequence
  targeting sequence with GTCN PAM
ggccccccagaccccauaau

SEQ ID NO: 9391 - RNA, 20 nt, Artificial Sequence
  targeting sequence with GTCN PAM
ggggggcccgacuggccggc

SEQ ID NO: 9392 - RNA, 20 nt, Artificial Sequence
  targeting sequence with GTCN PAM
cccaaaccccagacccauaa

SEQ ID NO: 9393 - RNA, 20 nt, Artificial Sequence
  targeting sequence with GTCN PAM
gggguuugggggacagauua

SEQ ID NO: 9394 - RNA, 20 nt, Artificial Sequence
  targeting sequence with GTCN PAM
cucuggcccugccacuugua

SEQ ID NO: 9395 - RNA, 20 nt, Artificial Sequence
  targeting sequence with GTCN PAM
gauauauaaaugaggaaaac

SEQ ID NO: 9396 - RNA, 20 nt, Artificial Sequence
  targeting sequence with GTCN PAM
uggagcccacaguugccucc

SEQ ID NO: 9397 - RNA, 20 nt, Artificial Sequence
  targeting sequence with GTCN PAM
ccacaggaggcaacuguggg

SEQ ID NO: 9398 - RNA, 20 nt, Artificial Sequence
  targeting sequence with GTCN PAM
gggaaagugccuggcggggg

SEQ ID NO: 9399 - RNA, 20 nt, Artificial Sequence
  targeting sequence with GTCN PAM
cacaaaagccggcacugggc

SEQ ID NO: 9400 - RNA, 20 nt, Artificial Sequence
  targeting sequence with GTCN PAM
cagcccugugaggaccaugc

SEQ ID NO: 9401 - RNA, 20 nt, Artificial Sequence
  targeting sequence with GTCN PAM
ucacagggcugugaccuugg

SEQ ID NO: 9402 - RNA, 20 nt, Artificial Sequence
  targeting sequence with GTCN PAM
ggcacgggcuagcccugugu

SEQ ID NO: 9403 - RNA, 20 nt, Artificial Sequence
  targeting sequence with GTCN PAM
cuuccccucagccuugguuu

SEQ ID NO: 9404 - RNA, 20 nt, Artificial Sequence
  targeting sequence with GTCN PAM
gagcugaagggcuuuugcuu

SEQ ID NO: 9405 - RNA, 20 nt, Artificial Sequence
  targeting sequence with GTCN PAM
gaugggaggccccguucuga

SEQ ID NO: 9406 - RNA, 20 nt, Artificial Sequence
  targeting sequence with GTCN PAM
cgcuacucucagagugaggc

SEQ ID NO: 9407 - RNA, 20 nt, Artificial Sequence
  targeting sequence with GTCN PAM
gugcaccauggggccggcag

SEQ ID NO: 9408 - RNA, 20 nt, Artificial Sequence
  targeting sequence with GTCN PAM
ggaacaaggcgggcaggaug

SEQ ID NO: 9409 - RNA, 20 nt, Artificial Sequence
  targeting sequence with GTCN PAM
ggccacugcuuugauggccg

SEQ ID NO: 9410 - RNA, 20 nt, Artificial Sequence
  targeting sequence with GTCN PAM
ccugaguggcucuugguggg

SEQ ID NO: 9411 - RNA, 20 nt, Artificial Sequence
  targeting sequence with GTCN PAM
cacgggcaguccccugagug

SEQ ID NO: 9412 - RNA, 20 nt, Artificial Sequence
  targeting sequence with GTCN PAM
cugucuuccucucuggaugg

SEQ ID NO: 9413 - RNA, 20 nt, Artificial Sequence
  targeting sequence with GTCN PAM
uccucucuggauggagaagg

SEQ ID NO: 9414 - RNA, 20 nt, Artificial Sequence
  targeting sequence with GTCN PAM
auccgcuggucucucugucu

SEQ ID NO: 9415 - RNA, 20 nt, Artificial Sequence
  targeting sequence with GTCN PAM
cucugucuuaucucucucuc

SEQ ID NO: 9416 - RNA, 20 nt, Artificial Sequence
  targeting sequence with GTCN PAM
uaucucucucucuccugccc

SEQ ID NO: 9417 - RNA, 20 nt, Artificial Sequence
  targeting sequence with GTCN PAM
ugcuccucccguucacucuc

SEQ ID NO: 9418 - RNA, 20 nt, Artificial Sequence
  targeting sequence with GTCN PAM
cuccuucucucagugucuug

SEQ ID NO: 9419 - RNA, 20 nt, Artificial Sequence
  targeting sequence with GTCN PAM
ugcccccuucccuuuccacu

SEQ ID NO: 9420 - RNA, 20 nt, Artificial Sequence
  targeting sequence with GTCN PAM
cucugugucucuaucucugu

SEQ ID NO: 9421 - RNA, 20 nt, Artificial Sequence
  targeting sequence with GTCN PAM
cuaucucugucucucucucu

SEQ ID NO: 9422 - RNA, 20 nt, Artificial Sequence
  targeting sequence with GTCN PAM
cucucucugucucccucccu

SEQ ID NO: 9423 - RNA, 20 nt, Artificial Sequence
  targeting sequence with GTCN PAM
cccucccuaucccucacccc

SEQ ID NO: 9424 - RNA, 20 nt, Artificial Sequence
  targeting sequence with GTCN PAM
cccgcucaucugguucaucu

SEQ ID NO: 9425 - RNA, 20 nt, Artificial Sequence
  targeting sequence with GTCN PAM
uagaccagccuguggugaug

SEQ ID NO: 9426 - RNA, 20 nt, Artificial Sequence
  targeting sequence with GTCN PAM
aagacaacacugagcauuau

SEQ ID NO: 9427 - RNA, 20 nt, Artificial Sequence
  targeting sequence with GTCN PAM
caagugcccaggaucaucac

SEQ ID NO: 9428 - RNA, 20 nt, Artificial Sequence
  targeting sequence with GTCN PAM
gaguauccucacaucaacug

SEQ ID NO: 9429 - RNA, 20 nt, Artificial Sequence
  targeting sequence with GTCN PAM
ugugcaaggcacucacccuc

SEQ ID NO: 9430 - RNA, 20 nt, Artificial Sequence
  targeting sequence with GTCN PAM
ucauuuuacaguugaggaaa

SEQ ID NO: 9431 - RNA, 20 nt, Artificial Sequence
  targeting sequence with GTCN PAM
agcacaacaaggcucuuagc

SEQ ID NO: 9432 - RNA, 20 nt, Artificial Sequence
  targeting sequence with GTCN PAM
ugguucacugccacaaggcg

SEQ ID NO: 9433 - RNA, 20 nt, Artificial Sequence
  targeting sequence with GTCN PAM
uuaguugcaaugccccccac

SEQ ID NO: 9434 - RNA, 20 nt, Artificial Sequence
  targeting sequence with GTCN PAM
ugagccccaauguggcuagc

SEQ ID NO: 9435 - RNA, 20 nt, Artificial Sequence
  targeting sequence with GTCN PAM
gguggcucugcuagccacau

SEQ ID NO: 9436 - RNA, 20 nt, Artificial Sequence
  targeting sequence with GTCN PAM
gcuggcugcaaggauggugu

SEQ ID NO: 9437 - RNA, 20 nt, Artificial Sequence
  targeting sequence with GTCN PAM
gcaaacccauuucacagaug

SEQ ID NO: 9438 - RNA, 20 nt, Artificial Sequence
  targeting sequence with GTCN PAM
gcaccuccucugcccagcca

SEQ ID NO: 9439 - RNA, 20 nt, Artificial Sequence
  targeting sequence with GTCN PAM
caccuaauccccacuccuga

SEQ ID NO: 9440 - RNA, 20 nt, Artificial Sequence
  targeting sequence with GTCN PAM
ggcuauucuggguuaguuca

SEQ ID NO: 9441 - RNA, 20 nt, Artificial Sequence
  targeting sequence with GTCN PAM
gauuauaucaaggaaaaggu

SEQ ID NO: 9442 - RNA, 20 nt, Artificial Sequence
  targeting sequence with GTCN PAM
ugguuugaggcuaacauguc

SEQ ID NO: 9443 - RNA, 20 nt, Artificial Sequence
  targeting sequence with GTCN PAM
uuaaugacuguaacauuugu

SEQ ID NO: 9444 - RNA, 20 nt, Artificial Sequence
  targeting sequence with GTCN PAM
uuaaagacauguuagccuca

SEQ ID NO: 9445 - RNA, 20 nt, Artificial Sequence
  targeting sequence with GTCN PAM
cugucucuuuuuaauagaga

SEQ ID NO: 9446 - RNA, 20 nt, Artificial Sequence
  targeting sequence with GTCN PAM
cuuuuuaauagagagaaggu

SEQ ID NO: 9447 - RNA, 20 nt, Artificial Sequence
  targeting sequence with GTCN PAM
caaacucagggcuguugaca

SEQ ID NO: 9448 - RNA, 20 nt, Artificial Sequence
  targeting sequence with GTCN PAM
acagcccugaguuugagacc

SEQ ID NO: 9449 - RNA, 20 nt, Artificial Sequence
  targeting sequence with GTCN PAM
uuuaaaagugaguuaaagac

SEQ ID NO: 9450 - RNA, 20 nt, Artificial Sequence
  targeting sequence with GTCN PAM
uuaacucacuuuuaaaggac

SEQ ID NO: 9451 - RNA, 20 nt, Artificial Sequence
  targeting sequence with GTCN PAM
agcagugccuuugaagacga

SEQ ID NO: 9452 - RNA, 20 nt, Artificial Sequence
  targeting sequence with GTCN PAM
ucaaaggcacugcuggacau

SEQ ID NO: 9453 - RNA, 20 nt, Artificial Sequence
  targeting sequence with GTCN PAM
ucgucuucaaaggcacugcu

SEQ ID NO: 9454 - RNA, 20 nt, Artificial Sequence
  targeting sequence with GTCN PAM
gggcagucuugcuuggggca

SEQ ID NO: 9455 - RNA, 20 nt, Artificial Sequence
  targeting sequence with GTCN PAM
ugcuuggggcacggugguca

SEQ ID NO: 9456 - RNA, 20 nt, Artificial Sequence
  targeting sequence with GTCN PAM
acggcuaugcuggcucggag

SEQ ID NO: 9457 - RNA, 20 nt, Artificial Sequence
  targeting sequence with GTCN PAM
uguccauucucaccucugac

SEQ ID NO: 9458 - RNA, 20 nt, Artificial Sequence
  targeting sequence with GTCN PAM
auucucaccucugacugccc

SEQ ID NO: 9459 - RNA, 20 nt, Artificial Sequence
  targeting sequence with GTCN PAM
gaggugagaauggacaggac

SEQ ID NO: 9460 - RNA, 20 nt, Artificial Sequence
  targeting sequence with GTCN PAM
ccucacagcucugcccuggg

SEQ ID NO: 9461 - RNA, 20 nt, Artificial Sequence
  targeting sequence with GTCN PAM
cuugggccuggccucugaga

SEQ ID NO: 9462 - RNA, 20 nt, Artificial Sequence
  targeting sequence with GTCN PAM
uagggacggcuuggcaaucc

SEQ ID NO: 9463 - RNA, 20 nt, Artificial Sequence
  targeting sequence with GTCN PAM
cuaggacucuuguuuccagc

SEQ ID NO: 9464 - RNA, 20 nt, Artificial Sequence
  targeting sequence with GTCN PAM
agcccccgagaagcagcagu

SEQ ID NO: 9465 - RNA, 20 nt, Artificial Sequence
  targeting sequence with GTCN PAM
cauuuccccgugggagcaac

SEQ ID NO: 9466 - RNA, 20 nt, Artificial Sequence
  targeting sequence with GTCN PAM
uagcaaccccccuuuuuuuu

SEQ ID NO: 9467 - RNA, 20 nt, Artificial Sequence
  targeting sequence with GTCN PAM
uugcgauaguuugcucagaa

SEQ ID NO: 9468 - RNA, 20 nt, Artificial Sequence
  targeting sequence with GTCN PAM
cuacaaaggacaugaacuca

SEQ ID NO: 9469 - RNA, 20 nt, Artificial Sequence
  targeting sequence with GTCN PAM
uuuguagggacauggaugaa

SEQ ID NO: 9470 - RNA, 20 nt, Artificial Sequence
  targeting sequence with GTCN PAM
aucauugauggaccuuugau

SEQ ID NO: 9471 - RNA, 20 nt, Artificial Sequence
  targeting sequence with GTCN PAM
aucaaugauagacuggauua

SEQ ID NO: 9472 - RNA, 20 nt, Artificial Sequence
  targeting sequence with GTCN PAM
gugcucaggaggagagggga

SEQ ID NO: 9473 - RNA, 20 nt, Artificial Sequence
  targeting sequence with GTCN PAM
cacagcaaacagguggcaaa

SEQ ID NO: 9474 - RNA, 20 nt, Artificial Sequence
  targeting sequence with GTCN PAM
ccguggggcuggaggaaaug

SEQ ID NO: 9475 - RNA, 20 nt, Artificial Sequence
  targeting sequence with GTCN PAM
uucacaugcaggaaugagaa

SEQ ID NO: 9476 - RNA, 20 nt, Artificial Sequence
  targeting sequence with GTCN PAM
ggagagggcgucguucacau

SEQ ID NO: 9477 - RNA, 20 nt, Artificial Sequence
  targeting sequence with GTCN PAM
uugcccucugugcucagggg

SEQ ID NO: 9478 - RNA, 20 nt, Artificial Sequence
  targeting sequence with GTCN PAM
ccugagcacagagggcaagg

SEQ ID NO: 9479 - RNA, 20 nt, Artificial Sequence
  targeting sequence with GTCN PAM
ccaccccggcccaugagucc

SEQ ID NO: 9480 - RNA, 20 nt, Artificial Sequence
  targeting sequence with GTCN PAM
gagaaugccgcccauuaucc

SEQ ID NO: 9481 - RNA, 20 nt, Artificial Sequence
  targeting sequence with GTCN PAM
agucaugggucugggcccgu

SEQ ID NO: 9482 - RNA, 20 nt, Artificial Sequence
  targeting sequence with GTCN PAM
ugggucugggcccgugaaag

SEQ ID NO: 9483 - RNA, 20 nt, Artificial Sequence
  targeting sequence with GTCN PAM
gggcccgugaaaggacccgg

SEQ ID NO: 9484 - RNA, 20 nt, Artificial Sequence
  targeting sequence with GTCN PAM
uuucacgggcccagacccau

SEQ ID NO: 9485 - RNA, 20 nt, Artificial Sequence
  targeting sequence with GTCN PAM
agcagaagccucagaggggc

SEQ ID NO: 9486 - RNA, 20 nt, Artificial Sequence
  targeting sequence with GTCN PAM
ccuggagauggcagccaggg

SEQ ID NO: 9487 - RNA, 20 nt, Artificial Sequence
  targeting sequence with GTCN PAM
gcagcacagcuguuugaugg

SEQ ID NO: 9488 - RNA, 20 nt, Artificial Sequence
  targeting sequence with GTCN PAM
uggauuugaaccggugucug

SEQ ID NO: 9489 - RNA, 20 nt, Artificial Sequence
  targeting sequence with GTCN PAM
ccucaccuccugccucaguu

SEQ ID NO: 9490 - RNA, 20 nt, Artificial Sequence
  targeting sequence with GTCN PAM
ccagcuaguacgugguagaa

SEQ ID NO: 9491 - RNA, 20 nt, Artificial Sequence
  targeting sequence with GTCN PAM
uguucuuaaugaacuugagu

SEQ ID NO: 9492 - RNA, 20 nt, Artificial Sequence
  targeting sequence with GTCN PAM
ccauggccccaggccccagu

SEQ ID NO: 9493 - RNA, 20 nt, Artificial Sequence
  targeting sequence with GTCN PAM
ugagggauacaaaaaguuca

SEQ ID NO: 9494 - RNA, 20 nt, Artificial Sequence
  targeting sequence with GTCN PAM
uuccuagugaacuccuaggc

SEQ ID NO: 9495 - RNA, 20 nt, Artificial Sequence
  targeting sequence with GTCN PAM
ugagggaggccuaggaguuc

SEQ ID NO: 9496 - RNA, 20 nt, Artificial Sequence
  targeting sequence with GTCN PAM
aaagaccuucugagaagacu

SEQ ID NO: 9497 - RNA, 20 nt, Artificial Sequence
  targeting sequence with GTCN PAM
uuagacuaggucuugaggga

SEQ ID NO: 9498 - RNA, 20 nt, Artificial Sequence
  targeting sequence with GTCN PAM
ucucagaaggucuuuagacu

SEQ ID NO: 9499 - RNA, 20 nt, Artificial Sequence
  targeting sequence with GTCN PAM
cgcccuguagugagcuucuu

SEQ ID NO: 9500 - RNA, 20 nt, Artificial Sequence
  targeting sequence with GTCN PAM
ucucugcggaggaacuuggg

SEQ ID NO: 9501 - RNA, 20 nt, Artificial Sequence
  targeting sequence with GTCN PAM
caaguuccuccgcagagagg

SEQ ID NO: 9502 - RNA, 20 nt, Artificial Sequence
  targeting sequence with GTCN PAM
cccaaaacucccuaaagaac

SEQ ID NO: 9503 - RNA, 20 nt, Artificial Sequence
  targeting sequence with GTCN PAM
uucucguaaggcugcucuug

SEQ ID NO: 9504 - RNA, 20 nt, Artificial Sequence
  targeting sequence with GTCN PAM
caggggaagccacaggggaa

SEQ ID NO: 9505 - RNA, 20 nt, Artificial Sequence
  targeting sequence with GTCN PAM
ccaagauuuggaucuggcug

SEQ ID NO: 9506 - RNA, 20 nt, Artificial Sequence
  targeting sequence with GTCN PAM
augcagcuaaugcuuccuga

SEQ ID NO: 9507 - RNA, 20 nt, Artificial Sequence
  targeting sequence with GTCN PAM
ucacaguggccucaggaagc

SEQ ID NO: 9508 - RNA, 20 nt, Artificial Sequence
  targeting sequence with GTCN PAM
ggguccucacaguggccuca

SEQ ID NO: 9509 - RNA, 20 nt, Artificial Sequence
  targeting sequence with GTCN PAM
cuuccucccaccuguccaga

SEQ ID NO: 9510 - RNA, 20 nt, Artificial Sequence
  targeting sequence with GTCN PAM
agagguugcuucccaaucac

SEQ ID NO: 9511 - RNA, 20 nt, Artificial Sequence
  targeting sequence with GTCN PAM
caccauccaggggaggcuau

SEQ ID NO: 9512 - RNA, 20 nt, Artificial Sequence
  targeting sequence with GTCN PAM
gaacaggggcaggcggccgc

SEQ ID NO: 9513 - RNA, 20 nt, Artificial Sequence
  targeting sequence with GTCN PAM
cgcccauagugccggcggcc

SEQ ID NO: 9514 - RNA, 20 nt, Artificial Sequence
  targeting sequence with GTCN PAM
cagccgucucgcccauagug

SEQ ID NO: 9515 - RNA, 20 nt, Artificial Sequence
  targeting sequence with GTCN PAM
agccuucugugcaggucuca

SEQ ID NO: 9516 - RNA, 20 nt, Artificial Sequence
  targeting sequence with GTCN PAM
ucccuccuauccucuuccuc

SEQ ID NO: 9517 - RNA, 20 nt, Artificial Sequence
  targeting sequence with GTCN PAM
gcacagaugcagccaccagg

SEQ ID NO: 9518 - RNA, 20 nt, Artificial Sequence
  targeting sequence with GTCN PAM
ugccacaccuggggcccacc

SEQ ID NO: 9519 - RNA, 20 nt, Artificial Sequence
  targeting sequence with GTCN PAM
gcccagccaagccucucgag

SEQ ID NO: 9520 - RNA, 20 nt, Artificial Sequence
  targeting sequence with GTCN PAM
aagccaggggcugccugggc

SEQ ID NO: 9521 - RNA, 20 nt, Artificial Sequence
  targeting sequence with GTCN PAM
gaauuuucuaaguuuuccuc

SEQ ID NO: 9522 - RNA, 20 nt, Artificial Sequence
  targeting sequence with GTCN PAM
gaauccccacugcccauaau

SEQ ID NO: 9523 - RNA, 20 nt, Artificial Sequence
  targeting sequence with GTCN PAM
cacaaauggaagugaauuau

SEQ ID NO: 9524 - RNA, 20 nt, Artificial Sequence
  targeting sequence with GTCN PAM
cguggcugggagggucuagg

SEQ ID NO: 9525 - RNA, 20 nt, Artificial Sequence
  targeting sequence with GTCN PAM
cggcgugaggccuggcgggc

SEQ ID NO: 9526 - RNA, 20 nt, Artificial Sequence
  targeting sequence with GTCN PAM
guuuugccgggcguugcugu

SEQ ID NO: 9527 - RNA, 20 nt, Artificial Sequence
  targeting sequence with GTCN PAM
gccucaauuuccuucucuga

SEQ ID NO: 9528 - RNA, 20 nt, Artificial Sequence
  targeting sequence with GTCN PAM
agcccugugggcugucccac

SEQ ID NO: 9529 - RNA, 20 nt, Artificial Sequence
  targeting sequence with GTCN PAM
cacccacacuccuucugugc

SEQ ID NO: 9530 - RNA, 20 nt, Artificial Sequence
  targeting sequence with GTCN PAM
cccacccccuggcccuccug

SEQ ID NO: 9531 - RNA, 20 nt, Artificial Sequence
  targeting sequence with GTCN PAM
aacuuacacaggagggccag

SEQ ID NO: 9532 - RNA, 20 nt, Artificial Sequence
  targeting sequence with GTCN PAM
ccaucugggggugggaggug

SEQ ID NO: 9533 - RNA, 20 nt, Artificial Sequence
  targeting sequence with GTCN PAM
ucacugccugcucaggaguc

SEQ ID NO: 9534 - RNA, 20 nt, Artificial Sequence
  targeting sequence with GTCN PAM
ucacacuagcgucccuuucc

SEQ ID NO: 9535 - RNA, 20 nt, Artificial Sequence
  targeting sequence with GTCN PAM
cuuuccaugcucggcucagc

SEQ ID NO: 9536 - RNA, 20 nt, Artificial Sequence
  targeting sequence with GTCN PAM
acuaagggccgucuucagcc

SEQ ID NO: 9537 - RNA, 20 nt, Artificial Sequence
  targeting sequence with GTCN PAM
ucagcccggugcugggugcu

SEQ ID NO: 9538 - RNA, 20 nt, Artificial Sequence
  targeting sequence with GTCN PAM
gagagggcuuccuggaggag

SEQ ID NO: 9539 - RNA, 20 nt, Artificial Sequence
  targeting sequence with GTCN PAM
uugcacaugcuguuuccucc

SEQ ID NO: 9540 - RNA, 20 nt, Artificial Sequence
  targeting sequence with GTCN PAM
uucgcuacugcuggcccugc

SEQ ID NO: 9541 - RNA, 20 nt, Artificial Sequence
  targeting sequence with GTCN PAM
ggcaaggcagggccagcagu

SEQ ID NO: 9542 - RNA, 20 nt, Artificial Sequence
  targeting sequence with GTCN PAM
gggagggcacggauggggag

SEQ ID NO: 9543 - RNA, 20 nt, Artificial Sequence
  targeting sequence with GTCN PAM
gcagaggagccggcaggaga

SEQ ID NO: 9544 - RNA, 20 nt, Artificial Sequence
  targeting sequence with GTCN PAM
cacagcucucaaugaagaga

SEQ ID NO: 9545 - RNA, 20 nt, Artificial Sequence
  targeting sequence with GTCN PAM
ccacucccagauccugccug

SEQ ID NO: 9546 - RNA, 20 nt, Artificial Sequence
  targeting sequence with GTCN PAM
accguucaaucccccuccuu

SEQ ID NO: 9547 - RNA, 20 nt, Artificial Sequence
  targeting sequence with GTCN PAM
gggccuguguccaccguuca

SEQ ID NO: 9548 - RNA, 20 nt, Artificial Sequence
  targeting sequence with GTCN PAM
cugcugcugcugggguggga

SEQ ID NO: 9549 - RNA, 20 nt, Artificial Sequence
  targeting sequence with GTCN PAM
caccccagcagcagcagcga

SEQ ID NO: 9550 - RNA, 20 nt, Artificial Sequence
  targeting sequence with GTCN PAM
gcaccgcugucccaccccag

SEQ ID NO: 9551 - RNA, 20 nt, Artificial Sequence
  targeting sequence with GTCN PAM
ggaguccucagucacacagc

SEQ ID NO: 9552 - RNA, 20 nt, Artificial Sequence
  targeting sequence with GTCN PAM
ucagucacacagcagagcug

SEQ ID NO: 9553 - RNA, 20 nt, Artificial Sequence
  targeting sequence with GTCN PAM
cacagcagagcugggaugug

SEQ ID NO: 9554 - RNA, 20 nt, Artificial Sequence
  targeting sequence with GTCN PAM
ggcagggccacuccuucccc

SEQ ID NO: 9555 - RNA, 20 nt, Artificial Sequence
  targeting sequence with GTCN PAM
gcucacacuuccagggacag

SEQ ID NO: 9556 - RNA, 20 nt, Artificial Sequence
  targeting sequence with GTCN PAM
cuggaagugugagcagacgu

SEQ ID NO: 9557 - RNA, 20 nt, Artificial Sequence
  targeting sequence with GTCN PAM
gccucacacauauguccccu

SEQ ID NO: 9558 - RNA, 20 nt, Artificial Sequence
  targeting sequence with GTCN PAM
ccuugcuggaaauguccacu

SEQ ID NO: 9559 - RNA, 20 nt, Artificial Sequence
  targeting sequence with GTCN PAM
acucccacccccaccccggc

SEQ ID NO: 9560 - RNA, 20 nt, Artificial Sequence
  targeting sequence with GTCN PAM
gugauuaggaaccuggccgg

SEQ ID NO: 9561 - RNA, 20 nt, Artificial Sequence
  targeting sequence with GTCN PAM
cccggucagugauuaggaac

SEQ ID NO: 9562 - RNA, 20 nt, Artificial Sequence
  targeting sequence with GTCN PAM
ugccccaccauucuagagcc

SEQ ID NO: 9563 - RNA, 20 nt, Artificial Sequence
  targeting sequence with GTCN PAM
ucaccuccaguccugcccca

SEQ ID NO: 9564 - RNA, 20 nt, Artificial Sequence
  targeting sequence with GTCN PAM
uugcccagugcuggcucccu

SEQ ID NO: 9565 - RNA, 20 nt, Artificial Sequence
  targeting sequence with GTCN PAM
caagcccaggccaagggagc

SEQ ID NO: 9566 - RNA, 20 nt, Artificial Sequence
  targeting sequence with GTCN PAM
ggucccaagcccaggccaag

SEQ ID NO: 9567 - RNA, 20 nt, Artificial Sequence
  targeting sequence with GTCN PAM
ccuucguggauacugaucuc

SEQ ID NO: 9568 - RNA, 20 nt, Artificial Sequence
  targeting sequence with GTCN PAM
gcagagccagcagaugaggu

SEQ ID NO: 9569 - RNA, 20 nt, Artificial Sequence
  targeting sequence with GTCN PAM
ccauagugcugucggcagag

SEQ ID NO: 9570 - RNA, 20 nt, Artificial Sequence
  targeting sequence with GTCN PAM
ucacaguccccauagugcug

SEQ ID NO: 9571 - RNA, 20 nt, Artificial Sequence
  targeting sequence with GTCN PAM
uguucuccuuccccuucucc

SEQ ID NO: 9572 - RNA, 20 nt, Artificial Sequence
  targeting sequence with GTCN PAM
ggccccuuccagcacuaagg

SEQ ID NO: 9573 - RNA, 20 nt, Artificial Sequence
  targeting sequence with GTCN PAM
ccagggcaccuuagugcugg

SEQ ID NO: 9574 - RNA, 20 nt, Artificial Sequence
  targeting sequence with GTCN PAM
cuuggggugccuacuggacc

SEQ ID NO: 9575 - RNA, 20 nt, Artificial Sequence
  targeting sequence with GTCN PAM
aguaggcaccccaagggacu

SEQ ID NO: 9576 - RNA, 20 nt, Artificial Sequence
  targeting sequence with GTCN PAM
uuggugccaggcccaggcag

SEQ ID NO: 9577 - RNA, 20 nt, Artificial Sequence
  targeting sequence with GTCN PAM
uccagaggguguaauuaggc

SEQ ID NO: 9578 - RNA, 20 nt, Artificial Sequence
  targeting sequence with GTCN PAM
ccaggccagguccggcugac

SEQ ID NO: 9579 - RNA, 20 nt, Artificial Sequence
  targeting sequence with GTCN PAM
ggcugaccccuacguaggga

SEQ ID NO: 9580 - RNA, 20 nt, Artificial Sequence
  targeting sequence with GTCN PAM
gccggaccuggccuggggac

SEQ ID NO: 9581 - RNA, 20 nt, Artificial Sequence
  targeting sequence with GTCN PAM
cuacguaggggucagccgga

SEQ ID NO: 9582 - RNA, 20 nt, Artificial Sequence
  targeting sequence with GTCN PAM
acccuggagggaaguggaag

SEQ ID NO: 9583 - RNA, 20 nt, Artificial Sequence
  targeting sequence with GTCN PAM
cgaguguuuguucaggcugg

SEQ ID NO: 9584 - RNA, 20 nt, Artificial Sequence
  targeting sequence with GTCN PAM
aagggggucaggcuccccca

SEQ ID NO: 9585 - RNA, 20 nt, Artificial Sequence
  targeting sequence with GTCN PAM
ggcucccccaccgggaggaa

SEQ ID NO: 9586 - RNA, 20 nt, Artificial Sequence
  targeting sequence with GTCN PAM
gcucucccagccagguucuc

SEQ ID NO: 9587 - RNA, 20 nt, Artificial Sequence
  targeting sequence with GTCN PAM
uaguccaaacugugugcccc

SEQ ID NO: 9588 - RNA, 20 nt, Artificial Sequence
  targeting sequence with GTCN PAM
aaacugugugcccccgacaa

SEQ ID NO: 9589 - RNA, 20 nt, Artificial Sequence
  targeting sequence with GTCN PAM
ggggcacacaguuuggacua

SEQ ID NO: 9590 - RNA, 20 nt, Artificial Sequence
  targeting sequence with GTCN PAM
cauccugagguauugggggu

SEQ ID NO: 9591 - RNA, 20 nt, Artificial Sequence
  targeting sequence with GTCN PAM
ccagauacagucucauccug

SEQ ID NO: 9592 - RNA, 20 nt, Artificial Sequence
  targeting sequence with GTCN PAM
cgaacuccugggcucaagcg

SEQ ID NO: 9593 - RNA, 20 nt, Artificial Sequence
  targeting sequence with GTCN PAM
cacuguguugccuaggcugg

SEQ ID NO: 9594 - RNA, 20 nt, Artificial Sequence
  targeting sequence with GTCN PAM
cagcuacuuagaggaccgag

SEQ ID NO: 9595 - RNA, 20 nt, Artificial Sequence
  targeting sequence with GTCN PAM
ucuaaguagcugagacuacg

SEQ ID NO: 9596 - RNA, 20 nt, Artificial Sequence
  targeting sequence with GTCN PAM
aggcugcagugagcuguggc

SEQ ID NO: 9597 - RNA, 20 nt, Artificial Sequence
  targeting sequence with GTCN PAM
guggccucuuguuacggcag

SEQ ID NO: 9598 - RNA, 20 nt, Artificial Sequence
  targeting sequence with GTCN PAM
cggggccagggggagguuug

SEQ ID NO: 9599 - RNA, 20 nt, Artificial Sequence
  targeting sequence with GTCN PAM
aagaccaaggagucugcagg

SEQ ID NO: 9600 - RNA, 20 nt, Artificial Sequence
  targeting sequence with GTCN PAM
uggacuuggccuugcagccu

SEQ ID NO: 9601 - RNA, 20 nt, Artificial Sequence
  targeting sequence with GTCN PAM
gcaggguuggugucugcugc

SEQ ID NO: 9602 - RNA, 20 nt, Artificial Sequence
  targeting sequence with GTCN PAM
gcugcagccucucuccuugg

SEQ ID NO: 9603 - RNA, 20 nt, Artificial Sequence
  targeting sequence with GTCN PAM
ucacaugaucuucccucacu

SEQ ID NO: 9604 - RNA, 20 nt, Artificial Sequence
  targeting sequence with GTCN PAM
caaaaaaaaaaaaauaaaga

SEQ ID NO: 9605 - RNA, 20 nt, Artificial Sequence
  targeting sequence with GTCN PAM
gacucugucacccaggcugg

SEQ ID NO: 9606 - RNA, 20 nt, Artificial Sequence
  targeting sequence with GTCN PAM
gacccugucucaaaaaaaaa

SEQ ID NO: 9607 - RNA, 20 nt, Artificial Sequence
  targeting sequence with GTCN PAM
cccaggcuggagugcagugu

SEQ ID NO: 9608 - RNA, 20 nt, Artificial Sequence
  targeting sequence with GTCN PAM
aggcugcagugagcugagau

SEQ ID NO: 9609 - RNA, 20 nt, Artificial Sequence
  targeting sequence with GTCN PAM
cagcuacucaggaggcugag

SEQ ID NO: 9610 - RNA, 20 nt, Artificial Sequence
  targeting sequence with GTCN PAM
aggacggugcuuuugcugug

SEQ ID NO: 9611 - RNA, 20 nt, Artificial Sequence
  targeting sequence with GTCN PAM
uggaccaagcucagugagga

SEQ ID NO: 9612 - RNA, 20 nt, Artificial Sequence
  targeting sequence with GTCN PAM
ugcccuuuccagaucucccc

SEQ ID NO: 9613 - RNA, 20 nt, Artificial Sequence
  targeting sequence with GTCN PAM
gggagggccucuuuggaggg

SEQ ID NO: 9614 - RNA, 20 nt, Artificial Sequence
  targeting sequence with GTCN PAM
auccagugagagagauggau

SEQ ID NO: 9615 - RNA, 20 nt, Artificial Sequence
  targeting sequence with GTCN PAM
ccagggccacagcagggccc

SEQ ID NO: 9616 - RNA, 20 nt, Artificial Sequence
  targeting sequence with GTCN PAM
ggcucaccuugguacugcca

SEQ ID NO: 9617 - RNA, 20 nt, Artificial Sequence
  targeting sequence with GTCN PAM
cagggucucagaggcagagc

SEQ ID NO: 9618 - RNA, 20 nt, Artificial Sequence
  targeting sequence with GTCN PAM
cagaggcagagcagggccuc

SEQ ID NO: 9619 - RNA, 20 nt, Artificial Sequence
  targeting sequence with GTCN PAM
aaccaugaggacugccuacc

SEQ ID NO: 9620 - RNA, 20 nt, Artificial Sequence
  targeting sequence with GTCN PAM
ucaugguuggaccacccaca

SEQ ID NO: 9621 - RNA, 20 nt, Artificial Sequence
  targeting sequence with GTCN PAM
uccagugauuccuccagagg

SEQ ID NO: 9622 - RNA, 20 nt, Artificial Sequence
  targeting sequence with GTCN PAM
uaccugcuuagccaucuagc

SEQ ID NO: 9623 - RNA, 20 nt, Artificial Sequence
  targeting sequence with GTCN PAM
aaagugaugggcuguguuuc

SEQ ID NO: 9624 - RNA, 20 nt, Artificial Sequence
  targeting sequence with GTCN PAM
ccaaguccaaagugaugggc

SEQ ID NO: 9625 - RNA, 20 nt, Artificial Sequence
  targeting sequence with GTCN PAM
gaggaggacuugagcauagg

SEQ ID NO: 9626 - RNA, 20 nt, Artificial Sequence
  targeting sequence with GTCN PAM
uccucagacacuggagcagg

SEQ ID NO: 9627 - RNA, 20 nt, Artificial Sequence
  targeting sequence with GTCN PAM
ugggacucgugggguggagc

SEQ ID NO: 9628 - RNA, 20 nt, Artificial Sequence
  targeting sequence with GTCN PAM
caggacugagcaggcacgca

SEQ ID NO: 9629 - RNA, 20 nt, Artificial Sequence
  targeting sequence with GTCN PAM
ccaggugaaugcuccacccc

SEQ ID NO: 9630 - RNA, 20 nt, Artificial Sequence
  targeting sequence with GTCN PAM
cagccccagcucuaccccac

SEQ ID NO: 9631 - RNA, 20 nt, Artificial Sequence
  targeting sequence with GTCN PAM
acccugucuugagacagccc

SEQ ID NO: 9632 - RNA, 20 nt, Artificial Sequence
  targeting sequence with GTCN PAM
ugagacagcccuacucccac

SEQ ID NO: 9633 - RNA, 20 nt, Artificial Sequence
  targeting sequence with GTCN PAM
caagacaggguugacugagc

SEQ ID NO: 9634 - RNA, 20 nt, Artificial Sequence
  targeting sequence with GTCN PAM
cagccuuucaagugggagua

SEQ ID NO: 9635 - RNA, 20 nt, Artificial Sequence
  targeting sequence with GTCN PAM
uuucugucucagccuuucaa

SEQ ID NO: 9636 - RNA, 20 nt, Artificial Sequence
  targeting sequence with GTCN PAM
gucuuuucugucucagccuu

SEQ ID NO: 9637 - RNA, 20 nt, Artificial Sequence
  targeting sequence with GTCN PAM
aauguggcuggacgcggugg

SEQ ID NO: 9638 - RNA, 20 nt, Artificial Sequence
  targeting sequence with GTCN PAM
agccacauuugacuuuuuuu

SEQ ID NO: 9639 - RNA, 20 nt, Artificial Sequence
  targeting sequence with GTCN PAM
ggagauagagaccagccugg

SEQ ID NO: 9640 - RNA, 20 nt, Artificial Sequence
  targeting sequence with GTCN PAM
cuaucuccugaccucgugau

SEQ ID NO: 9641 - RNA, 20 nt, Artificial Sequence
  targeting sequence with GTCN PAM
acuaaaaauacaaaaaaaau

SEQ ID NO: 9642 - RNA, 20 nt, Artificial Sequence
  targeting sequence with GTCN PAM
caggagugcaguggcgcaau

SEQ ID NO: 9643 - RNA, 20 nt, Artificial Sequence
  targeting sequence with GTCN PAM
gucccaggagugcaguggcg

SEQ ID NO: 9644 - RNA, 20 nt, Artificial Sequence
  targeting sequence with GTCN PAM
cacucugucugucccaggag

SEQ ID NO: 9645 - RNA, 20 nt, Artificial Sequence
  targeting sequence with GTCN PAM
caaaaaaaaaaaaaaaaaaa

SEQ ID NO: 9646 - RNA, 20 nt, Artificial Sequence
  targeting sequence with GTCN PAM
aauguagacacgugcauccu

SEQ ID NO: 9647 - RNA, 20 nt, Artificial Sequence
  targeting sequence with GTCN PAM
acauuugacuuuuuuuuuuu

SEQ ID NO: 9648 - RNA, 20 nt, Artificial Sequence
  targeting sequence with GTCN PAM
agauauuggaauaaaauuaa

SEQ ID NO: 9649 - RNA, 20 nt, Artificial Sequence
  targeting sequence with GTCN PAM
auaaaaaccuguacagaugc

SEQ ID NO: 9650 - RNA, 20 nt, Artificial Sequence
  targeting sequence with GTCN PAM
cagcuccauugauaauuucu

SEQ ID NO: 9651 - RNA, 20 nt, Artificial Sequence
  targeting sequence with GTCN PAM
cugggcuggugaagagguaa

SEQ ID NO: 9652 - RNA, 20 nt, Artificial Sequence
  targeting sequence with GTCN PAM
gaguaucaagaggcuguucc

SEQ ID NO: 9653 - RNA, 20 nt, Artificial Sequence
  targeting sequence with GTCN PAM
uguggccuggccuuuuccaa

SEQ ID NO: 9654 - RNA, 20 nt, Artificial Sequence
  targeting sequence with GTCN PAM
cguccuguggccuggccuuu

SEQ ID NO: 9655 - RNA, 20 nt, Artificial Sequence
  targeting sequence with GTCN PAM
cuccccccagccccagcccu

SEQ ID NO: 9656 - RNA, 20 nt, Artificial Sequence
  targeting sequence with GTCN PAM
gucccuccccccagccccag

SEQ ID NO: 9657 - RNA, 20 nt, Artificial Sequence
  targeting sequence with GTCN PAM
uguucagagcauuuacaggg

SEQ ID NO: 9658 - RNA, 20 nt, Artificial Sequence
  targeting sequence with GTCN PAM
gguaaacuuugcacguuuau

SEQ ID NO: 9659 - RNA, 20 nt, Artificial Sequence
  targeting sequence with GTCN PAM
ccaggcuaagaaccuggcac

SEQ ID NO: 9660 - RNA, 20 nt, Artificial Sequence
  targeting sequence with GTCN PAM
cugcuuucugaccggcaggg

SEQ ID NO: 9661 - RNA, 20 nt, Artificial Sequence
  targeting sequence with GTCN PAM
gaaagcagggacccgccccg

SEQ ID NO: 9662 - RNA, 20 nt, Artificial Sequence
  targeting sequence with GTCN PAM
gcgcuuccguuccggcuccg

SEQ ID NO: 9663 - RNA, 20 nt, Artificial Sequence
  targeting sequence with GTCN PAM
ucccgcggccagaggugcga

SEQ ID NO: 9664 - RNA, 20 nt, Artificial Sequence
  targeting sequence with GTCN PAM
caccucuggccgcgggagga

SEQ ID NO: 9665 - RNA, 20 nt, Artificial Sequence
  targeting sequence with GTCN PAM
cgcagcccgugcucgucccg

SEQ ID NO: 9666 - RNA, 20 nt, Artificial Sequence
  targeting sequence with GTCN PAM
cgccucgcuuggagggagca

SEQ ID NO: 9667 - RNA, 20 nt, Artificial Sequence
  targeting sequence with GTCN PAM
ugugccuccgcuuccccggc

SEQ ID NO: 9668 - RNA, 20 nt, Artificial Sequence
  targeting sequence with GTCN PAM
ccgcaacuucuggguggagc

SEQ ID NO: 9669 - RNA, 20 nt, Artificial Sequence
  targeting sequence with GTCN PAM
ucugggggcagcaugcugcg

SEQ ID NO: 9670 - RNA, 20 nt, Artificial Sequence
  targeting sequence with GTCN PAM
cccacaccucauucaccccc

SEQ ID NO: 9671 - RNA, 20 nt, Artificial Sequence
  targeting sequence with GTCN PAM
uagaagccgcagaugccaag

SEQ ID NO: 9672 - RNA, 20 nt, Artificial Sequence
  targeting sequence with GTCN PAM
ccuccuuggcaucugcggcu

SEQ ID NO: 9673 - RNA, 20 nt, Artificial Sequence
  targeting sequence with GTCN PAM
cuugggagcaaagcugggga

SEQ ID NO: 9674 - RNA, 20 nt, Artificial Sequence
  targeting sequence with GTCN PAM
ccagcuuugcucccaaguga

SEQ ID NO: 9675 - RNA, 20 nt, Artificial Sequence
  targeting sequence with GTCN PAM
cugguuccuuuaguccccag

SEQ ID NO: 9676 - RNA, 20 nt, Artificial Sequence
  targeting sequence with GTCN PAM
ucagugccuggcccagagcg

SEQ ID NO: 9677 - RNA, 20 nt, Artificial Sequence
  targeting sequence with GTCN PAM
uguccucagggcccuguccg

SEQ ID NO: 9678 - RNA, 20 nt, Artificial Sequence
  targeting sequence with GTCN PAM
ucagggcccuguccggaaga

SEQ ID NO: 9679 - RNA, 20 nt, Artificial Sequence
  targeting sequence with GTCN PAM
ggaagaggacugggcagccu

SEQ ID NO: 9680 - RNA, 20 nt, Artificial Sequence
  targeting sequence with GTCN PAM
ucuuccggacagggcccuga

SEQ ID NO: 9681 - RNA, 20 nt, Artificial Sequence
  targeting sequence with GTCN PAM
gcggcaaugaaugaauguuc

SEQ ID NO: 9682 - RNA, 20 nt, Artificial Sequence
  targeting sequence with GTCN PAM
cuugggcggucauuggaggc

SEQ ID NO: 9683 - RNA, 20 nt, Artificial Sequence
  targeting sequence with GTCN PAM
uuggaggcucugggaggcua

SEQ ID NO: 9684 - RNA, 20 nt, Artificial Sequence
  targeting sequence with GTCN PAM
gcgagggccgcguggaugug

SEQ ID NO: 9685 - RNA, 20 nt, Artificial Sequence
  targeting sequence with GTCN PAM
cccacucucacgccccucca

SEQ ID NO: 9686 - RNA, 20 nt, Artificial Sequence
  targeting sequence with GTCN PAM
ggucucccacucucacgccc

SEQ ID NO: 9687 - RNA, 20 nt, Artificial Sequence
  targeting sequence with GTCN PAM
caacuccagccacuccccuc

SEQ ID NO: 9688 - RNA, 20 nt, Artificial Sequence
  targeting sequence with GTCN PAM
aagccccaccguuuccuucu

SEQ ID NO: 9689 - RNA, 20 nt, Artificial Sequence
  targeting sequence with GTCN PAM
ggaaggcuuuagaucuaguc

SEQ ID NO: 9690 - RNA, 20 nt, Artificial Sequence
  targeting sequence with GTCN PAM
cgcuuggucacuuccgucuc

SEQ ID NO: 9691 - RNA, 20 nt, Artificial Sequence
  targeting sequence with GTCN PAM
cuuccgucuccgggccucag

SEQ ID NO: 9692 - RNA, 20 nt, Artificial Sequence
  targeting sequence with GTCN PAM
ccgggccucagcuucccagg

SEQ ID NO: 9693 - RNA, 20 nt, Artificial Sequence
  targeting sequence with GTCN PAM
uacuaaucuuggcuugagag

SEQ ID NO: 9694 - RNA, 20 nt, Artificial Sequence
  targeting sequence with GTCN PAM
cucugccucugcgaaccgcu

SEQ ID NO: 9695 - RNA, 20 nt, Artificial Sequence
  targeting sequence with GTCN PAM
ggagcccagaccccaggcag

SEQ ID NO: 9696 - RNA, 20 nt, Artificial Sequence
  targeting sequence with GTCN PAM
gggcucccgacguuccugcc

SEQ ID NO: 9697 - RNA, 20 nt, Artificial Sequence
  targeting sequence with GTCN PAM
uggacacagagggugcgcuc

SEQ ID NO: 9698 - RNA, 20 nt, Artificial Sequence
  targeting sequence with GTCN PAM
aagaccuuaaacucccugcc

SEQ ID NO: 9699 - RNA, 20 nt, Artificial Sequence
  targeting sequence with GTCN PAM
ccgcuuuguggcugcuucga

SEQ ID NO: 9700 - RNA, 20 nt, Artificial Sequence
  targeting sequence with GTCN PAM
cugucaccgcuuuguggcug

SEQ ID NO: 9701 - RNA, 20 nt, Artificial Sequence
  targeting sequence with GTCN PAM
uccaauguguauugcccaag

SEQ ID NO: 9702 - RNA, 20 nt, Artificial Sequence
  targeting sequence with GTCN PAM
uuguucuugggcaauacaca

SEQ ID NO: 9703 - RNA, 20 nt, Artificial Sequence
  targeting sequence with GTCN PAM
caacgaggucuuuuauagca

SEQ ID NO: 9704 - RNA, 20 nt, Artificial Sequence
  targeting sequence with GTCN PAM
uuuauagcacauccccuucc

SEQ ID NO: 9705 - RNA, 20 nt, Artificial Sequence
  targeting sequence with GTCN PAM
uaaauaauaauaauuaaauu

SEQ ID NO: 9706 - RNA, 20 nt, Artificial Sequence
  targeting sequence with GTCN PAM
cgcucugucgcccaggcugg

SEQ ID NO: 9707 - RNA, 20 nt, Artificial Sequence
  targeting sequence with GTCN PAM
cccaggcuggagugcagugg

SEQ ID NO: 9708 - RNA, 20 nt, Artificial Sequence
  targeting sequence with GTCN PAM
cagcuacucgggaggcugag

SEQ ID NO: 9709 - RNA, 20 nt, Artificial Sequence
  targeting sequence with GTCN PAM
cuacuaaaaauacaaaaaau

SEQ ID NO: 9710 - RNA, 20 nt, Artificial Sequence
  targeting sequence with GTCN PAM
ggucucgaucuccugaccuc

SEQ ID NO: 9711 - RNA, 20 nt, Artificial Sequence
  targeting sequence with GTCN PAM
cgaucuccugaccucgugau

SEQ ID NO: 9712 - RNA, 20 nt, Artificial Sequence
  targeting sequence with GTCN PAM
ggagaucgagaccagacugg

SEQ ID NO: 9713 - RNA, 20 nt, Artificial Sequence
  targeting sequence with GTCN PAM
caguggcucacgccuguaau

SEQ ID NO: 9714 - RNA, 20 nt, Artificial Sequence
  targeting sequence with GTCN PAM
caaaacaaacaaacgaaaua

SEQ ID NO: 9715 - RNA, 20 nt, Artificial Sequence
  targeting sequence with GTCN PAM
uccaggcuggagugcagugg

SEQ ID NO: 9716 - RNA, 20 nt, Artificial Sequence
  targeting sequence with GTCN PAM
gcagaguagcugggacuaug

SEQ ID NO: 9717 - RNA, 20 nt, Artificial Sequence
  targeting sequence with GTCN PAM
cagcuacucugcagacugag

SEQ ID NO: 9718 - RNA, 20 nt, Artificial Sequence
  targeting sequence with GTCN PAM
caggauggggaguauguucc

SEQ ID NO: 9719 - RNA, 20 nt, Artificial Sequence
  targeting sequence with GTCN PAM
gucucaggauggggaguaug

SEQ ID NO: 9720 - RNA, 20 nt, Artificial Sequence
  targeting sequence with GTCN PAM
acuaauagagguuaaaaaua

SEQ ID NO: 9721 - RNA, 20 nt, Artificial Sequence
  targeting sequence with GTCN PAM
cauaaauaagcaaagggaaa

SEQ ID NO: 9722 - RNA, 20 nt, Artificial Sequence
  targeting sequence with GTCN PAM
ugucacauaaauaagcaaag

SEQ ID NO: 9723 - RNA, 20 nt, Artificial Sequence
  targeting sequence with GTCN PAM
cuuccaauuucucauuuuua

SEQ ID NO: 9724 - RNA, 20 nt, Artificial Sequence
  targeting sequence with GTCN PAM
gaagucccagcuacuggaga

SEQ ID NO: 9725 - RNA, 20 nt, Artificial Sequence
  targeting sequence with GTCN PAM
cagcuacuggagaggcugag

SEQ ID NO: 9726 - RNA, 20 nt, Artificial Sequence
  targeting sequence with GTCN PAM
caagugauccuccugccuca

SEQ ID NO: 9727 - RNA, 20 nt, Artificial Sequence
  targeting sequence with GTCN PAM
aggaugcagugagcugugau

SEQ ID NO: 9728 - RNA, 20 nt, Artificial Sequence
  targeting sequence with GTCN PAM
cacugucacccaggcugggg

SEQ ID NO: 9729 - RNA, 20 nt, Artificial Sequence
  targeting sequence with GTCN PAM
cccaggcuggggugcagugg

SEQ ID NO: 9730 - RNA, 20 nt, Artificial Sequence
  targeting sequence with GTCN PAM
ggaguucgagaccagccugg

SEQ ID NO: 9731 - RNA, 20 nt, Artificial Sequence
  targeting sequence with GTCN PAM
cgaacuccugaccucaggug

SEQ ID NO: 9732 - RNA, 20 nt, Artificial Sequence
  targeting sequence with GTCN PAM
guguuggccuagcgcagugg

SEQ ID NO: 9733 - RNA, 20 nt, Artificial Sequence
  targeting sequence with GTCN PAM
uaaacucaaaugauccuccu

SEQ ID NO: 9734 - RNA, 20 nt, Artificial Sequence
  targeting sequence with GTCN PAM
cacucuaucucccaggcugg

SEQ ID NO: 9735 - RNA, 20 nt, Artificial Sequence
  targeting sequence with GTCN PAM
cuaaaaugaauaaauaaaua

SEQ ID NO: 9736 - RNA, 20 nt, Artificial Sequence
  targeting sequence with GTCN PAM
gcuggagggcagccuauggc

SEQ ID NO: 9737 - RNA, 20 nt, Artificial Sequence
  targeting sequence with GTCN PAM
ucuccugaugcaugagauua

SEQ ID NO: 9738 - RNA, 20 nt, Artificial Sequence
  targeting sequence with GTCN PAM
gggauuggggccgcugccuc

SEQ ID NO: 9739 - RNA, 20 nt, Artificial Sequence
  targeting sequence with GTCN PAM
guggcuggggagggugggcu

SEQ ID NO: 9740 - RNA, 20 nt, Artificial Sequence
  targeting sequence with GTCN PAM
caggggcuguucagcagggg

SEQ ID NO: 9741 - RNA, 20 nt, Artificial Sequence
  targeting sequence with GTCN PAM
ucaagcacagacaccgcuca

SEQ ID NO: 9742 - RNA, 20 nt, Artificial Sequence
  targeting sequence with GTCN PAM
gugcuugaggaccagcucca

SEQ ID NO: 9743 - RNA, 20 nt, Artificial Sequence
  targeting sequence with GTCN PAM
aagcccaaggcccugcagag

SEQ ID NO: 9744 - RNA, 20 nt, Artificial Sequence
  targeting sequence with GTCN PAM
acccagcuggaugauaagca

SEQ ID NO: 9745 - RNA, 20 nt, Artificial Sequence
  targeting sequence with GTCN PAM
acacuucuguccacccagcu

SEQ ID NO: 9746 - RNA, 20 nt, Artificial Sequence
  targeting sequence with GTCN PAM
ccaggcuugggcagaaggcu

SEQ ID NO: 9747 - RNA, 20 nt, Artificial Sequence
  targeting sequence with GTCN PAM
gggcuuugccugccucccuu

SEQ ID NO: 9748 - RNA, 20 nt, Artificial Sequence
  targeting sequence with GTCN PAM
caagggaggcaggcaaagcc

SEQ ID NO: 9749 - RNA, 20 nt, Artificial Sequence
  targeting sequence with GTCN PAM
auccagacugugcucuggca

SEQ ID NO: 9750 - RNA, 20 nt, Artificial Sequence
  targeting sequence with GTCN PAM
ggccaacuggagucgauccu

SEQ ID NO: 9751 - RNA, 20 nt, Artificial Sequence
  targeting sequence with GTCN PAM
aucccuugagccagagguca

SEQ ID NO: 9752 - RNA, 20 nt, Artificial Sequence
  targeting sequence with GTCN PAM
ggugggaauuaguuucaugu

SEQ ID NO: 9753 - RNA, 20 nt, Artificial Sequence
  targeting sequence with GTCN PAM
agagauggagaccauucugg

SEQ ID NO: 9754 - RNA, 20 nt, Artificial Sequence
  targeting sequence with GTCN PAM
uuugccuauugauccuguaa

SEQ ID NO: 9755 - RNA, 20 nt, Artificial Sequence
  targeting sequence with GTCN PAM
aagguauuuggucuuuugcc

SEQ ID NO: 9756 - RNA, 20 nt, Artificial Sequence
  targeting sequence with GTCN PAM
ucccaaucaguuggguguuu

SEQ ID NO: 9757 - RNA, 20 nt, Artificial Sequence
  targeting sequence with GTCN PAM
ccuuucaacaccuguaaugg

SEQ ID NO: 9758 - RNA, 20 nt, Artificial Sequence
  targeting sequence with GTCN PAM
caagguaaaccuuuagcgug

SEQ ID NO: 9759 - RNA, 20 nt, Artificial Sequence
  targeting sequence with GTCN PAM
cuuaaggcuccuuauccauu

SEQ ID NO: 9760 - RNA, 20 nt, Artificial Sequence
  targeting sequence with GTCN PAM
agauaccauggccuccuccg

SEQ ID NO: 9761 - RNA, 20 nt, Artificial Sequence
  targeting sequence with GTCN PAM
ucugccucuuuaccacaugu

SEQ ID NO: 9762 - RNA, 20 nt, Artificial Sequence
  targeting sequence with GTCN PAM
uguauagaguggcucuuaag

SEQ ID NO: 9763 - RNA, 20 nt, Artificial Sequence
  targeting sequence with GTCN PAM
ccucugcacgugcuccuccu

SEQ ID NO: 9764 - RNA, 20 nt, Artificial Sequence
  targeting sequence with GTCN PAM
cgcugccagaagcccugcgg

SEQ ID NO: 9765 - RNA, 20 nt, Artificial Sequence
  targeting sequence with GTCN PAM
cauagaugucccgcugccag

SEQ ID NO: 9766 - RNA, 20 nt, Artificial Sequence
  targeting sequence with GTCN PAM
agagcccccucuaaggcaau

SEQ ID NO: 9767 - RNA, 20 nt, Artificial Sequence
  targeting sequence with GTCN PAM
aguaugaucugucauuagga

SEQ ID NO: 9768 - RNA, 20 nt, Artificial Sequence
  targeting sequence with GTCN PAM
uuaggaacacuaucaauucu

SEQ ID NO: 9769 - RNA, 20 nt, Artificial Sequence
  targeting sequence with GTCN PAM
agugagaagugaaaaaagaa

SEQ ID NO: 9770 - RNA, 20 nt, Artificial Sequence
  targeting sequence with GTCN PAM
cccauuuauguugagaauau

SEQ ID NO: 9771 - RNA, 20 nt, Artificial Sequence
  targeting sequence with GTCN PAM
uuuuucuuuucuuuuuuuuu

SEQ ID NO: 9772 - RNA, 20 nt, Artificial Sequence
  targeting sequence with GTCN PAM
caaaaaaaaaaaaagaaaag

SEQ ID NO: 9773 - RNA, 20 nt, Artificial Sequence
  targeting sequence with GTCN PAM
cgcucugucgcccuggcugc

SEQ ID NO: 9774 - RNA, 20 nt, Artificial Sequence
  targeting sequence with GTCN PAM
cccuggcugcuggagugcag

SEQ ID NO: 9775 - RNA, 20 nt, Artificial Sequence
  targeting sequence with GTCN PAM
cugcacuccagcagccaggg

SEQ ID NO: 9776 - RNA, 20 nt, Artificial Sequence
  targeting sequence with GTCN PAM
cagcuacucgggaggcugag

SEQ ID NO: 9777 - RNA, 20 nt, Artificial Sequence
  targeting sequence with GTCN PAM
gaugaaaaugcugaguucug

SEQ ID NO: 9778 - RNA, 20 nt, Artificial Sequence
  targeting sequence with GTCN PAM
ucacugcauuugguuuuguu

SEQ ID NO: 9779 - RNA, 20 nt, Artificial Sequence
  targeting sequence with GTCN PAM
aaauaaugagcguauuuuca

SEQ ID NO: 9780 - RNA, 20 nt, Artificial Sequence
  targeting sequence with GTCN PAM
uggcaucagacuuuuacucc

SEQ ID NO: 9781 - RNA, 20 nt, Artificial Sequence
  targeting sequence with GTCN PAM
gaugccaagacaaauauugg

SEQ ID NO: 9782 - RNA, 20 nt, Artificial Sequence
  targeting sequence with GTCN PAM
ucucucuccccuguucugaa

SEQ ID NO: 9783 - RNA, 20 nt, Artificial Sequence
  targeting sequence with GTCN PAM
gugaaguauaaaauuuaacc

SEQ ID NO: 9784 - RNA, 20 nt, Artificial Sequence
  targeting sequence with GTCN PAM
uaguaaggaaggcuuuccac

SEQ ID NO: 9785 - RNA, 20 nt, Artificial Sequence
  targeting sequence with GTCN PAM
gcuccaauuuccauuccuug

SEQ ID NO: 9786 - RNA, 20 nt, Artificial Sequence
  targeting sequence with GTCN PAM
augccucuagccugggugag

SEQ ID NO: 9787 - RNA, 20 nt, Artificial Sequence
  targeting sequence with GTCN PAM
ccucauuugaaugcuccucu

SEQ ID NO: 9788 - RNA, 20 nt, Artificial Sequence
  targeting sequence with GTCN PAM
gagcucuucuauaaccucgc

SEQ ID NO: 9789 - RNA, 20 nt, Artificial Sequence
  targeting sequence with GTCN PAM
ugucagagcucuucuauaac

SEQ ID NO: 9790 - RNA, 20 nt, Artificial Sequence
  targeting sequence with GTCN PAM
ggugaauaauuaagggacaa

SEQ ID NO: 9791 - RNA, 20 nt, Artificial Sequence
  targeting sequence with GTCN PAM
cuuaauuauucaccagaccc

SEQ ID NO: 9792 - RNA, 20 nt, Artificial Sequence
  targeting sequence with GTCN PAM
uuccuaagacaguuugagaa

SEQ ID NO: 9793 - RNA, 20 nt, Artificial Sequence
  targeting sequence with GTCN PAM
uaggaaggaccuucagugca

SEQ ID NO: 9794 - RNA, 20 nt, Artificial Sequence
  targeting sequence with GTCN PAM
gcaugggacuauuuggcugg

SEQ ID NO: 9795 - RNA, 20 nt, Artificial Sequence
  targeting sequence with GTCN PAM
caugcugacuuucuaucuuc

SEQ ID NO: 9796 - RNA, 20 nt, Artificial Sequence
  targeting sequence with GTCN PAM
cagggcaaauaggaacaguu

SEQ ID NO: 9797 - RNA, 20 nt, Artificial Sequence
  targeting sequence with GTCN PAM
cuuugauagauggauugaaa

SEQ ID NO: 9798 - RNA, 20 nt, Artificial Sequence
  targeting sequence with GTCN PAM
ucaggcaguuugggggacuc

SEQ ID NO: 9799 - RNA, 20 nt, Artificial Sequence
  targeting sequence with GTCN PAM
cccaaacugccugaagacuu

SEQ ID NO: 9800 - RNA, 20 nt, Artificial Sequence
  targeting sequence with GTCN PAM
guucaaaaaguucauagugu

SEQ ID NO: 9801 - RNA, 20 nt, Artificial Sequence
  targeting sequence with GTCN PAM
uuuggcacuccugccuaaaa

SEQ ID NO: 9802 - RNA, 20 nt, Artificial Sequence
  targeting sequence with GTCN PAM
cugcaauauuuuuaggcaaa

SEQ ID NO: 9803 - RNA, 20 nt, Artificial Sequence
  targeting sequence with GTCN PAM
ccaagccuauauguauuaaa

SEQ ID NO: 9804 - RNA, 20 nt, Artificial Sequence
  targeting sequence with GTCN PAM
ucaccccaaccucagcugau

SEQ ID NO: 9805 - RNA, 20 nt, Artificial Sequence
  targeting sequence with GTCN PAM
uuucagacaggcagggcaau

SEQ ID NO: 9806 - RNA, 20 nt, Artificial Sequence
  targeting sequence with GTCN PAM
gaaaggacaguuuaccuaau

SEQ ID NO: 9807 - RNA, 20 nt, Artificial Sequence
  targeting sequence with GTCN PAM
caaaugcuguucccucuuag

SEQ ID NO: 9808 - RNA, 20 nt, Artificial Sequence
  targeting sequence with GTCN PAM
cauaaccaguuccaucaucc

SEQ ID NO: 9809 - RNA, 20 nt, Artificial Sequence
  targeting sequence with GTCN PAM
acugagcauaauuagguuag

SEQ ID NO: 9810 - RNA, 20 nt, Artificial Sequence
  targeting sequence with GTCN PAM
guuuacauuauaggaagcug

SEQ ID NO: 9811 - RNA, 20 nt, Artificial Sequence
  targeting sequence with GTCN PAM
ugcuaaccugacauuuccuu

SEQ ID NO: 9812 - RNA, 20 nt, Artificial Sequence
  targeting sequence with GTCN PAM
gguuagcaggacccaaguuu

SEQ ID NO: 9813 - RNA, 20 nt, Artificial Sequence
  targeting sequence with GTCN PAM
gccuaagagaaucaaccaaa

SEQ ID NO: 9814 - RNA, 20 nt, Artificial Sequence
  targeting sequence with GTCN PAM
ucauuuuggccccagcauuc

SEQ ID NO: 9815 - RNA, 20 nt, Artificial Sequence
  targeting sequence with GTCN PAM
ucugucuucauuuuggcccc

SEQ ID NO: 9816 - RNA, 20 nt, Artificial Sequence
  targeting sequence with GTCN PAM
uuguguuuccuuaauuuauu

SEQ ID NO: 9817 - RNA, 20 nt, Artificial Sequence
  targeting sequence with GTCN PAM
uaaauaaguccuuguguuuc

SEQ ID NO: 9818 - RNA, 20 nt, Artificial Sequence
  targeting sequence with GTCN PAM
caacuuuuccuaaagacaac

SEQ ID NO: 9819 - RNA, 20 nt, Artificial Sequence
  targeting sequence with GTCN PAM
uuaggaaaaguugagacuau

SEQ ID NO: 9820 - RNA, 20 nt, Artificial Sequence
  targeting sequence with GTCN PAM
ggacaccaaaaagcagcagc

SEQ ID NO: 9821 - RNA, 20 nt, Artificial Sequence
  targeting sequence with GTCN PAM
cgacauaccuacgcccccgu

SEQ ID NO: 9822 - RNA, 20 nt, Artificial Sequence
  targeting sequence with GTCN PAM
ugcuguaaaugcugcccucu

SEQ ID NO: 9823 - RNA, 20 nt, Artificial Sequence
  targeting sequence with GTCN PAM
ugaaacaguuugaguaagaa

SEQ ID NO: 9824 - RNA, 20 nt, Artificial Sequence
  targeting sequence with GTCN PAM
uuuauuuuuccuuugaaaua

SEQ ID NO: 9825 - RNA, 20 nt, Artificial Sequence
  targeting sequence with GTCN PAM
aaaaaaacccaauaauaaua

SEQ ID NO: 9826 - RNA, 20 nt, Artificial Sequence
  targeting sequence with GTCN PAM
uacuacaguauuuuuaagua

SEQ ID NO: 9827 - RNA, 20 nt, Artificial Sequence
  targeting sequence with GTCN PAM
agguuaaggggcagguucaa

SEQ ID NO: 9828 - RNA, 20 nt, Artificial Sequence
  targeting sequence with GTCN PAM
guggaagaacacauggaucu

SEQ ID NO: 9829 - RNA, 20 nt, Artificial Sequence
  targeting sequence with GTCN PAM
gaauuuuuggauucggggug

SEQ ID NO: 9830 - RNA, 20 nt, Artificial Sequence
  targeting sequence with GTCN PAM
gggauagggagaggugauga

SEQ ID NO: 9831 - RNA, 20 nt, Artificial Sequence
  targeting sequence with GTCN PAM
gggcucaucaccucucccua

SEQ ID NO: 9832 - RNA, 20 nt, Artificial Sequence
  targeting sequence with GTCN PAM
uucaagccacaauuuagauu

SEQ ID NO: 9833 - RNA, 20 nt, Artificial Sequence
  targeting sequence with GTCN PAM
uuuaauaugaaccaacaauc

SEQ ID NO: 9834 - RNA, 20 nt, Artificial Sequence
  targeting sequence with GTCN PAM
cuugaagaaaaaaacauuau

SEQ ID NO: 9835 - RNA, 20 nt, Artificial Sequence
  targeting sequence with GTCN PAM
aacucucugcugcaugcacu

SEQ ID NO: 9836 - RNA, 20 nt, Artificial Sequence
  targeting sequence with GTCN PAM
cagugcuuccagagaaaggc

SEQ ID NO: 9837 - RNA, 20 nt, Artificial Sequence
  targeting sequence with GTCN PAM
uguugcgagucuucaugagg

SEQ ID NO: 9838 - RNA, 20 nt, Artificial Sequence
  targeting sequence with GTCN PAM
ucaugagggggaccacacag

SEQ ID NO: 9839 - RNA, 20 nt, Artificial Sequence
  targeting sequence with GTCN PAM
cccucaugaagacucgcaac

SEQ ID NO: 9840 - RNA, 20 nt, Artificial Sequence
  targeting sequence with GTCN PAM
ccacuguagccaacugugug

SEQ ID NO: 9841 - RNA, 20 nt, Artificial Sequence
  targeting sequence with GTCN PAM
uugucuccacuguagccaac

SEQ ID NO: 9842 - RNA, 20 nt, Artificial Sequence
  targeting sequence with GTCN PAM
uuuuggucuuugucuccacu

SEQ ID NO: 9843 - RNA, 20 nt, Artificial Sequence
  targeting sequence with GTCN PAM
uggcaguccuuuuggucuuu

SEQ ID NO: 9844 - RNA, 20 nt, Artificial Sequence
  targeting sequence with GTCN PAM
ggcaugccuccagggccucc

SEQ ID NO: 9845 - RNA, 20 nt, Artificial Sequence
  targeting sequence with GTCN PAM
gcaucucagaauacuuguga

SEQ ID NO: 9846 - RNA, 20 nt, Artificial Sequence
  targeting sequence with GTCN PAM
caggaagcaguggccacacu

SEQ ID NO: 9847 - RNA, 20 nt, Artificial Sequence
  targeting sequence with GTCN PAM
agaacauuuuaaugacaaga

SEQ ID NO: 9848 - RNA, 20 nt, Artificial Sequence
  targeting sequence with GTCN PAM
uuaaaauguucuagacuaaa

SEQ ID NO: 9849 - RNA, 20 nt, Artificial Sequence
  targeting sequence with GTCN PAM
ugucauuaaaauguucuaga

SEQ ID NO: 9850 - RNA, 20 nt, Artificial Sequence
  targeting sequence with GTCN PAM
cucuugacauuuccuucaau

SEQ ID NO: 9851 - RNA, 20 nt, Artificial Sequence
  targeting sequence with GTCN PAM
agagagacuauccuauuuga

SEQ ID NO: 9852 - RNA, 20 nt, Artificial Sequence
  targeting sequence with GTCN PAM
cugaggcaguacuguuugug

SEQ ID NO: 9853 - RNA, 20 nt, Artificial Sequence
  targeting sequence with GTCN PAM
aggaaaauauacggaauuau

SEQ ID NO: 9854 - RNA, 20 nt, Artificial Sequence
  targeting sequence with GTCN PAM
uaggauuuuauuuuuaguuu

SEQ ID NO: 9855 - RNA, 20 nt, Artificial Sequence
  targeting sequence with GTCN PAM
guucauuuggcugggggucu

SEQ ID NO: 9856 - RNA, 20 nt, Artificial Sequence
  targeting sequence with GTCN PAM
acuuuggccaagagggaguc

SEQ ID NO: 9857 - RNA, 20 nt, Artificial Sequence
  targeting sequence with GTCN PAM
agccucuuucccaucauugc

SEQ ID NO: 9858 - RNA, 20 nt, Artificial Sequence
  targeting sequence with GTCN PAM
uuugugccacaacucaaaaa

SEQ ID NO: 9859 - RNA, 20 nt, Artificial Sequence
  targeting sequence with GTCN PAM
uaugaucucuauuuucacau

SEQ ID NO: 9860 - RNA, 20 nt, Artificial Sequence
  targeting sequence with GTCN PAM
gucuuaugaucucuauuuuc

SEQ ID NO: 9861 - RNA, 20 nt, Artificial Sequence
  targeting sequence with GTCN PAM
auucugucagucuuaugauc

SEQ ID NO: 9862 - RNA, 20 nt, Artificial Sequence
  targeting sequence with GTCN PAM
uacugccacaaagaguccau

SEQ ID NO: 9863 - RNA, 20 nt, Artificial Sequence
  targeting sequence with GTCN PAM
uguuuauaauuugaugucuu

SEQ ID NO: 9864 - RNA, 20 nt, Artificial Sequence
  targeting sequence with GTCN PAM
ggcauggccuuaggucuugu

SEQ ID NO: 9865 - RNA, 20 nt, Artificial Sequence
  targeting sequence with GTCN PAM
gguuggaaagaaagccacau

SEQ ID NO: 9866 - RNA, 20 nt, Artificial Sequence
  targeting sequence with GTCN PAM
ugugaugcuauaccugaguc

SEQ ID NO: 9867 - RNA, 20 nt, Artificial Sequence
  targeting sequence with GTCN PAM
gucaugugaugcuauaccug

SEQ ID NO: 9868 - RNA, 20 nt, Artificial Sequence
  targeting sequence with GTCN PAM
guugucugucaugugaugcu

SEQ ID NO: 9869 - RNA, 20 nt, Artificial Sequence
  targeting sequence with GTCN PAM
uuacacaaagcuuaacucuu

SEQ ID NO: 9870 - RNA, 20 nt, Artificial Sequence
  targeting sequence with GTCN PAM
guugaaagaguuaagcuuug

SEQ ID NO: 9871 - RNA, 20 nt, Artificial Sequence
  targeting sequence with GTCN PAM
uagugggcuuuaggaauuuu

SEQ ID NO: 9872 - RNA, 20 nt, Artificial Sequence
  targeting sequence with GTCN PAM
cccugaaauguauaaagcca

SEQ ID NO: 9873 - RNA, 20 nt, Artificial Sequence
  targeting sequence with GTCN PAM
ugagaaaauaugccugaagc

SEQ ID NO: 9874 - RNA, 20 nt, Artificial Sequence
  targeting sequence with GTCN PAM
gaagagguccugagaaaaua

SEQ ID NO: 9875 - RNA, 20 nt, Artificial Sequence
  targeting sequence with GTCN PAM
uggugaucucuccaugucaa

SEQ ID NO: 9876 - RNA, 20 nt, Artificial Sequence
  targeting sequence with GTCN PAM
auacacagaaucuaccucau

SEQ ID NO: 9877 - RNA, 20 nt, Artificial Sequence
  targeting sequence with GTCN PAM
agucaaucccugacaucagu

SEQ ID NO: 9878 - RNA, 20 nt, Artificial Sequence
  targeting sequence with GTCN PAM
aucccugacaucaguggaaa

SEQ ID NO: 9879 - RNA, 20 nt, Artificial Sequence
  targeting sequence with GTCN PAM
gggauugacuugacuuagaa

SEQ ID NO: 9880 - RNA, 20 nt, Artificial Sequence
  targeting sequence with GTCN PAM
ucuuuacagaggaucaaacu

SEQ ID NO: 9881 - RNA, 20 nt, Artificial Sequence
  targeting sequence with GTCN PAM
agugugugggcauagugucc

SEQ ID NO: 9882 - RNA, 20 nt, Artificial Sequence
  targeting sequence with GTCN PAM
auucuugcuauuuuuuugag

SEQ ID NO: 9883 - RNA, 20 nt, Artificial Sequence
  targeting sequence with GTCN PAM
caaaaaaauagcaagaauag

SEQ ID NO: 9884 - RNA, 20 nt, Artificial Sequence
  targeting sequence with GTCN PAM
cgcucugucacccaggcuag

SEQ ID NO: 9885 - RNA, 20 nt, Artificial Sequence
  targeting sequence with GTCN PAM
cccaggcuagagugcagcgg

SEQ ID NO: 9886 - RNA, 20 nt, Artificial Sequence
  targeting sequence with GTCN PAM
cagcuacucaggaggcugag

SEQ ID NO: 9887 - RNA, 20 nt, Artificial Sequence
  targeting sequence with GTCN PAM
ugaucuccugaccuugugau

SEQ ID NO: 9888 - RNA, 20 nt, Artificial Sequence
  targeting sequence with GTCN PAM
ggagaucaagaccauccuaa

SEQ ID NO: 9889 - RNA, 20 nt, Artificial Sequence
  targeting sequence with GTCN PAM
auauuaccaagaccugauug

SEQ ID NO: 9890 - RNA, 20 nt, Artificial Sequence
  targeting sequence with GTCN PAM
ugguaauauagacuuuuaaa

SEQ ID NO: 9891 - RNA, 20 nt, Artificial Sequence
  targeting sequence with GTCN PAM
cuaaugcauuacuaauguuu

SEQ ID NO: 9892 - RNA, 20 nt, Artificial Sequence
  targeting sequence with GTCN PAM
aauguuuagaauuaccagua

SEQ ID NO: 9893 - RNA, 20 nt, Artificial Sequence
  targeting sequence with GTCN PAM
uauaacauaugcaauuagaa

SEQ ID NO: 9894 - RNA, 20 nt, Artificial Sequence
  targeting sequence with GTCN PAM
guucuccucaaggucauagc

SEQ ID NO: 9895 - RNA, 20 nt, Artificial Sequence
  targeting sequence with GTCN PAM
uagccuucacucaugaguuu

SEQ ID NO: 9896 - RNA, 20 nt, Artificial Sequence
  targeting sequence with GTCN PAM
gauauccuccaaaguugguc

SEQ ID NO: 9897 - RNA, 20 nt, Artificial Sequence
  targeting sequence with GTCN PAM
gagccuugaguuuuucuggu

SEQ ID NO: 9898 - RNA, 20 nt, Artificial Sequence
  targeting sequence with GTCN PAM
ugguuuccugggauuugagg

SEQ ID NO: 9899 - RNA, 20 nt, Artificial Sequence
  targeting sequence with GTCN PAM
gaaguugcccaagccuuacc

SEQ ID NO: 9900 - RNA, 20 nt, Artificial Sequence
  targeting sequence with GTCN PAM
gucugaaguugcccaagccu

SEQ ID NO: 9901 - RNA, 20 nt, Artificial Sequence
  targeting sequence with GTCN PAM
auaguuggcgucagucugaa

SEQ ID NO: 9902 - RNA, 20 nt, Artificial Sequence
  targeting sequence with GTCN PAM
gucuauaguuggcgucaguc

SEQ ID NO: 9903 - RNA, 20 nt, Artificial Sequence
  targeting sequence with GTCN PAM
aguccagaaggaucuuagga

SEQ ID NO: 9904 - RNA, 20 nt, Artificial Sequence
  targeting sequence with GTCN PAM
agaaggaucuuaggaaaaaa

SEQ ID NO: 9905 - RNA, 20 nt, Artificial Sequence
  targeting sequence with GTCN PAM
agaucauuuacccagaugcc

SEQ ID NO: 9906 - RNA, 20 nt, Artificial Sequence
  targeting sequence with GTCN PAM
cagagaagggaagugggcca

SEQ ID NO: 9907 - RNA, 20 nt, Artificial Sequence
  targeting sequence with GTCN PAM
uucaaaaugcuuucauauga

SEQ ID NO: 9908 - RNA, 20 nt, Artificial Sequence
  targeting sequence with GTCN PAM
ggcaaugugccuauaugaga

SEQ ID NO: 9909 - RNA, 20 nt, Artificial Sequence
  targeting sequence with GTCN PAM
ucuccuucugugggaaaggg

SEQ ID NO: 9910 - RNA, 20 nt, Artificial Sequence
  targeting sequence with GTCN PAM
uugucuucuccuucuguggg

SEQ ID NO: 9911 - RNA, 20 nt, Artificial Sequence
  targeting sequence with GTCN PAM
gagcugcuuuugaagcagua

SEQ ID NO: 9912 - RNA, 20 nt, Artificial Sequence
  targeting sequence with GTCN PAM
auuacugcuucaaaagcagc

SEQ ID NO: 9913 - RNA, 20 nt, Artificial Sequence
  targeting sequence with GTCN PAM
gcuugguacuugggaaaugu

SEQ ID NO: 9914 - RNA, 20 nt, Artificial Sequence
  targeting sequence with GTCN PAM
cgggcccguucauaggacug

SEQ ID NO: 9915 - RNA, 20 nt, Artificial Sequence
  targeting sequence with GTCN PAM
uaugaacgggcccgggacau

SEQ ID NO: 9916 - RNA, 20 nt, Artificial Sequence
  targeting sequence with GTCN PAM
uuuagcuguucuuccaaucg

SEQ ID NO: 9917 - RNA, 20 nt, Artificial Sequence
  targeting sequence with GTCN PAM
cuggaaaagauagcuugucu

SEQ ID NO: 9918 - RNA, 20 nt, Artificial Sequence
  targeting sequence with GTCN PAM
caaggccaaaucacguggca

SEQ ID NO: 9919 - RNA, 20 nt, Artificial Sequence
  targeting sequence with GTCN PAM
uaauauuaugguuaugcuca

SEQ ID NO: 9920 - RNA, 20 nt, Artificial Sequence
  targeting sequence with GTCN PAM
uuaggcuccucugaacaaca

SEQ ID NO: 9921 - RNA, 20 nt, Artificial Sequence
  targeting sequence with GTCN PAM
ccaguagcuuauuccagaac

SEQ ID NO: 9922 - RNA, 20 nt, Artificial Sequence
  targeting sequence with GTCN PAM
aucauccccauggccaaaca

SEQ ID NO: 9923 - RNA, 20 nt, Artificial Sequence
  targeting sequence with GTCN PAM
gggacacuucugucaacaaa

SEQ ID NO: 9924 - RNA, 20 nt, Artificial Sequence
  targeting sequence with GTCN PAM
cagacacuuguguuuggcca

SEQ ID NO: 9925 - RNA, 20 nt, Artificial Sequence
  targeting sequence with GTCN PAM
acaaauauuuacugagagcc

SEQ ID NO: 9926 - RNA, 20 nt, Artificial Sequence
  targeting sequence with GTCN PAM
ugcuuaccacaauauuccca

SEQ ID NO: 9927 - RNA, 20 nt, Artificial Sequence
  targeting sequence with GTCN PAM
uauaccucuacugaucuucu

SEQ ID NO: 9928 - RNA, 20 nt, Artificial Sequence
  targeting sequence with GTCN PAM
cccaaagugcugggauuaca

SEQ ID NO: 9929 - RNA, 20 nt, Artificial Sequence
  targeting sequence with GTCN PAM
ucuuugggcucauuuaauau

SEQ ID NO: 9930 - RNA, 20 nt, Artificial Sequence
  targeting sequence with GTCN PAM
caugaugaauauguguuuuu

SEQ ID NO: 9931 - RNA, 20 nt, Artificial Sequence
  targeting sequence with GTCN PAM
ucucauaguggugaagaaga

SEQ ID NO: 9932 - RNA, 20 nt, Artificial Sequence
  targeting sequence with GTCN PAM
ucuucaccacuaugagaaga

SEQ ID NO: 9933 - RNA, 20 nt, Artificial Sequence
  targeting sequence with GTCN PAM
gucuucuucaccacuaugag

SEQ ID NO: 9934 - RNA, 20 nt, Artificial Sequence
  targeting sequence with GTCN PAM
caggaacuaaagagcuaagu

SEQ ID NO: 9935 - RNA, 20 nt, Artificial Sequence
  targeting sequence with GTCN PAM
ucaaccuuucuccuaucuac

SEQ ID NO: 9936 - RNA, 20 nt, Artificial Sequence
  targeting sequence with GTCN PAM
agcuucuggugccuagaaug

SEQ ID NO: 9937 - RNA, 20 nt, Artificial Sequence
  targeting sequence with GTCN PAM
ggcagagggcagauggguag

SEQ ID NO: 9938 - RNA, 20 nt, Artificial Sequence
  targeting sequence with GTCN PAM
caagggacuucauacuaaaa

SEQ ID NO: 9939 - RNA, 20 nt, Artificial Sequence
  targeting sequence with GTCN PAM
cuugagacucacaugcuggu

SEQ ID NO: 9940 - RNA, 20 nt, Artificial Sequence
  targeting sequence with GTCN PAM
uacccuuuuuacgauguuac

SEQ ID NO: 9941 - RNA, 20 nt, Artificial Sequence
  targeting sequence with GTCN PAM
cuauacugccuucuuuuaug

SEQ ID NO: 9942 - RNA, 20 nt, Artificial Sequence
  targeting sequence with GTCN PAM
cuucaauaacaggaagaguu

SEQ ID NO: 9943 - RNA, 20 nt, Artificial Sequence
  targeting sequence with GTCN PAM
uacuuuugauggauaacuag

SEQ ID NO: 9944 - RNA, 20 nt, Artificial Sequence
  targeting sequence with GTCN PAM
aaguucucugugacucugcc

SEQ ID NO: 9945 - RNA, 20 nt, Artificial Sequence
  targeting sequence with GTCN PAM
cagagaacuuugacccuagu

SEQ ID NO: 9946 - RNA, 20 nt, Artificial Sequence
  targeting sequence with GTCN PAM
caucccuagaauugauuuuc

SEQ ID NO: 9947 - RNA, 20 nt, Artificial Sequence
  targeting sequence with GTCN PAM
uuucgugacuguccuauguu

SEQ ID NO: 9948 - RNA, 20 nt, Artificial Sequence
  targeting sequence with GTCN PAM
cgaaaagacauuauguuaac

SEQ ID NO: 9949 - RNA, 20 nt, Artificial Sequence
  targeting sequence with GTCN PAM
uauguuagcccacucuucug

SEQ ID NO: 9950 - RNA, 20 nt, Artificial Sequence
  targeting sequence with GTCN PAM
cuggccccucucugguaaag

SEQ ID NO: 9951 - RNA, 20 nt, Artificial Sequence
  targeting sequence with GTCN PAM
cuugggauuuaagggaaagg

SEQ ID NO: 9952 - RNA, 20 nt, Artificial Sequence
  targeting sequence with GTCN PAM
uuaguugaggagaguaauuu

SEQ ID NO: 9953 - RNA, 20 nt, Artificial Sequence
  targeting sequence with GTCN PAM
ccagccuacaucuugauaaa

SEQ ID NO: 9954 - RNA, 20 nt, Artificial Sequence
  targeting sequence with GTCN PAM
gcuuuuaucaagauguaggc

SEQ ID NO: 9955 - RNA, 20 nt, Artificial Sequence
  targeting sequence with GTCN PAM
cacaggcuaccacacaaccu

SEQ ID NO: 9956 - RNA, 20 nt, Artificial Sequence
  targeting sequence with GTCN PAM
aaacuggauucaaauccuug

SEQ ID NO: 9957 - RNA, 20 nt, Artificial Sequence
  targeting sequence with GTCN PAM
gagugcuagcgauccaaauc

SEQ ID NO: 9958 - RNA, 20 nt, Artificial Sequence
  targeting sequence with GTCN PAM
gaugucaaaguggaguugau

SEQ ID NO: 9959 - RNA, 20 nt, Artificial Sequence
  targeting sequence with GTCN PAM
aaguggaguugaugggagaa

SEQ ID NO: 9960 - RNA, 20 nt, Artificial Sequence
  targeting sequence with GTCN PAM
uaagguaacuguuaacuuuu

SEQ ID NO: 9961 - RNA, 20 nt, Artificial Sequence
  targeting sequence with GTCN PAM
aguaucaauauuuuguaucc

SEQ ID NO: 9962 - RNA, 20 nt, Artificial Sequence
  targeting sequence with GTCN PAM
uuugccaccuggcaaguuuc

SEQ ID NO: 9963 - RNA, 20 nt, Artificial Sequence
  targeting sequence with GTCN PAM
gccuauuuuguaguuuugcc

SEQ ID NO: 9964 - RNA, 20 nt, Artificial Sequence
  targeting sequence with GTCN PAM
auguugugggagugaaggca

SEQ ID NO: 9965 - RNA, 20 nt, Artificial Sequence
  targeting sequence with GTCN PAM
ggugagaagaugaggaaagg

SEQ ID NO: 9966 - RNA, 20 nt, Artificial Sequence
  targeting sequence with GTCN PAM
guauauuaugaaaggucagg

SEQ ID NO: 9967 - RNA, 20 nt, Artificial Sequence
  targeting sequence with GTCN PAM
aagagugucuguauauuaug

SEQ ID NO: 9968 - RNA, 20 nt, Artificial Sequence
  targeting sequence with GTCN PAM
cuggcuaacaaugguuugau

SEQ ID NO: 9969 - RNA, 20 nt, Artificial Sequence
  targeting sequence with GTCN PAM
guacaacaacauguauguca

SEQ ID NO: 9970 - RNA, 20 nt, Artificial Sequence
  targeting sequence with GTCN PAM
cucuagcaagaauaauuccc

SEQ ID NO: 9971 - RNA, 20 nt, Artificial Sequence
  targeting sequence with GTCN PAM
ugggaauuauucuugcuaga

SEQ ID NO: 9972 - RNA, 20 nt, Artificial Sequence
  targeting sequence with GTCN PAM
gagcccacaggcugcugcua

SEQ ID NO: 9973 - RNA, 20 nt, Artificial Sequence
  targeting sequence with GTCN PAM
aagccgagucagagcccaca

SEQ ID NO: 9974 - RNA, 20 nt, Artificial Sequence
  targeting sequence with GTCN PAM
gaacaaaaaaggccaggcag

SEQ ID NO: 9975 - RNA, 20 nt, Artificial Sequence
  targeting sequence with GTCN PAM
ucauacugggucugaacaaa

SEQ ID NO: 9976 - RNA, 20 nt, Artificial Sequence
  targeting sequence with GTCN PAM
gcuguuucaccucuuucuug

SEQ ID NO: 9977 - RNA, 20 nt, Artificial Sequence
  targeting sequence with GTCN PAM
auaucauuuugaauucaguc

SEQ ID NO: 9978 - RNA, 20 nt, Artificial Sequence
  targeting sequence with GTCN PAM
uggcugcacuugaaucuguc

SEQ ID NO: 9979 - RNA, 20 nt, Artificial Sequence
  targeting sequence with GTCN PAM
uacaaauaguuuggucuuua

SEQ ID NO: 9980 - RNA, 20 nt, Artificial Sequence
  targeting sequence with GTCN PAM
uuaguucaauuuuagaaaga

SEQ ID NO: 9981 - RNA, 20 nt, Artificial Sequence
  targeting sequence with GTCN PAM
aacaaugaaaaaaacuaucu

SEQ ID NO: 9982 - RNA, 20 nt, Artificial Sequence
  targeting sequence with GTCN PAM
cauuuucuaagauaguuuuu

SEQ ID NO: 9983 - RNA, 20 nt, Artificial Sequence
  targeting sequence with GTCN PAM
gggauguugcagaaauaaau

SEQ ID NO: 9984 - RNA, 20 nt, Artificial Sequence
  targeting sequence with GTCN PAM
aguuaaaucucuuucaauag

SEQ ID NO: 9985 - RNA, 20 nt, Artificial Sequence
  targeting sequence with GTCN PAM
gggaaccuguuuuccuuuuu

SEQ ID NO: 9986 - RNA, 20 nt, Artificial Sequence
  targeting sequence with GTCN PAM
ugcucugucacccagggugg

SEQ ID NO: 9987 - RNA, 20 nt, Artificial Sequence
  targeting sequence with GTCN PAM
cccaggguggagugcagugg

SEQ ID NO: 9988 - RNA, 20 nt, Artificial Sequence
  targeting sequence with GTCN PAM
cagcuacucagaaggcugag

SEQ ID NO: 9989 - RNA, 20 nt, Artificial Sequence
  targeting sequence with GTCN PAM
guagucccagcuacucagaa

SEQ ID NO: 9990 - RNA, 20 nt, Artificial Sequence
  targeting sequence with GTCN PAM
cugaaaaaaaaaaauagcca

SEQ ID NO: 9991 - RNA, 20 nt, Artificial Sequence
  targeting sequence with GTCN PAM
cacuauguugcccaggcugg

SEQ ID NO: 9992 - RNA, 20 nt, Artificial Sequence
  targeting sequence with GTCN PAM
ugaacuccugagcucaagca

SEQ ID NO: 9993 - RNA, 20 nt, Artificial Sequence
  targeting sequence with GTCN PAM
cagcacuuugggaagcugag

SEQ ID NO: 9994 - RNA, 20 nt, Artificial Sequence
  targeting sequence with GTCN PAM
ucagcacuuauucccaacac

SEQ ID NO: 9995 - RNA, 20 nt, Artificial Sequence
  targeting sequence with GTCN PAM
aagguucuggaagucauuuu

SEQ ID NO: 9996 - RNA, 20 nt, Artificial Sequence
  targeting sequence with GTCN PAM
uuuucaaacuagauuuuggu

SEQ ID NO: 9997 - RNA, 20 nt, Artificial Sequence
  targeting sequence with GTCN PAM
agaggugcuccaucuucacu

SEQ ID NO: 9998 - RNA, 20 nt, Artificial Sequence
  targeting sequence with GTCN PAM
agguuuuggauuaaaauccc

SEQ ID NO: 9999 - RNA, 20 nt, Artificial Sequence
  targeting sequence with GTCN PAM
ucuccuuuaaucuuugcaau

SEQ ID NO: 10000 - RNA, 20 nt, Artificial Sequence
  targeting sequence with GTCN PAM
gucuucuccuuuaaucuuug

SEQ ID NO: 10001 - RNA, 20 nt, Artificial Sequence
  targeting sequence with GTCN PAM
cacagagcaccucuugugug

SEQ ID NO: 10002 - RNA, 20 nt, Artificial Sequence
  targeting sequence with GTCN PAM
cccagguuggagugcagugg

SEQ ID NO: 10003 - RNA, 20 nt, Artificial Sequence
  targeting sequence with GTCN PAM
caaucuccuaggcucuagug

SEQ ID NO: 10004 - RNA, 20 nt, Artificial Sequence
  targeting sequence with GTCN PAM
cuagagccuaggagauugag

SEQ ID NO: 10005 - RNA, 20 nt, Artificial Sequence
  targeting sequence with GTCN PAM
cagcugcuugggaggcugag

SEQ ID NO: 10006 - RNA, 20 nt, Artificial Sequence
  targeting sequence with GTCN PAM
cuacagaaaauacaaaaaca

SEQ ID NO: 10007 - RNA, 20 nt, Artificial Sequence
  targeting sequence with GTCN PAM
ugaauuccuggauugaagug

SEQ ID NO: 10008 - RNA, 20 nt, Artificial Sequence
  targeting sequence with GTCN PAM
auggccuuaagucuucauuu

SEQ ID NO: 10009 - RNA, 20 nt, Artificial Sequence
  targeting sequence with GTCN PAM
ucauuucuuuauguccacuu

SEQ ID NO: 10010 - RNA, 20 nt, Artificial Sequence
  targeting sequence with GTCN PAM
acuuucccaauuuuauauau

SEQ ID NO: 10011 - RNA, 20 nt, Artificial Sequence
  targeting sequence with GTCN PAM
aaauauauaaaauugggaaa

SEQ ID NO: 10012 - RNA, 20 nt, Artificial Sequence
  targeting sequence with GTCN PAM
uaggaaaaacaucauaaaua

SEQ ID NO: 10013 - RNA, 20 nt, Artificial Sequence
  targeting sequence with GTCN PAM
caaguaauuuuuauuuuuuu

SEQ ID NO: 10014 - RNA, 20 nt, Artificial Sequence
  targeting sequence with GTCN PAM
cuaaaauaaaaaaauaaaaa

SEQ ID NO: 10015 - RNA, 20 nt, Artificial Sequence
  targeting sequence with GTCN PAM
cacuauguuguccaugcugg

SEQ ID NO: 10016 - RNA, 20 nt, Artificial Sequence
  targeting sequence with GTCN PAM
augcuggaguacagugguua

SEQ ID NO: 10017 - RNA, 20 nt, Artificial Sequence
  targeting sequence with GTCN PAM
cagcuacucaggaggcugag

SEQ ID NO: 10018 - RNA, 20 nt, Artificial Sequence
  targeting sequence with GTCN PAM
guagucccagcuacucagga

SEQ ID NO: 10019 - RNA, 20 nt, Artificial Sequence
  targeting sequence with GTCN PAM
uuuagagguugaacaauuua

SEQ ID NO: 10020 - RNA, 20 nt, Artificial Sequence
  targeting sequence with GTCN PAM
ucccaaauaagaaaauguaa

SEQ ID NO: 10021 - RNA, 20 nt, Artificial Sequence
  targeting sequence with GTCN PAM
guuucaucugcugagaucau

SEQ ID NO: 10022 - RNA, 20 nt, Artificial Sequence
  targeting sequence with GTCN PAM
ccauguuugucuguuucauc

SEQ ID NO: 10023 - RNA, 20 nt, Artificial Sequence
  targeting sequence with GTCN PAM
uuacaaaaaauacaaaaauu

SEQ ID NO: 10024 - RNA, 20 nt, Artificial Sequence
  targeting sequence with GTCN PAM
cagcuacucaggaggcugag

SEQ ID NO: 10025 - RNA, 20 nt, Artificial Sequence
  targeting sequence with GTCN PAM
aggcugcagugagccgagac

SEQ ID NO: 10026 - RNA, 20 nt, Artificial Sequence
  targeting sequence with GTCN PAM
cggcucacugcagccuugac

SEQ ID NO: 10027 - RNA, 20 nt, Artificial Sequence
  targeting sequence with GTCN PAM
cuacccuccagucuggguga

SEQ ID NO: 10028 - RNA, 20 nt, Artificial Sequence
  targeting sequence with GTCN PAM
gggugacagagcaagaaccu

SEQ ID NO: 10029 - RNA, 20 nt, Artificial Sequence
  targeting sequence with GTCN PAM
cccagacuggaggguaguga

SEQ ID NO: 10030 - RNA, 20 nt, Artificial Sequence
  targeting sequence with GTCN PAM
caaacaaacagaaaaaccca

SEQ ID NO: 10031 - RNA, 20 nt, Artificial Sequence
  targeting sequence with GTCN PAM
cagaaggaugcagugacucc

SEQ ID NO: 10032 - RNA, 20 nt, Artificial Sequence
  targeting sequence with GTCN PAM
cugcauccuucugggacucc

SEQ ID NO: 10033 - RNA, 20 nt, Artificial Sequence
  targeting sequence with GTCN PAM
uuuuaaaaacuuuuugacug

SEQ ID NO: 10034 - RNA, 20 nt, Artificial Sequence
  targeting sequence with GTCN PAM
aaaaguuuuuaaaaagacaa

SEQ ID NO: 10035 - RNA, 20 nt, Artificial Sequence
  targeting sequence with GTCN PAM
agcaauuugcccagucaaaa

SEQ ID NO: 10036 - RNA, 20 nt, Artificial Sequence
  targeting sequence with GTCN PAM
gaaacuccuggggucaagca

SEQ ID NO: 10037 - RNA, 20 nt, Artificial Sequence
  targeting sequence with GTCN PAM
cuacuaaaaauacaaaaaaa

SEQ ID NO: 10038 - RNA, 20 nt, Artificial Sequence
  targeting sequence with GTCN PAM
ucucaccucagccucccaag

SEQ ID NO: 10039 - RNA, 20 nt, Artificial Sequence
  targeting sequence with GTCN PAM
cagcucacugcaccucugcc

SEQ ID NO: 10040 - RNA, 20 nt, Artificial Sequence
  targeting sequence with GTCN PAM
cccaggcuggagugcagugg

SEQ ID NO: 10041 - RNA, 20 nt, Artificial Sequence
  targeting sequence with GTCN PAM
uacucugucacccaggcugg

SEQ ID NO: 10042 - RNA, 20 nt, Artificial Sequence
  targeting sequence with GTCN PAM
caaagagaagacaaaaaaau

SEQ ID NO: 10043 - RNA, 20 nt, Artificial Sequence
  targeting sequence with GTCN PAM
ucucuuugagacaaggucuu

SEQ ID NO: 10044 - RNA, 20 nt, Artificial Sequence
  targeting sequence with GTCN PAM
gugggaacuagaauacaggu

SEQ ID NO: 10045 - RNA, 20 nt, Artificial Sequence
  targeting sequence with GTCN PAM
aaauucuaaaauggagaaac

SEQ ID NO: 10046 - RNA, 20 nt, Artificial Sequence
  targeting sequence with GTCN PAM
auaaaacauguaucuucccu

SEQ ID NO: 10047 - RNA, 20 nt, Artificial Sequence
  targeting sequence with GTCN PAM
uggguuuuuuuuaaaccuag

SEQ ID NO: 10048 - RNA, 20 nt, Artificial Sequence
  targeting sequence with GTCN PAM
ggagaguucuauuuagcauc

SEQ ID NO: 10049 - RNA, 20 nt, Artificial Sequence
  targeting sequence with GTCN PAM
ugccucacuuaaugaugggg

SEQ ID NO: 10050 - RNA, 20 nt, Artificial Sequence
  targeting sequence with GTCN PAM
ccaucauuaagugaggcaug

SEQ ID NO: 10051 - RNA, 20 nt, Artificial Sequence
  targeting sequence with GTCN PAM
auuguuccuaggcuacaaag

SEQ ID NO: 10052 - RNA, 20 nt, Artificial Sequence
  targeting sequence with GTCN PAM
gcaguugccuaugguacagu

SEQ ID NO: 10053 - RNA, 20 nt, Artificial Sequence
  targeting sequence with GTCN PAM
agauacacaaacacuauugu

SEQ ID NO: 10054 - RNA, 20 nt, Artificial Sequence
  targeting sequence with GTCN PAM
ugccucagcuuccaagcagc

SEQ ID NO: 10055 - RNA, 20 nt, Artificial Sequence
  targeting sequence with GTCN PAM
cggcucacugaaaccucugc

SEQ ID NO: 10056 - RNA, 20 nt, Artificial Sequence
  targeting sequence with GTCN PAM
cacucuugcccaggcuggag

SEQ ID NO: 10057 - RNA, 20 nt, Artificial Sequence
  targeting sequence with GTCN PAM
uauauguuguugaucaaaau

SEQ ID NO: 10058 - RNA, 20 nt, Artificial Sequence
  targeting sequence with GTCN PAM
uuauucagcacaugacuaug

SEQ ID NO: 10059 - RNA, 20 nt, Artificial Sequence
  targeting sequence with GTCN PAM
ugugcugaauaaugacauuu

SEQ ID NO: 10060 - RNA, 20 nt, Artificial Sequence
  targeting sequence with GTCN PAM
uuccuaaauuguuacaaccc

SEQ ID NO: 10061 - RNA, 20 nt, Artificial Sequence
  targeting sequence with GTCN PAM
agguucucuuuggguuguaa

SEQ ID NO: 10062 - RNA, 20 nt, Artificial Sequence
  targeting sequence with GTCN PAM
uagguaaauaauucauaaau

SEQ ID NO: 10063 - RNA, 20 nt, Artificial Sequence
  targeting sequence with GTCN PAM
cuaggucaacacaguaguca

SEQ ID NO: 10064 - RNA, 20 nt, Artificial Sequence
  targeting sequence with GTCN PAM
acacaguagucaacuuccua

SEQ ID NO: 10065 - RNA, 20 nt, Artificial Sequence
  targeting sequence with GTCN PAM
acuuccuagaucagagauga

SEQ ID NO: 10066 - RNA, 20 nt, Artificial Sequence
  targeting sequence with GTCN PAM
aauuacugaugaaugggagc

SEQ ID NO: 10067 - RNA, 20 nt, Artificial Sequence
  targeting sequence with GTCN PAM
aagcauucccaggcugugua

SEQ ID NO: 10068 - RNA, 20 nt, Artificial Sequence
  targeting sequence with GTCN PAM
cuagcacaggauagcugaag

SEQ ID NO: 10069 - RNA, 20 nt, Artificial Sequence
  targeting sequence with GTCN PAM
caggaaaaacacccacaggc

SEQ ID NO: 10070 - RNA, 20 nt, Artificial Sequence
  targeting sequence with GTCN PAM
auucuucucccauaguugcc

SEQ ID NO: 10071 - RNA, 20 nt, Artificial Sequence
  targeting sequence with GTCN PAM
cugguaugcauuugggaaau

SEQ ID NO: 10072 - RNA, 20 nt, Artificial Sequence
  targeting sequence with GTCN PAM
aacacuggcagaagcuauuu

SEQ ID NO: 10073 - RNA, 20 nt, Artificial Sequence
  targeting sequence with GTCN PAM
cucuacucuggucaaacacu

SEQ ID NO: 10074 - RNA, 20 nt, Artificial Sequence
  targeting sequence with GTCN PAM
uacucccuaccccaacugug

SEQ ID NO: 10075 - RNA, 20 nt, Artificial Sequence
  targeting sequence with GTCN PAM
cccacaauauuucaagggua

SEQ ID NO: 10076 - RNA, 20 nt, Artificial Sequence
  targeting sequence with GTCN PAM
uuaagauaauucauugccua

SEQ ID NO: 10077 - RNA, 20 nt, Artificial Sequence
  targeting sequence with GTCN PAM
gcaaguugcccagaaagccc

SEQ ID NO: 10078 - RNA, 20 nt, Artificial Sequence
  targeting sequence with GTCN PAM
uuaccaagucugcaaguugc

SEQ ID NO: 10079 - RNA, 20 nt, Artificial Sequence
  targeting sequence with GTCN PAM
acuccaaggaauaaggguua

SEQ ID NO: 10080 - RNA, 20 nt, Artificial Sequence
  targeting sequence with GTCN PAM
uauuuccuaauugggauuuu

SEQ ID NO: 10081 - RNA, 20 nt, Artificial Sequence
  targeting sequence with GTCN PAM
aaaucuagccuacauaucgu

SEQ ID NO: 10082 - RNA, 20 nt, Artificial Sequence
  targeting sequence with GTCN PAM
ggagauucucagaucacuuu

SEQ ID NO: 10083 - RNA, 20 nt, Artificial Sequence
  targeting sequence with GTCN PAM
acugaaaagugaucugagaa

SEQ ID NO: 10084 - RNA, 20 nt, Artificial Sequence
  targeting sequence with GTCN PAM
cacacauagaauaaaggggc

SEQ ID NO: 10085 - RNA, 20 nt, Artificial Sequence
  targeting sequence with GTCN PAM
aaugauggucaaaucaacua

SEQ ID NO: 10086 - RNA, 20 nt, Artificial Sequence
  targeting sequence with GTCN PAM
aaucaacuaaaauuauauuu

SEQ ID NO: 10087 - RNA, 20 nt, Artificial Sequence
  targeting sequence with GTCN PAM
gccuaguuacuaacuguucu

SEQ ID NO: 10088 - RNA, 20 nt, Artificial Sequence
  targeting sequence with GTCN PAM
caugcaguagaacaguuagu

SEQ ID NO: 10089 - RNA, 20 nt, Artificial Sequence
  targeting sequence with GTCN PAM
cccugagcaguugucacaug

SEQ ID NO: 10090 - RNA, 20 nt, Artificial Sequence
  targeting sequence with GTCN PAM
ccuguauuuuugcucuuaug

SEQ ID NO: 10091 - RNA, 20 nt, Artificial Sequence
  targeting sequence with GTCN PAM
uaagagcaaaaauacaggag

SEQ ID NO: 10092 - RNA, 20 nt, Artificial Sequence
  targeting sequence with GTCN PAM
auuggaaaucggcuucugag

SEQ ID NO: 10093 - RNA, 20 nt, Artificial Sequence
  targeting sequence with GTCN PAM
uguagggcaggcuaaaaacc

SEQ ID NO: 10094 - RNA, 20 nt, Artificial Sequence
  targeting sequence with GTCN PAM
cacaguaaaaugguuuuaca

SEQ ID NO: 10095 - RNA, 20 nt, Artificial Sequence
  targeting sequence with GTCN PAM
cuuuaucuuucugagcuuca

SEQ ID NO: 10096 - RNA, 20 nt, Artificial Sequence
  targeting sequence with GTCN PAM
cuucuacuucugaaguacug

SEQ ID NO: 10097 - RNA, 20 nt, Artificial Sequence
  targeting sequence with GTCN PAM
aguuaguuucuucaucccau

SEQ ID NO: 10098 - RNA, 20 nt, Artificial Sequence
  targeting sequence with GTCN PAM
caucacuuaaaaaaauuucu

SEQ ID NO: 10099 - RNA, 20 nt, Artificial Sequence
  targeting sequence with GTCN PAM
ccugccuuccccaaauacau

SEQ ID NO: 10100 - RNA, 20 nt, Artificial Sequence
  targeting sequence with GTCN PAM
cuagucaaaggcugaggugg

SEQ ID NO: 10101 - RNA, 20 nt, Artificial Sequence
  targeting sequence with GTCN PAM
aaggcugagguggaguucag

SEQ ID NO: 10102 - RNA, 20 nt, Artificial Sequence
  targeting sequence with GTCN PAM
gucaugguacaauuaugugg

SEQ ID NO: 10103 - RNA, 20 nt, Artificial Sequence
  targeting sequence with GTCN PAM
ugguacaauuauguggguga

SEQ ID NO: 10104 - RNA, 20 nt, Artificial Sequence
  targeting sequence with GTCN PAM
cucucucuucacccacauaa

SEQ ID NO: 10105 - RNA, 20 nt, Artificial Sequence
  targeting sequence with GTCN PAM
ugggcaacuaucuucacuug

SEQ ID NO: 10106 - RNA, 20 nt, Artificial Sequence
  targeting sequence with GTCN PAM
acccaagugaguagcuccaa

SEQ ID NO: 10107 - RNA, 20 nt, Artificial Sequence
  targeting sequence with GTCN PAM
uucgcuuaauguguuuccau

SEQ ID NO: 10108 - RNA, 20 nt, Artificial Sequence
  targeting sequence with GTCN PAM
uuauuuccccuucucagaau

SEQ ID NO: 10109 - RNA, 20 nt, Artificial Sequence
  targeting sequence with GTCN PAM
cuguuuuuaacauauuuuau

SEQ ID NO: 10110 - RNA, 20 nt, Artificial Sequence
  targeting sequence with GTCN PAM
gacaaaacuggguuuugaau

SEQ ID NO: 10111 - RNA, 20 nt, Artificial Sequence
  targeting sequence with GTCN PAM
gacuucaaauucaguguuau

SEQ ID NO: 10112 - RNA, 20 nt, Artificial Sequence
  targeting sequence with GTCN PAM
cucaguaagugguaaagcca

SEQ ID NO: 10113 - RNA, 20 nt, Artificial Sequence
  targeting sequence with GTCN PAM
ccaucaucaucaaauaacaa

SEQ ID NO: 10114 - RNA, 20 nt, Artificial Sequence
  targeting sequence with GTCN PAM
cagaaggaucugugaagucc

SEQ ID NO: 10115 - RNA, 20 nt, Artificial Sequence
  targeting sequence with GTCN PAM
auccacagccuacuuucuuc

SEQ ID NO: 10116 - RNA, 20 nt, Artificial Sequence
  targeting sequence with GTCN PAM
gcuuuuuuuauaguuuuuuc

SEQ ID NO: 10117 - RNA, 20 nt, Artificial Sequence
  targeting sequence with GTCN PAM
auuuaugugccucuacagua

SEQ ID NO: 10118 - RNA, 20 nt, Artificial Sequence
  targeting sequence with GTCN PAM
guaaucccagcauuguggga

SEQ ID NO: 10119 - RNA, 20 nt, Artificial Sequence
  targeting sequence with GTCN PAM
ggaguucgagaccagccugg

SEQ ID NO: 10120 - RNA, 20 nt, Artificial Sequence
  targeting sequence with GTCN PAM
cgaacuccugaccucaggug

SEQ ID NO: 10121 - RNA, 20 nt, Artificial Sequence
  targeting sequence with GTCN PAM
gccaccacgcccagcuacuu

SEQ ID NO: 10122 - RNA, 20 nt, Artificial Sequence
  targeting sequence with GTCN PAM
agaucgcaccacugcacucc

SEQ ID NO: 10123 - RNA, 20 nt, Artificial Sequence
  targeting sequence with GTCN PAM
ccaaaaacaaagaacaaaaa

SEQ ID NO: 10124 - RNA, 20 nt, Artificial Sequence
  targeting sequence with GTCN PAM
cagcuacucaggaggcugag

SEQ ID NO: 10125 - RNA, 20 nt, Artificial Sequence
  targeting sequence with GTCN PAM
ugaacuccugggcucaagca

SEQ ID NO: 10126 - RNA, 20 nt, Artificial Sequence
  targeting sequence with GTCN PAM
ugcuauguugccuugcuggu

SEQ ID NO: 10127 - RNA, 20 nt, Artificial Sequence
  targeting sequence with GTCN PAM
gggucuugcuauguugccuu

SEQ ID NO: 10128 - RNA, 20 nt, Artificial Sequence
  targeting sequence with GTCN PAM
caaaaaaaaaauuaaaaaau

SEQ ID NO: 10129 - RNA, 20 nt, Artificial Sequence
  targeting sequence with GTCN PAM
cacucugucacccaggcugg

SEQ ID NO: 10130 - RNA, 20 nt, Artificial Sequence
  targeting sequence with GTCN PAM
cccaggcuggagugcagugg

SEQ ID NO: 10131 - RNA, 20 nt, Artificial Sequence
  targeting sequence with GTCN PAM
caguuacgggggaggcugag

SEQ ID NO: 10132 - RNA, 20 nt, Artificial Sequence
  targeting sequence with GTCN PAM
caaucuucugaccuugugau

SEQ ID NO: 10133 - RNA, 20 nt, Artificial Sequence
  targeting sequence with GTCN PAM
gaagauugagaccauccugg

SEQ ID NO: 10134 - RNA, 20 nt, Artificial Sequence
  targeting sequence with GTCN PAM
ugcuggccaggcgcaguggc

SEQ ID NO: 10135 - RNA, 20 nt, Artificial Sequence
  targeting sequence with GTCN PAM
gggucuugcuggccaggcgc

SEQ ID NO: 10136 - RNA, 20 nt, Artificial Sequence
  targeting sequence with GTCN PAM
guauucuccacauauccuua

SEQ ID NO: 10137 - RNA, 20 nt, Artificial Sequence
  targeting sequence with GTCN PAM
aaggauauguggagaauaca

SEQ ID NO: 10138 - RNA, 20 nt, Artificial Sequence
  targeting sequence with GTCN PAM
uaaguauaucugcccaguag

SEQ ID NO: 10139 - RNA, 20 nt, Artificial Sequence
  targeting sequence with GTCN PAM
ucuacugggcagauauacuu

SEQ ID NO: 10140 - RNA, 20 nt, Artificial Sequence
  targeting sequence with GTCN PAM
uagcuccuguguaagaguga

SEQ ID NO: 10141 - RNA, 20 nt, Artificial Sequence
  targeting sequence with GTCN PAM
ucuucauguuuguaguccua

SEQ ID NO: 10142 - RNA, 20 nt, Artificial Sequence
  targeting sequence with GTCN PAM
uuucugaagacaaauguuuu

SEQ ID NO: 10143 - RNA, 20 nt, Artificial Sequence
  targeting sequence with GTCN PAM
ucagaaaagacaaagaacuu

SEQ ID NO: 10144 - RNA, 20 nt, Artificial Sequence
  targeting sequence with GTCN PAM
ccauccuaccuuaaaaugca

SEQ ID NO: 10145 - RNA, 20 nt, Artificial Sequence
  targeting sequence with GTCN PAM
gguguucacgaccagccugg

SEQ ID NO: 10146 - RNA, 20 nt, Artificial Sequence
  targeting sequence with GTCN PAM
ugaacaccugaccucaugau

SEQ ID NO: 10147 - RNA, 20 nt, Artificial Sequence
  targeting sequence with GTCN PAM
acauggcaaaacccugucuc

SEQ ID NO: 10148 - RNA, 20 nt, Artificial Sequence
  targeting sequence with GTCN PAM
cuacuaaaaauacaaaaaac

SEQ ID NO: 10149 - RNA, 20 nt, Artificial Sequence
  targeting sequence with GTCN PAM
cagcuacuugggaggcugag

SEQ ID NO: 10150 - RNA, 20 nt, Artificial Sequence
  targeting sequence with GTCN PAM
cuguugcccaggcuagagug

SEQ ID NO: 10151 - RNA, 20 nt, Artificial Sequence
  targeting sequence with GTCN PAM
aaguaagccuaccuuuauau

SEQ ID NO: 10152 - RNA, 20 nt, Artificial Sequence
  targeting sequence with GTCN PAM
auauaaagguaggcuuacuu

SEQ ID NO: 10153 - RNA, 20 nt, Artificial Sequence
  targeting sequence with GTCN PAM
aguaaaaaauauauauauac

SEQ ID NO: 10154 - RNA, 20 nt, Artificial Sequence
  targeting sequence with GTCN PAM
gagacugugucuuauaucuu

SEQ ID NO: 10155 - RNA, 20 nt, Artificial Sequence
  targeting sequence with GTCN PAM
cagacuuaagcacucacaau

SEQ ID NO: 10156 - RNA, 20 nt, Artificial Sequence
  targeting sequence with GTCN PAM
uauaucuuauacauucuuga

SEQ ID NO: 10157 - RNA, 20 nt, Artificial Sequence
  targeting sequence with GTCN PAM
acuaaaaaguuucuguugag

SEQ ID NO: 10158 - RNA, 20 nt, Artificial Sequence
  targeting sequence with GTCN PAM
ccucaacagaaacuuuuuag

SEQ ID NO: 10159 - RNA, 20 nt, Artificial Sequence
  targeting sequence with GTCN PAM
ucuucuuauugaccuaucug

SEQ ID NO: 10160 - RNA, 20 nt, Artificial Sequence
  targeting sequence with GTCN PAM
auaagaagaggacuaagaac

SEQ ID NO: 10161 - RNA, 20 nt, Artificial Sequence
  targeting sequence with GTCN PAM
aaugcugcagauaggucaau

SEQ ID NO: 10162 - RNA, 20 nt, Artificial Sequence
  targeting sequence with GTCN PAM
aucuucuuccuuuucuucuu

SEQ ID NO: 10163 - RNA, 20 nt, Artificial Sequence
  targeting sequence with GTCN PAM
uaggauacuaaggagaaagu

SEQ ID NO: 10164 - RNA, 20 nt, Artificial Sequence
  targeting sequence with GTCN PAM
cuagacucaaaaaugucacu

SEQ ID NO: 10165 - RNA, 20 nt, Artificial Sequence
  targeting sequence with GTCN PAM
agagacucuuagagucauag

SEQ ID NO: 10166 - RNA, 20 nt, Artificial Sequence
  targeting sequence with GTCN PAM
cuuaccuauucaacauuccc

SEQ ID NO: 10167 - RNA, 20 nt, Artificial Sequence
  targeting sequence with GTCN PAM
aucagccaucuaagugggaa

SEQ ID NO: 10168 - RNA, 20 nt, Artificial Sequence
  targeting sequence with GTCN PAM
uuaacugagauguaaaugcu

SEQ ID NO: 10169 - RNA, 20 nt, Artificial Sequence
  targeting sequence with GTCN PAM
gaaccaugaucauauauugu

SEQ ID NO: 10170 - RNA, 20 nt, Artificial Sequence
  targeting sequence with GTCN PAM
gaguuacuaaaaugauuucc

SEQ ID NO: 10171 - RNA, 20 nt, Artificial Sequence
  targeting sequence with GTCN PAM
aucuugcccacauaucuguu

SEQ ID NO: 10172 - RNA, 20 nt, Artificial Sequence
  targeting sequence with GTCN PAM
aaucacaucaguccucugcu

SEQ ID NO: 10173 - RNA, 20 nt, Artificial Sequence
  targeting sequence with GTCN PAM
ucugcuuaaaauucuucaau

SEQ ID NO: 10174 - RNA, 20 nt, Artificial Sequence
  targeting sequence with GTCN PAM
acuauguauuucauaguauc

SEQ ID NO: 10175 - RNA, 20 nt, Artificial Sequence
  targeting sequence with GTCN PAM
gaacuacauggauccacuua

SEQ ID NO: 10176 - RNA, 20 nt, Artificial Sequence
  targeting sequence with GTCN PAM
gcauauguuuuaugcauuca

SEQ ID NO: 10177 - RNA, 20 nt, Artificial Sequence
  targeting sequence with GTCN PAM
agagaaauguaaacaaagau

SEQ ID NO: 10178 - RNA, 20 nt, Artificial Sequence
  targeting sequence with GTCN PAM
caugcacuuuaaguggauac

SEQ ID NO: 10179 - RNA, 20 nt, Artificial Sequence
  targeting sequence with GTCN PAM
cucaggugauuagugucaca

SEQ ID NO: 10180 - RNA, 20 nt, Artificial Sequence
  targeting sequence with GTCN PAM
caagagaucgcuuuuuacug

SEQ ID NO: 10181 - RNA, 20 nt, Artificial Sequence
  targeting sequence with GTCN PAM
cacuucuuacgcaucucaug

SEQ ID NO: 10182 - RNA, 20 nt, Artificial Sequence
  targeting sequence with GTCN PAM
cuagucucacuucuuacgca

SEQ ID NO: 10183 - RNA, 20 nt, Artificial Sequence
  targeting sequence with GTCN PAM
ugacauuacaagaaaaaguu

SEQ ID NO: 10184 - RNA, 20 nt, Artificial Sequence
  targeting sequence with GTCN PAM
ugacauuuucucugcuucuu

SEQ ID NO: 10185 - RNA, 20 nt, Artificial Sequence
  targeting sequence with GTCN PAM
gcugcugcgguugccugcca

SEQ ID NO: 10186 - RNA, 20 nt, Artificial Sequence
  targeting sequence with GTCN PAM
uguaaacauauguaaauaca

SEQ ID NO: 10187 - RNA, 20 nt, Artificial Sequence
  targeting sequence with GTCN PAM
gcaauagacuguuaguuaag

SEQ ID NO: 10188 - RNA, 20 nt, Artificial Sequence
  targeting sequence with GTCN PAM
auugcugaccagagccuuau

SEQ ID NO: 10189 - RNA, 20 nt, Artificial Sequence
  targeting sequence with GTCN PAM
gaaguuauacacggaucuuu

SEQ ID NO: 10190 - RNA, 20 nt, Artificial Sequence
  targeting sequence with GTCN PAM
agcaccccuaauccccacuu

SEQ ID NO: 10191 - RNA, 20 nt, Artificial Sequence
  targeting sequence with GTCN PAM
ucuucuccuuuuccuggcau

SEQ ID NO: 10192 - RNA, 20 nt, Artificial Sequence
  targeting sequence with GTCN PAM
ucuccuuuuccuggcauaca

SEQ ID NO: 10193 - RNA, 20 nt, Artificial Sequence
  targeting sequence with GTCN PAM
uuuuguaugcuaauaagacg

SEQ ID NO: 10194 - RNA, 20 nt, Artificial Sequence
  targeting sequence with GTCN PAM
uauuagcauacaaaaagaca

SEQ ID NO: 10195 - RNA, 20 nt, Artificial Sequence
  targeting sequence with GTCN PAM
ucagaaagaccaaggcauaa

SEQ ID NO: 10196 - RNA, 20 nt, Artificial Sequence
  targeting sequence with GTCN PAM
uucugaugaccagccucacc

SEQ ID NO: 10197 - RNA, 20 nt, Artificial Sequence
  targeting sequence with GTCN PAM
uuuuggguuuuuauggaaac

SEQ ID NO: 10198 - RNA, 20 nt, Artificial Sequence
  targeting sequence with GTCN PAM
gaagcacaagcaaaauaacc

SEQ ID NO: 10199 - RNA, 20 nt, Artificial Sequence
  targeting sequence with GTCN PAM
ugugggacccaguccucaac

SEQ ID NO: 10200 - RNA, 20 nt, Artificial Sequence
  targeting sequence with GTCN PAM
cacaagacugcaucccauuu

SEQ ID NO: 10201 - RNA, 20 nt, Artificial Sequence
  targeting sequence with GTCN PAM
ucaacuaguguaaucuaaua

SEQ ID NO: 10202 - RNA, 20 nt, Artificial Sequence
  targeting sequence with GTCN PAM
accuggagauaguauuagau

SEQ ID NO: 10203 - RNA, 20 nt, Artificial Sequence
  targeting sequence with GTCN PAM
gaauugaauugaauuaaagg

SEQ ID NO: 10204 - RNA, 20 nt, Artificial Sequence
  targeting sequence with GTCN PAM
gcugcagaauugcuugcugg

SEQ ID NO: 10205 - RNA, 20 nt, Artificial Sequence
  targeting sequence with GTCN PAM
guggagauuucuucccacca

SEQ ID NO: 10206 - RNA, 20 nt, Artificial Sequence
  targeting sequence with GTCN PAM
agagguggcuucuggccagg

SEQ ID NO: 10207 - RNA, 20 nt, Artificial Sequence
  targeting sequence with GTCN PAM
caugccuguaaucucaacau

SEQ ID NO: 10208 - RNA, 20 nt, Artificial Sequence
  targeting sequence with GTCN PAM
caaacuccugggcucaagug

SEQ ID NO: 10209 - RNA, 20 nt, Artificial Sequence
  targeting sequence with GTCN PAM
caccauguugcugaggcuug

SEQ ID NO: 10210 - RNA, 20 nt, Artificial Sequence
  targeting sequence with GTCN PAM
ccacccacuauuccuuuagg

SEQ ID NO: 10211 - RNA, 20 nt, Artificial Sequence
  targeting sequence with GTCN PAM
guuuacuuaucuauuuuauu

SEQ ID NO: 10212 - RNA, 20 nt, Artificial Sequence
  targeting sequence with GTCN PAM
gggguuuugaauccaagaua

SEQ ID NO: 10213 - RNA, 20 nt, Artificial Sequence
  targeting sequence with GTCN PAM
guacccucuuuuucuguugu

SEQ ID NO: 10214 - RNA, 20 nt, Artificial Sequence
  targeting sequence with GTCN PAM
acuaaaaaaaaugguaaaau

SEQ ID NO: 10215 - RNA, 20 nt, Artificial Sequence
  targeting sequence with GTCN PAM
ugaguacaaacuuagccuau

SEQ ID NO: 10216 - RNA, 20 nt, Artificial Sequence
  targeting sequence with GTCN PAM
uugggaaaaauacuuugaaa

SEQ ID NO: 10217 - RNA, 20 nt, Artificial Sequence
  targeting sequence with GTCN PAM
aaggcaaaugaaacucuugu

SEQ ID NO: 10218 - RNA, 20 nt, Artificial Sequence
  targeting sequence with GTCN PAM
uccucacuuucucaagcgaa

SEQ ID NO: 10219 - RNA, 20 nt, Artificial Sequence
  targeting sequence with GTCN PAM
cuuguguguaaugggcugcu

SEQ ID NO: 10220 - RNA, 20 nt, Artificial Sequence
  targeting sequence with GTCN PAM
cgucucuuguguguaauggg

SEQ ID NO: 10221 - RNA, 20 nt, Artificial Sequence
  targeting sequence with GTCN PAM
auacagcuacagagcacccu

SEQ ID NO: 10222 - RNA, 20 nt, Artificial Sequence
  targeting sequence with GTCN PAM
aaauagcuuuggguaaaaug

SEQ ID NO: 10223 - RNA, 20 nt, Artificial Sequence
  targeting sequence with GTCN PAM
guccuaaaauagcaaaugcc

SEQ ID NO: 10224 - RNA, 20 nt, Artificial Sequence
  targeting sequence with GTCN PAM
uaaaauagcaaaugccccug

SEQ ID NO: 10225 - RNA, 20 nt, Artificial Sequence
  targeting sequence with GTCN PAM
gucuauucaaccagccccca

SEQ ID NO: 10226 - RNA, 20 nt, Artificial Sequence
  targeting sequence with GTCN PAM
auucaaccagcccccacuua

SEQ ID NO: 10227 - RNA, 20 nt, Artificial Sequence
  targeting sequence with GTCN PAM
ugcagcuuuaagugggggcu

SEQ ID NO: 10228 - RNA, 20 nt, Artificial Sequence
  targeting sequence with GTCN PAM
uuuaaaaaaaaaaaaaaaaa

SEQ ID NO: 10229 - RNA, 20 nt, Artificial Sequence
  targeting sequence with GTCN PAM
gcagagacuuacuccagccc

SEQ ID NO: 10230 - RNA, 20 nt, Artificial Sequence
  targeting sequence with GTCN PAM
cugcugaccucaugccacag

SEQ ID NO: 10231 - RNA, 20 nt, Artificial Sequence
  targeting sequence with GTCN PAM
ggguagaauucagccucaca

SEQ ID NO: 10232 - RNA, 20 nt, Artificial Sequence
  targeting sequence with GTCN PAM
caugagauaaucuucagccc

SEQ ID NO: 10233 - RNA, 20 nt, Artificial Sequence
  targeting sequence with GTCN PAM
aggagaaaaguucuuuucua

SEQ ID NO: 10234 - RNA, 20 nt, Artificial Sequence
  targeting sequence with GTCN PAM
ggaggaaauaaucaggaaga

SEQ ID NO: 10235 - RNA, 20 nt, Artificial Sequence
  targeting sequence with GTCN PAM
uagugcccaggaacagauca

SEQ ID NO: 10236 - RNA, 20 nt, Artificial Sequence
  targeting sequence with GTCN PAM
cagaggugguuugggguucu

SEQ ID NO: 10237 - RNA, 20 nt, Artificial Sequence
  targeting sequence with GTCN PAM
gcauugcccuguuuucucuu

SEQ ID NO: 10238 - RNA, 20 nt, Artificial Sequence
  targeting sequence with GTCN PAM
cuuauacuaugaaaguucua

SEQ ID NO: 10239 - RNA, 20 nt, Artificial Sequence
  targeting sequence with GTCN PAM
agaauagaacuuucauagua

SEQ ID NO: 10240 - RNA, 20 nt, Artificial Sequence
  targeting sequence with GTCN PAM
cuuuuggucuagaauagaac

SEQ ID NO: 10241 - RNA, 20 nt, Artificial Sequence
  targeting sequence with GTCN PAM
uguguuuccuggcuaaauuu

SEQ ID NO: 10242 - RNA, 20 nt, Artificial Sequence
  targeting sequence with GTCN PAM
uucaaaauuaccugcuuuga

SEQ ID NO: 10243 - RNA, 20 nt, Artificial Sequence
  targeting sequence with GTCN PAM
uuuuauaagaaccucugaaa

SEQ ID NO: 10244 - RNA, 20 nt, Artificial Sequence
  targeting sequence with GTCN PAM
uaccaaucuguuuuuuuaug

SEQ ID NO: 10245 - RNA, 20 nt, Artificial Sequence
  targeting sequence with GTCN PAM
ccauuguaugaaaacaaugg

SEQ ID NO: 10246 - RNA, 20 nt, Artificial Sequence
  targeting sequence with GTCN PAM
ggagaguccuagguaugaaa

SEQ ID NO: 10247 - RNA, 20 nt, Artificial Sequence
  targeting sequence with GTCN PAM
uagguaugaaaaacaguaag

SEQ ID NO: 10248 - RNA, 20 nt, Artificial Sequence
  targeting sequence with GTCN PAM
accaggagaggagggaacug

SEQ ID NO: 10249 - RNA, 20 nt, Artificial Sequence
  targeting sequence with GTCN PAM
ucauccacaacugaugcacc

SEQ ID NO: 10250 - RNA, 20 nt, Artificial Sequence
  targeting sequence with GTCN PAM
gccugacugcauaacagcug

SEQ ID NO: 10251 - RNA, 20 nt, Artificial Sequence
  targeting sequence with GTCN PAM
ggccgacccaggucuucauc

SEQ ID NO: 10252 - RNA, 20 nt, Artificial Sequence
  targeting sequence with GTCN PAM
ucuccugaccagacuuccug

SEQ ID NO: 10253 - RNA, 20 nt, Artificial Sequence
  targeting sequence with GTCN PAM
ggagaugacagcuguuaugc

SEQ ID NO: 10254 - RNA, 20 nt, Artificial Sequence
  targeting sequence with GTCN PAM
ggucaggagaugacagcugu

SEQ ID NO: 10255 - RNA, 20 nt, Artificial Sequence
  targeting sequence with GTCN PAM
ccaaaucaacaggaagucug

SEQ ID NO: 10256 - RNA, 20 nt, Artificial Sequence
  targeting sequence with GTCN PAM
cucucuucaucuuggguggc

SEQ ID NO: 10257 - RNA, 20 nt, Artificial Sequence
  targeting sequence with GTCN PAM
ugcagcagauucgagugcca

SEQ ID NO: 10258 - RNA, 20 nt, Artificial Sequence
  targeting sequence with GTCN PAM
ccacccaccccacagcucug

SEQ ID NO: 10259 - RNA, 20 nt, Artificial Sequence
  targeting sequence with GTCN PAM
ccacaugaugugcagcaaau

SEQ ID NO: 10260 - RNA, 20 nt, Artificial Sequence
  targeting sequence with GTCN PAM
ucagugucuccacaugaugu

SEQ ID NO: 10261 - RNA, 20 nt, Artificial Sequence
  targeting sequence with GTCN PAM
uuuuagacaauuuuuguucu

SEQ ID NO: 10262 - RNA, 20 nt, Artificial Sequence
  targeting sequence with GTCN PAM
aaaaugacccacaaugcuuu

SEQ ID NO: 10263 - RNA, 20 nt, Artificial Sequence
  targeting sequence with GTCN PAM
gcuuucuggccucugcaucu

SEQ ID NO: 10264 - RNA, 20 nt, Artificial Sequence
  targeting sequence with GTCN PAM
ucaaauaacuguucacugcc

SEQ ID NO: 10265 - RNA, 20 nt, Artificial Sequence
  targeting sequence with GTCN PAM
acugauggagccuucgggca

SEQ ID NO: 10266 - RNA, 20 nt, Artificial Sequence
  targeting sequence with GTCN PAM
aauuagguaggcauuugcuu

SEQ ID NO: 10267 - RNA, 20 nt, Artificial Sequence
  targeting sequence with GTCN PAM
cuguugaagcaaaugccuac

SEQ ID NO: 10268 - RNA, 20 nt, Artificial Sequence
  targeting sequence with GTCN PAM
cacagcugcaugcguaguca

SEQ ID NO: 10269 - RNA, 20 nt, Artificial Sequence
  targeting sequence with GTCN PAM
ucucuaguuaccagugaacu

SEQ ID NO: 10270 - RNA, 20 nt, Artificial Sequence
  targeting sequence with GTCN PAM
uuugugcuucagcagagaau

SEQ ID NO: 10271 - RNA, 20 nt, Artificial Sequence
  targeting sequence with GTCN PAM
gaaccauucacucauauggu

SEQ ID NO: 10272 - RNA, 20 nt, Artificial Sequence
  targeting sequence with GTCN PAM
cugauucugauucugucuga

SEQ ID NO: 10273 - RNA, 20 nt, Artificial Sequence
  targeting sequence with GTCN PAM
ucccugacagaagcuuccca

SEQ ID NO: 10274 - RNA, 20 nt, Artificial Sequence
  targeting sequence with GTCN PAM
gggaugacacuauagagaaa

SEQ ID NO: 10275 - RNA, 20 nt, Artificial Sequence
  targeting sequence with GTCN PAM
aacagcaaacauauaccagu

SEQ ID NO: 10276 - RNA, 20 nt, Artificial Sequence
  targeting sequence with GTCN PAM
uauauauuugcacaaauaca

SEQ ID NO: 10277 - RNA, 20 nt, Artificial Sequence
  targeting sequence with GTCN PAM
uuuaaacaaaaauuuaaaga

SEQ ID NO: 10278 - RNA, 20 nt, Artificial Sequence
  targeting sequence with GTCN PAM
acauauucccagaacaggag

SEQ ID NO: 10279 - RNA, 20 nt, Artificial Sequence
  targeting sequence with GTCN PAM
ucaggaacaaaacuuuagug

SEQ ID NO: 10280 - RNA, 20 nt, Artificial Sequence
  targeting sequence with GTCN PAM
ucugagaguagucaucagga

SEQ ID NO: 10281 - RNA, 20 nt, Artificial Sequence
  targeting sequence with GTCN PAM
uuguggcuccacuguccaua

SEQ ID NO: 10282 - RNA, 20 nt, Artificial Sequence
  targeting sequence with GTCN PAM
auauucuuucaugccuguga

SEQ ID NO: 10283 - RNA, 20 nt, Artificial Sequence
  targeting sequence with GTCN PAM
cccuguuuaugcuccucugu

SEQ ID NO: 10284 - RNA, 20 nt, Artificial Sequence
  targeting sequence with GTCN PAM
uuaucccugucucccuguuu

SEQ ID NO: 10285 - RNA, 20 nt, Artificial Sequence
  targeting sequence with GTCN PAM
cucucuaguaccuuccuacu

SEQ ID NO: 10286 - RNA, 20 nt, Artificial Sequence
  targeting sequence with GTCN PAM
uugaucuaauaagggcaagg

SEQ ID NO: 10287 - RNA, 20 nt, Artificial Sequence
  targeting sequence with GTCN PAM
uggccucuggugugguuuuc

SEQ ID NO: 10288 - RNA, 20 nt, Artificial Sequence
  targeting sequence with GTCN PAM
ugcuggcuaauaguuacuga

SEQ ID NO: 10289 - RNA, 20 nt, Artificial Sequence
  targeting sequence with GTCN PAM
uuuaaucucaugggauaaac

SEQ ID NO: 10290 - RNA, 20 nt, Artificial Sequence
  targeting sequence with GTCN PAM
agguuagcugaggaucauuc

SEQ ID NO: 10291 - RNA, 20 nt, Artificial Sequence
  targeting sequence with GTCN PAM
cauaugcaaagguacuagga

SEQ ID NO: 10292 - RNA, 20 nt, Artificial Sequence
  targeting sequence with GTCN PAM
ucugguugcugccuauuuaa

SEQ ID NO: 10293 - RNA, 20 nt, Artificial Sequence
  targeting sequence with GTCN PAM
aaugcuguggcaaaaauacc

SEQ ID NO: 10294 - RNA, 20 nt, Artificial Sequence
  targeting sequence with GTCN PAM
gcaauuuuauagaguuaauu

SEQ ID NO: 10295 - RNA, 20 nt, Artificial Sequence
  targeting sequence with GTCN PAM
caaaguuguacagggacacc

SEQ ID NO: 10296 - RNA, 20 nt, Artificial Sequence
  targeting sequence with GTCN PAM
cuguacaacuuugagacuau

SEQ ID NO: 10297 - RNA, 20 nt, Artificial Sequence
  targeting sequence with GTCN PAM
uacagaggcucaaaugaaua

SEQ ID NO: 10298 - RNA, 20 nt, Artificial Sequence
  targeting sequence with GTCN PAM
cuaaauaaauaaauaguuaa

SEQ ID NO: 10299 - RNA, 20 nt, Artificial Sequence
  targeting sequence with GTCN PAM
cccccugccacccaggcugg

SEQ ID NO: 10300 - RNA, 20 nt, Artificial Sequence
  targeting sequence with GTCN PAM
acauggcgaaaccccauguu

SEQ ID NO: 10301 - RNA, 20 nt, Artificial Sequence
  targeting sequence with GTCN PAM
cgaacuccugaccucaagug

SEQ ID NO: 10302 - RNA, 20 nt, Artificial Sequence
  targeting sequence with GTCN PAM
ggaguucgagaccagccugg

SEQ ID NO: 10303 - RNA, 20 nt, Artificial Sequence
  targeting sequence with GTCN PAM
ccgcgccccacccaacuaac

SEQ ID NO: 10304 - RNA, 20 nt, Artificial Sequence
  targeting sequence with GTCN PAM
uuuugcuccuuuuucucuuu

SEQ ID NO: 10305 - RNA, 20 nt, Artificial Sequence
  targeting sequence with GTCN PAM
aaggagugaaaggggagagg

SEQ ID NO: 10306 - RNA, 20 nt, Artificial Sequence
  targeting sequence with GTCN PAM
cccuuccucaccuuuugcuc

SEQ ID NO: 10307 - RNA, 20 nt, Artificial Sequence
  targeting sequence with GTCN PAM
ggcauuucaaauaauuuggu

SEQ ID NO: 10308 - RNA, 20 nt, Artificial Sequence
  targeting sequence with GTCN PAM
ucaguaaaauugugcuagaa

SEQ ID NO: 10309 - RNA, 20 nt, Artificial Sequence
  targeting sequence with GTCN PAM
uuuuuucccuuaaguuuuuc

SEQ ID NO: 10310 - RNA, 20 nt, Artificial Sequence
  targeting sequence with GTCN PAM
ccauauuuaucaaaaaacua

SEQ ID NO: 10311 - RNA, 20 nt, Artificial Sequence
  targeting sequence with GTCN PAM
aaaccaaaaaagcuuugguc

SEQ ID NO: 10312 - RNA, 20 nt, Artificial Sequence
  targeting sequence with GTCN PAM
gugaaauuuaacuugguuca

SEQ ID NO: 10313 - RNA, 20 nt, Artificial Sequence
  targeting sequence with GTCN PAM
uuuucugcauaucuguaaaa

SEQ ID NO: 10314 - RNA, 20 nt, Artificial Sequence
  targeting sequence with GTCN PAM
cuguugcccaggcugaucuc

SEQ ID NO: 10315 - RNA, 20 nt, Artificial Sequence
  targeting sequence with GTCN PAM
uagauuaauuccucgagggc

SEQ ID NO: 10316 - RNA, 20 nt, Artificial Sequence
  targeting sequence with GTCN PAM
auacaugaaacauacagaaa

SEQ ID NO: 10317 - RNA, 20 nt, Artificial Sequence
  targeting sequence with GTCN PAM
uucuuacacacuucaccacu

SEQ ID NO: 10318 - RNA, 20 nt, Artificial Sequence
  targeting sequence with GTCN PAM
ggaagaucaguuagaauugg

SEQ ID NO: 10319 - RNA, 20 nt, Artificial Sequence
  targeting sequence with GTCN PAM
cauccuucagagcucaguaa

SEQ ID NO: 10320 - RNA, 20 nt, Artificial Sequence
  targeting sequence with GTCN PAM
ucuuuuucuaaauuauaagu

SEQ ID NO: 10321 - RNA, 20 nt, Artificial Sequence
  targeting sequence with GTCN PAM
acaggaauuccucauaccau

SEQ ID NO: 10322 - RNA, 20 nt, Artificial Sequence
  targeting sequence with GTCN PAM
caaugguaugaggaauuccu

SEQ ID NO: 10323 - RNA, 20 nt, Artificial Sequence
  targeting sequence with GTCN PAM
uccauacuucauuuagcccc

SEQ ID NO: 10324 - RNA, 20 nt, Artificial Sequence
  targeting sequence with GTCN PAM
agagggagcccauaggauuu

SEQ ID NO: 10325 - RNA, 20 nt, Artificial Sequence
  targeting sequence with GTCN PAM
cuuauuccuuuagaccugcu

SEQ ID NO: 10326 - RNA, 20 nt, Artificial Sequence
  targeting sequence with GTCN PAM
auuuuuguaaaugaucucuu

SEQ ID NO: 10327 - RNA, 20 nt, Artificial Sequence
  targeting sequence with GTCN PAM
cacaaauuuuaaaaaaacug

SEQ ID NO: 10328 - RNA, 20 nt, Artificial Sequence
  targeting sequence with GTCN PAM
gagaauauacuguguauuau

SEQ ID NO: 10329 - RNA, 20 nt, Artificial Sequence
  targeting sequence with GTCN PAM
agccuuagcuguugcuccau

SEQ ID NO: 10330 - RNA, 20 nt, Artificial Sequence
  targeting sequence with GTCN PAM
cugaccaaaggaaacagucc

SEQ ID NO: 10331 - RNA, 20 nt, Artificial Sequence
  targeting sequence with GTCN PAM
gagacaaggcuuuuaggugc

SEQ ID NO: 10332 - RNA, 20 nt, Artificial Sequence
  targeting sequence with GTCN PAM
caagagcauggaagaauccc

SEQ ID NO: 10333 - RNA, 20 nt, Artificial Sequence
  targeting sequence with GTCN PAM
gaauuuuugguuuaaucuuc

SEQ ID NO: 10334 - RNA, 20 nt, Artificial Sequence
  targeting sequence with GTCN PAM
ucagcaguuugucagaauuu

SEQ ID NO: 10335 - RNA, 20 nt, Artificial Sequence
  targeting sequence with GTCN PAM
ucgagggcugcaaucauagg

SEQ ID NO: 10336 - RNA, 20 nt, Artificial Sequence
  targeting sequence with GTCN PAM
gcuuccuuuccuuccuccag

SEQ ID NO: 10337 - RNA, 20 nt, Artificial Sequence
  targeting sequence with GTCN PAM
ucugaaggccacacccccaa

SEQ ID NO: 10338 - RNA, 20 nt, Artificial Sequence
  targeting sequence with GTCN PAM
uggggguguggccuucagaa

SEQ ID NO: 10339 - RNA, 20 nt, Artificial Sequence
  targeting sequence with GTCN PAM
guuaguggagggugagggga

SEQ ID NO: 10340 - RNA, 20 nt, Artificial Sequence
  targeting sequence with GTCN PAM
ugcagcuuucucagguguau

SEQ ID NO: 10341 - RNA, 20 nt, Artificial Sequence
  targeting sequence with GTCN PAM
gagucuugcagcuuucucag

SEQ ID NO: 10342 - RNA, 20 nt, Artificial Sequence
  targeting sequence with GTCN PAM
uccugcuuggcuuuggguuu

SEQ ID NO: 10343 - RNA, 20 nt, Artificial Sequence
  targeting sequence with GTCN PAM
acuccaguaaccauugcaau

SEQ ID NO: 10344 - RNA, 20 nt, Artificial Sequence
  targeting sequence with GTCN PAM
uuuaggguggagauuugugu

SEQ ID NO: 10345 - RNA, 20 nt, Artificial Sequence
  targeting sequence with GTCN PAM
ucaguaagcauaucaagcau

SEQ ID NO: 10346 - RNA, 20 nt, Artificial Sequence
  targeting sequence with GTCN PAM
uauacagcacauucagcuuu

SEQ ID NO: 10347 - RNA, 20 nt, Artificial Sequence
  targeting sequence with GTCN PAM
cuuugagcuguguuuuuauu

SEQ ID NO: 10348 - RNA, 20 nt, Artificial Sequence
  targeting sequence with GTCN PAM
ggcucugauaauugcuuugu

SEQ ID NO: 10349 - RNA, 20 nt, Artificial Sequence
  targeting sequence with GTCN PAM
uacgugggucuggcucugau

SEQ ID NO: 10350 - RNA, 20 nt, Artificial Sequence
  targeting sequence with GTCN PAM
uguaguuccaaaauuuaugu

SEQ ID NO: 10351 - RNA, 20 nt, Artificial Sequence
  targeting sequence with GTCN PAM
accucuuucauuagaguuuu

SEQ ID NO: 10352 - RNA, 20 nt, Artificial Sequence
  targeting sequence with GTCN PAM
gaucucauauguugucuacc

SEQ ID NO: 10353 - RNA, 20 nt, Artificial Sequence
  targeting sequence with GTCN PAM
uuauuucuaauuugguuucc

SEQ ID NO: 10354 - RNA, 20 nt, Artificial Sequence
  targeting sequence with GTCN PAM
uuacuaugucuuuauuucua

SEQ ID NO: 10355 - RNA, 20 nt, Artificial Sequence
  targeting sequence with GTCN PAM
acuugauaagccucucaaag

SEQ ID NO: 10356 - RNA, 20 nt, Artificial Sequence
  targeting sequence with GTCN PAM
agaagaagagacaacagaga

SEQ ID NO: 10357 - RNA, 20 nt, Artificial Sequence
  targeting sequence with GTCN PAM
cuucuucuggacuucugcca

SEQ ID NO: 10358 - RNA, 20 nt, Artificial Sequence
  targeting sequence with GTCN PAM
uaucacuaauuucgguaagu

SEQ ID NO: 10359 - RNA, 20 nt, Artificial Sequence
  targeting sequence with GTCN PAM
ccugggcucaagccauccuc

SEQ ID NO: 10360 - RNA, 20 nt, Artificial Sequence
  targeting sequence with GTCN PAM
cccuaugcugcccaggcugg

SEQ ID NO: 10361 - RNA, 20 nt, Artificial Sequence
  targeting sequence with GTCN PAM
cagcuacuugagaagccugg

SEQ ID NO: 10362 - RNA, 20 nt, Artificial Sequence
  targeting sequence with GTCN PAM
ucccagggcccaggcuucuc

SEQ ID NO: 10363 - RNA, 20 nt, Artificial Sequence
  targeting sequence with GTCN PAM
aggcugcaaagagccgugag

SEQ ID NO: 10364 - RNA, 20 nt, Artificial Sequence
  targeting sequence with GTCN PAM
cacugcauuccagccuggau

SEQ ID NO: 10365 - RNA, 20 nt, Artificial Sequence
  targeting sequence with GTCN PAM
uccaggcuggaaugcagugg

SEQ ID NO: 10366 - RNA, 20 nt, Artificial Sequence
  targeting sequence with GTCN PAM
ugcccugucauccaggcugg

SEQ ID NO: 10367 - RNA, 20 nt, Artificial Sequence
  targeting sequence with GTCN PAM
caaaaaauaaaagaaaaaga

SEQ ID NO: 10368 - RNA, 20 nt, Artificial Sequence
  targeting sequence with GTCN PAM
cacucuguugcccagguuga

SEQ ID NO: 10369 - RNA, 20 nt, Artificial Sequence
  targeting sequence with GTCN PAM
caaaaaaauaaaaagaaaaa

SEQ ID NO: 10370 - RNA, 20 nt, Artificial Sequence
  targeting sequence with GTCN PAM
caugauguuugauguuuuuc

SEQ ID NO: 10371 - RNA, 20 nt, Artificial Sequence
  targeting sequence with GTCN PAM
gugucucacaaauacuuuag

SEQ ID NO: 10372 - RNA, 20 nt, Artificial Sequence
  targeting sequence with GTCN PAM
cacaaauacuuuaguauuug

SEQ ID NO: 10373 - RNA, 20 nt, Artificial Sequence
  targeting sequence with GTCN PAM
ccaugcccagcccaaaagag

SEQ ID NO: 10374 - RNA, 20 nt, Artificial Sequence
  targeting sequence with GTCN PAM
cagcuucucaggaggcugag

SEQ ID NO: 10375 - RNA, 20 nt, Artificial Sequence
  targeting sequence with GTCN PAM
uuugaaaugguuucgaaggu

SEQ ID NO: 10376 - RNA, 20 nt, Artificial Sequence
  targeting sequence with GTCN PAM
uucacacucaaaacaaaucu

SEQ ID NO: 10377 - RNA, 20 nt, Artificial Sequence
  targeting sequence with GTCN PAM
uauagugagaauaaacauuu

SEQ ID NO: 10378 - RNA, 20 nt, Artificial Sequence
  targeting sequence with GTCN PAM
uaaucuuggaguuaggugaa

SEQ ID NO: 10379 - RNA, 20 nt, Artificial Sequence
  targeting sequence with GTCN PAM
ucaccuacacgagucucauc

SEQ ID NO: 10380 - RNA, 20 nt, Artificial Sequence
  targeting sequence with GTCN PAM
cauccuuguccaauucaucc

SEQ ID NO: 10381 - RNA, 20 nt, Artificial Sequence
  targeting sequence with GTCN PAM
aauucauccuaccuaugagu

SEQ ID NO: 10382 - RNA, 20 nt, Artificial Sequence
  targeting sequence with GTCN PAM
acucuucauaucuuaaaaug

SEQ ID NO: 10383 - RNA, 20 nt, Artificial Sequence
  targeting sequence with GTCN PAM
uuuuaagauaugaagagugg

SEQ ID NO: 10384 - RNA, 20 nt, Artificial Sequence
  targeting sequence with GTCN PAM
ccaaaaggucagcaaauggg

SEQ ID NO: 10385 - RNA, 20 nt, Artificial Sequence
  targeting sequence with GTCN PAM
gcaaauggguagggcgggcu

SEQ ID NO: 10386 - RNA, 20 nt, Artificial Sequence
  targeting sequence with GTCN PAM
cacaaacacagaaacacaaa

SEQ ID NO: 10387 - RNA, 20 nt, Artificial Sequence
  targeting sequence with GTCN PAM
ccuauucucuuccuucuuua

SEQ ID NO: 10388 - RNA, 20 nt, Artificial Sequence
  targeting sequence with GTCN PAM
cuaaauuaaaaaauuaucua

SEQ ID NO: 10389 - RNA, 20 nt, Artificial Sequence
  targeting sequence with GTCN PAM
uaaccugguguggguagaaa

SEQ ID NO: 10390 - RNA, 20 nt, Artificial Sequence
  targeting sequence with GTCN PAM
ccagauaggaugaacuggga

SEQ ID NO: 10391 - RNA, 20 nt, Artificial Sequence
  targeting sequence with GTCN PAM
guuucuugaaaauaagccaa

SEQ ID NO: 10392 - RNA, 20 nt, Artificial Sequence
  targeting sequence with GTCN PAM
uauuuuuuaaaaacuuauuu

SEQ ID NO: 10393 - RNA, 20 nt, Artificial Sequence
  targeting sequence with GTCN PAM
cugagucagagcuacaagac

SEQ ID NO: 10394 - RNA, 20 nt, Artificial Sequence
  targeting sequence with GTCN PAM
gagcuacaagacaagugauu

SEQ ID NO: 10395 - RNA, 20 nt, Artificial Sequence
  targeting sequence with GTCN PAM
uguagcucugacucagugac

SEQ ID NO: 10396 - RNA, 20 nt, Artificial Sequence
  targeting sequence with GTCN PAM
ucuuuagaaucacuugucuu

SEQ ID NO: 10397 - RNA, 20 nt, Artificial Sequence
  targeting sequence with GTCN PAM
ucaucuuuagaaucacuugu

SEQ ID NO: 10398 - RNA, 20 nt, Artificial Sequence
  targeting sequence with GTCN PAM
ucaucugucgucaucuuuag

SEQ ID NO: 10399 - RNA, 20 nt, Artificial Sequence
  targeting sequence with GTCN PAM
cacagauaguuuguggcaua

SEQ ID NO: 10400 - RNA, 20 nt, Artificial Sequence
  targeting sequence with GTCN PAM
aacguagugccuagcagagu

SEQ ID NO: 10401 - RNA, 20 nt, Artificial Sequence
  targeting sequence with GTCN PAM
ucuuguaacacagggauuuc

SEQ ID NO: 10402 - RNA, 20 nt, Artificial Sequence
  targeting sequence with GTCN PAM
uaaucucuuuauugguaaac

SEQ ID NO: 10403 - RNA, 20 nt, Artificial Sequence
  targeting sequence with GTCN PAM
ugaaauuuggguagaaaugc

SEQ ID NO: 10404 - RNA, 20 nt, Artificial Sequence
  targeting sequence with GTCN PAM
caucacaugcagagccaucu

SEQ ID NO: 10405 - RNA, 20 nt, Artificial Sequence
  targeting sequence with GTCN PAM
aagcaaaaaaagaaacaaua

SEQ ID NO: 10406 - RNA, 20 nt, Artificial Sequence
  targeting sequence with GTCN PAM
uuaucaaauuccaguauugu

SEQ ID NO: 10407 - RNA, 20 nt, Artificial Sequence
  targeting sequence with GTCN PAM
cuacuaaaaauacaaaaauu

SEQ ID NO: 10408 - RNA, 20 nt, Artificial Sequence
  targeting sequence with GTCN PAM
ucggacuccugaccucaagu

SEQ ID NO: 10409 - RNA, 20 nt, Artificial Sequence
  targeting sequence with GTCN PAM
gaggaccagccuggccaaca

SEQ ID NO: 10410 - RNA, 20 nt, Artificial Sequence
  targeting sequence with GTCN PAM
ggaguccgaggaccagccug

SEQ ID NO: 10411 - RNA, 20 nt, Artificial Sequence
  targeting sequence with GTCN PAM
guaacauuuguuuugagauc

SEQ ID NO: 10412 - RNA, 20 nt, Artificial Sequence
  targeting sequence with GTCN PAM
ccaauuugauuauugguaau

SEQ ID NO: 10413 - RNA, 20 nt, Artificial Sequence
  targeting sequence with GTCN PAM
uugauauauuucuuucugua

SEQ ID NO: 10414 - RNA, 20 nt, Artificial Sequence
  targeting sequence with GTCN PAM
uuguccuugauuccuggcag

SEQ ID NO: 10415 - RNA, 20 nt, Artificial Sequence
  targeting sequence with GTCN PAM
uugauuccuggcagagcucc

SEQ ID NO: 10416 - RNA, 20 nt, Artificial Sequence
  targeting sequence with GTCN PAM
ccuaauuaguauaaacucag

SEQ ID NO: 10417 - RNA, 20 nt, Artificial Sequence
  targeting sequence with GTCN PAM
uccacuccucaaccuuuggg

SEQ ID NO: 10418 - RNA, 20 nt, Artificial Sequence
  targeting sequence with GTCN PAM
ccaguuccucucucuucccc

SEQ ID NO: 10419 - RNA, 20 nt, Artificial Sequence
  targeting sequence with GTCN PAM
guccccaguuccucucucuu

SEQ ID NO: 10420 - RNA, 20 nt, Artificial Sequence
  targeting sequence with GTCN PAM
ucucugggcacaaaacccuc

SEQ ID NO: 10421 - RNA, 20 nt, Artificial Sequence
  targeting sequence with GTCN PAM
uuccagugaauuaacgaacc

SEQ ID NO: 10422 - RNA, 20 nt, Artificial Sequence
  targeting sequence with GTCN PAM
cgagaaccccugaauuugca

SEQ ID NO: 10423 - RNA, 20 nt, Artificial Sequence
  targeting sequence with GTCN PAM
ggcuuggcugcaaauucagg

SEQ ID NO: 10424 - RNA, 20 nt, Artificial Sequence
  targeting sequence with GTCN PAM
ugggccacccacacuucugu

SEQ ID NO: 10425 - RNA, 20 nt, Artificial Sequence
  targeting sequence with GTCN PAM
caagucuugggccacccaca

SEQ ID NO: 10426 - RNA, 20 nt, Artificial Sequence
  targeting sequence with GTCN PAM
uuugggacugagcccuuuaa

SEQ ID NO: 10427 - RNA, 20 nt, Artificial Sequence
  targeting sequence with GTCN PAM
caaaagacugcugcugcuug

SEQ ID NO: 10428 - RNA, 20 nt, Artificial Sequence
  targeting sequence with GTCN PAM
gaucucaaguuaaagggcuc

SEQ ID NO: 10429 - RNA, 20 nt, Artificial Sequence
  targeting sequence with GTCN PAM
accuggaguuagugucagau

SEQ ID NO: 10430 - RNA, 20 nt, Artificial Sequence
  targeting sequence with GTCN PAM
gaauugaauggaauuguuga

SEQ ID NO: 10431 - RNA, 20 nt, Artificial Sequence
  targeting sequence with GTCN PAM
uagaacugaaggugaauuag

SEQ ID NO: 10432 - RNA, 20 nt, Artificial Sequence
  targeting sequence with GTCN PAM
agaacaguugccacuaaaaa

SEQ ID NO: 10433 - RNA, 20 nt, Artificial Sequence
  targeting sequence with GTCN PAM
caaaaaaaaaauaaaaauaa

SEQ ID NO: 10434 - RNA, 20 nt, Artificial Sequence
  targeting sequence with GTCN PAM
ugaaaccccaucucuacuaa

SEQ ID NO: 10435 - RNA, 20 nt, Artificial Sequence
  targeting sequence with GTCN PAM
ugaacuccugaccucaggug

SEQ ID NO: 10436 - RNA, 20 nt, Artificial Sequence
  targeting sequence with GTCN PAM
ggaguucaagaccagccugg

SEQ ID NO: 10437 - RNA, 20 nt, Artificial Sequence
  targeting sequence with GTCN PAM
uaauaggcauguuuaauuua

SEQ ID NO: 10438 - RNA, 20 nt, Artificial Sequence
  targeting sequence with GTCN PAM
aaaacugagcuucuguuacu

SEQ ID NO: 10439 - RNA, 20 nt, Artificial Sequence
  targeting sequence with GTCN PAM
ucuccaucucaauaaaugac

SEQ ID NO: 10440 - RNA, 20 nt, Artificial Sequence
  targeting sequence with GTCN PAM
uuuauugagauggagaagac

SEQ ID NO: 10441 - RNA, 20 nt, Artificial Sequence
  targeting sequence with GTCN PAM
gcagguuuugcugauagauu

SEQ ID NO: 10442 - RNA, 20 nt, Artificial Sequence
  targeting sequence with GTCN PAM
cugcuacucucuagcacaaa

SEQ ID NO: 10443 - RNA, 20 nt, Artificial Sequence
  targeting sequence with GTCN PAM
uugcccaauccaccacuauc

SEQ ID NO: 10444 - RNA, 20 nt, Artificial Sequence
  targeting sequence with GTCN PAM
aaauauaaaucagaucaugu

SEQ ID NO: 10445 - RNA, 20 nt, Artificial Sequence
  targeting sequence with GTCN PAM
cccugcccaaacgcuccaaa

SEQ ID NO: 10446 - RNA, 20 nt, Artificial Sequence
  targeting sequence with GTCN PAM
uuggagcguuugggcagggu

SEQ ID NO: 10447 - RNA, 20 nt, Artificial Sequence
  targeting sequence with GTCN PAM
uacaaagaccagcagcagca

SEQ ID NO: 10448 - RNA, 20 nt, Artificial Sequence
  targeting sequence with GTCN PAM
uuguaggacuucagcauuua

SEQ ID NO: 10449 - RNA, 20 nt, Artificial Sequence
  targeting sequence with GTCN PAM
gggguagggccuaauucuaa

SEQ ID NO: 10450 - RNA, 20 nt, Artificial Sequence
  targeting sequence with GTCN PAM
aaauuuuaauagaaaccccc

SEQ ID NO: 10451 - RNA, 20 nt, Artificial Sequence
  targeting sequence with GTCN PAM
uuauuuuguggugcuuuaug

SEQ ID NO: 10452 - RNA, 20 nt, Artificial Sequence
  targeting sequence with GTCN PAM
caggacauguacacugugau

SEQ ID NO: 10453 - RNA, 20 nt, Artificial Sequence
  targeting sequence with GTCN PAM
ugagacagaagcuugccuga

SEQ ID NO: 10454 - RNA, 20 nt, Artificial Sequence
  targeting sequence with GTCN PAM
uugguaaccuguaauuuacu

SEQ ID NO: 10455 - RNA, 20 nt, Artificial Sequence
  targeting sequence with GTCN PAM
ucacuacucuauauuuccau

SEQ ID NO: 10456 - RNA, 20 nt, Artificial Sequence
  targeting sequence with GTCN PAM
uauagucaucacuacucuau

SEQ ID NO: 10457 - RNA, 20 nt, Artificial Sequence
  targeting sequence with GTCN PAM
cugguaaagggucgugacug

SEQ ID NO: 10458 - RNA, 20 nt, Artificial Sequence
  targeting sequence with GTCN PAM
ugacugccaauuguccaggu

SEQ ID NO: 10459 - RNA, 20 nt, Artificial Sequence
  targeting sequence with GTCN PAM
cgacccuuuaccagugacac

SEQ ID NO: 10460 - RNA, 20 nt, Artificial Sequence
  targeting sequence with GTCN PAM
agguucuugguguuuugaac

SEQ ID NO: 10461 - RNA, 20 nt, Artificial Sequence
  targeting sequence with GTCN PAM
aaauacccucuagaaguuuc

SEQ ID NO: 10462 - RNA, 20 nt, Artificial Sequence
  targeting sequence with GTCN PAM
ggugguuuuugcaaccaauc

SEQ ID NO: 10463 - RNA, 20 nt, Artificial Sequence
  targeting sequence with GTCN PAM
ucuuuugcauagaaguauaa

SEQ ID NO: 10464 - RNA, 20 nt, Artificial Sequence
  targeting sequence with GTCN PAM
gauugguuguggacagcaac

SEQ ID NO: 10465 - RNA, 20 nt, Artificial Sequence
  targeting sequence with GTCN PAM
acaaccaaucagacugauug

SEQ ID NO: 10466 - RNA, 20 nt, Artificial Sequence
  targeting sequence with GTCN PAM
uccuucgcaacuuuguaacu

SEQ ID NO: 10467 - RNA, 20 nt, Artificial Sequence
  targeting sequence with GTCN PAM
gauugguuguggacagccaa

SEQ ID NO: 10468 - RNA, 20 nt, Artificial Sequence
  targeting sequence with GTCN PAM
acaaccaaucagacugauug

SEQ ID NO: 10469 - RNA, 20 nt, Artificial Sequence
  targeting sequence with GTCN PAM
agaaaaggcuggggguuugc

SEQ ID NO: 10470 - RNA, 20 nt, Artificial Sequence
  targeting sequence with GTCN PAM
uuuuuuacuuaggcauggaa

SEQ ID NO: 10471 - RNA, 20 nt, Artificial Sequence
  targeting sequence with GTCN PAM
gagugaggcauaaggcugcc

SEQ ID NO: 10472 - RNA, 20 nt, Artificial Sequence
  targeting sequence with GTCN PAM
gcaggcagggaaccuaaggc

SEQ ID NO: 10473 - RNA, 20 nt, Artificial Sequence
  targeting sequence with GTCN PAM
caaaaaaaaaaaaaaaaaaa

SEQ ID NO: 10474 - RNA, 20 nt, Artificial Sequence
  targeting sequence with GTCN PAM
uguucugucuccaggcugga

SEQ ID NO: 10475 - RNA, 20 nt, Artificial Sequence
  targeting sequence with GTCN PAM
ccaggcuggagugcaguggc

SEQ ID NO: 10476 - RNA, 20 nt, Artificial Sequence
  targeting sequence with GTCN PAM
cucacucccucagaguaaag

SEQ ID NO: 10477 - RNA, 20 nt, Artificial Sequence
  targeting sequence with GTCN PAM
ucccaguuucaucugggccu

SEQ ID NO: 10478 - RNA, 20 nt, Artificial Sequence
  targeting sequence with GTCN PAM
ggugagugaggcccagauga

SEQ ID NO: 10479 - RNA, 20 nt, Artificial Sequence
  targeting sequence with GTCN PAM
guccggugagugaggcccag

SEQ ID NO: 10480 - RNA, 20 nt, Artificial Sequence
  targeting sequence with GTCN PAM
gaggggcagcgaggaggcag

SEQ ID NO: 10481 - RNA, 20 nt, Artificial Sequence
  targeting sequence with GTCN PAM
gccugcuccccuccuucagg

SEQ ID NO: 10482 - RNA, 20 nt, Artificial Sequence
  targeting sequence with GTCN PAM
cuauuuggugaggccuuccc

SEQ ID NO: 10483 - RNA, 20 nt, Artificial Sequence
  targeting sequence with GTCN PAM
ugucuccuuucacguaauuu

SEQ ID NO: 10484 - RNA, 20 nt, Artificial Sequence
  targeting sequence with GTCN PAM
ccuuucacguaauuugagcu

SEQ ID NO: 10485 - RNA, 20 nt, Artificial Sequence
  targeting sequence with GTCN PAM
cuguccaguucacuggcaca

SEQ ID NO: 10486 - RNA, 20 nt, Artificial Sequence
  targeting sequence with GTCN PAM
aguucacuggcacauaguag

SEQ ID NO: 10487 - RNA, 20 nt, Artificial Sequence
  targeting sequence with CTCN PAM
uuugucucgguuuuuuuuuu

SEQ ID NO: 10488 - RNA, 20 nt, Artificial Sequence
  targeting sequence with CTCN PAM
aaugaggucugaagaugguc

SEQ ID NO: 10489 - RNA, 20 nt, Artificial Sequence
  targeting sequence with CTCN PAM
uucgaguuugcucauuuguc

SEQ ID NO: 10490 - RNA, 20 nt, Artificial Sequence
  targeting sequence with CTCN PAM
ugucccaucacccugaugau

SEQ ID NO: 10491 - RNA, 20 nt, Artificial Sequence
  targeting sequence with CTCN PAM
ccugaaagccgguugccagc

SEQ ID NO: 10492 - RNA, 20 nt, Artificial Sequence
  targeting sequence with CTCN PAM
cucaccugaaagccgguugc

SEQ ID NO: 10493 - RNA, 20 nt, Artificial Sequence
  targeting sequence with CTCN PAM
uuuuggacugcgcuggcaga

SEQ ID NO: 10494 - RNA, 20 nt, Artificial Sequence
  targeting sequence with CTCN PAM
uuuugcagaaacuucaggcc

SEQ ID NO: 10495 - RNA, 20 nt, Artificial Sequence
  targeting sequence with CTCN PAM
aacaugaaaaugaaacuuua

SEQ ID NO: 10496 - RNA, 20 nt, Artificial Sequence
  targeting sequence with CTCN PAM
uuaaaaaucacauagcaaaa

SEQ ID NO: 10497 - RNA, 20 nt, Artificial Sequence
  targeting sequence with CTCN PAM
aguuuugcuaugugauuuuu

SEQ ID NO: 10498 - RNA, 20 nt, Artificial Sequence
  targeting sequence with CTCN PAM
gcuccugcccugucccacag

SEQ ID NO: 10499 - RNA, 20 nt, Artificial Sequence
  targeting sequence with CTCN PAM
ugcccugucccacagguggc

SEQ ID NO: 10500 - RNA, 20 nt, Artificial Sequence
  targeting sequence with CTCN PAM
ccgugcagccagugaacccu

SEQ ID NO: 10501 - RNA, 20 nt, Artificial Sequence
  targeting sequence with CTCN PAM
aguccaggguucacuggcug

SEQ ID NO: 10502 - RNA, 20 nt, Artificial Sequence
  targeting sequence with CTCN PAM
ggaacugaacugcucaauuu

SEQ ID NO: 10503 - RNA, 20 nt, Artificial Sequence
  targeting sequence with CTCN PAM
auuucuuuucuuuucuuuuc

SEQ ID NO: 10504 - RNA, 20 nt, Artificial Sequence
  targeting sequence with CTCN PAM
aaaaaagaaaaagaaaagaa

SEQ ID NO: 10505 - RNA, 20 nt, Artificial Sequence
  targeting sequence with CTCN PAM
guugucucgaaaaaagaaaa

SEQ ID NO: 10506 - RNA, 20 nt, Artificial Sequence
  targeting sequence with CTCN PAM
agccugggcgacagaacaag

SEQ ID NO: 10507 - RNA, 20 nt, Artificial Sequence
  targeting sequence with CTCN PAM
gcucacugcaagcuccgccu

SEQ ID NO: 10508 - RNA, 20 nt, Artificial Sequence
  targeting sequence with CTCN PAM
cugcaagcuccgccuucagg

SEQ ID NO: 10509 - RNA, 20 nt, Artificial Sequence
  targeting sequence with CTCN PAM
gccuucaggguucacgccau

SEQ ID NO: 10510 - RNA, 20 nt, Artificial Sequence
  targeting sequence with CTCN PAM
ugccucagccuccugaguag

SEQ ID NO: 10511 - RNA, 20 nt, Artificial Sequence
  targeting sequence with CTCN PAM
gccuccugaguagcugggac

SEQ ID NO: 10512 - RNA, 20 nt, Artificial Sequence
  targeting sequence with CTCN PAM
ugaguagcugggacuacagg

SEQ ID NO: 10513 - RNA, 20 nt, Artificial Sequence
  targeting sequence with CTCN PAM
ggaggcugaggcaggagaau

SEQ ID NO: 10514 - RNA, 20 nt, Artificial Sequence
  targeting sequence with CTCN PAM
cccucuguacuuucuuuucu

SEQ ID NO: 10515 - RNA, 20 nt, Artificial Sequence
  targeting sequence with CTCN PAM
cccagcaccccgcacucacu

SEQ ID NO: 10516 - RNA, 20 nt, Artificial Sequence
  targeting sequence with CTCN PAM
cuagauggacuuugccucca

SEQ ID NO: 10517 - RNA, 20 nt, Artificial Sequence
  targeting sequence with CTCN PAM
aagaucagguaucugccuau

SEQ ID NO: 10518 - RNA, 20 nt, Artificial Sequence
  targeting sequence with CTCN PAM
uaggcagauaccugaucuug

SEQ ID NO: 10519 - RNA, 20 nt, Artificial Sequence
  targeting sequence with CTCN PAM
cauaggcagauaccugaucu

SEQ ID NO: 10520 - RNA, 20 nt, Artificial Sequence
  targeting sequence with CTCN PAM
cucauaggcagauaccugau

SEQ ID NO: 10521 - RNA, 20 nt, Artificial Sequence
  targeting sequence with CTCN PAM
ccagauuccuuccccuggag

SEQ ID NO: 10522 - RNA, 20 nt, Artificial Sequence
  targeting sequence with CTCN PAM
aggggaaggaaucuggugag

SEQ ID NO: 10523 - RNA, 20 nt, Artificial Sequence
  targeting sequence with CTCN PAM
ugggaaugauacacaaaaga

SEQ ID NO: 10524 - RNA, 20 nt, Artificial Sequence
  targeting sequence with CTCN PAM
gaaguuugcuguggcaaagg

SEQ ID NO: 10525 - RNA, 20 nt, Artificial Sequence
  targeting sequence with CTCN PAM
aagcaccagaucuuuccugc

SEQ ID NO: 10526 - RNA, 20 nt, Artificial Sequence
  targeting sequence with CTCN PAM
gagcccagaggcaccaucuc

SEQ ID NO: 10527 - RNA, 20 nt, Artificial Sequence
  targeting sequence with CTCN PAM
gagugugcuguguuugccau

SEQ ID NO: 10528 - RNA, 20 nt, Artificial Sequence
  targeting sequence with CTCN PAM
gggcucugagugugcugugu

SEQ ID NO: 10529 - RNA, 20 nt, Artificial Sequence
  targeting sequence with CTCN PAM
guaugccguuaaaauacaaa

SEQ ID NO: 10530 - RNA, 20 nt, Artificial Sequence
  targeting sequence with CTCN PAM
cuuccaaggcuucauagccu

SEQ ID NO: 10531 - RNA, 20 nt, Artificial Sequence
  targeting sequence with CTCN PAM
aguguaacccucgugcuccc

SEQ ID NO: 10532 - RNA, 20 nt, Artificial Sequence
  targeting sequence with CTCN PAM
ugcuccccagcagccucucc

SEQ ID NO: 10533 - RNA, 20 nt, Artificial Sequence
  targeting sequence with CTCN PAM
ccagcagccucucccauugg

SEQ ID NO: 10534 - RNA, 20 nt, Artificial Sequence
  targeting sequence with CTCN PAM
cccauuggguccuaccugga

SEQ ID NO: 10535 - RNA, 20 nt, Artificial Sequence
  targeting sequence with CTCN PAM
cauuggguccuaccuggagu

SEQ ID NO: 10536 - RNA, 20 nt, Artificial Sequence
  targeting sequence with CTCN PAM
agguaggacccaaugggaga

SEQ ID NO: 10537 - RNA, 20 nt, Artificial Sequence
  targeting sequence with CTCN PAM
acuccagguaggacccaaug

SEQ ID NO: 10538 - RNA, 20 nt, Artificial Sequence
  targeting sequence with CTCN PAM
cgucuucauccucacugcug

SEQ ID NO: 10539 - RNA, 20 nt, Artificial Sequence
  targeting sequence with CTCN PAM
cugcugcgugcaccacaugg

SEQ ID NO: 10540 - RNA, 20 nt, Artificial Sequence
  targeting sequence with CTCN PAM
ggaauacccuucuugcugau

SEQ ID NO: 10541 - RNA, 20 nt, Artificial Sequence
  targeting sequence with CTCN PAM
cuggaauacccuucuugcug

SEQ ID NO: 10542 - RNA, 20 nt, Artificial Sequence
  targeting sequence with CTCN PAM
cccaucccuccuacuccauu

SEQ ID NO: 10543 - RNA, 20 nt, Artificial Sequence
  targeting sequence with CTCN PAM
uacuccauugaggucacauu

SEQ ID NO: 10544 - RNA, 20 nt, Artificial Sequence
  targeting sequence with CTCN PAM
auugaggucacauuagauga

SEQ ID NO: 10545 - RNA, 20 nt, Artificial Sequence
  targeting sequence with CTCN PAM
auggaguaggagggaugggu

SEQ ID NO: 10546 - RNA, 20 nt, Artificial Sequence
  targeting sequence with CTCN PAM
guccucugggcucucuuacc

SEQ ID NO: 10547 - RNA, 20 nt, Artificial Sequence
  targeting sequence with CTCN PAM
gggcucucuuacccucccug

SEQ ID NO: 10548 - RNA, 20 nt, Artificial Sequence
  targeting sequence with CTCN PAM
cuuacccucccugggcucua

SEQ ID NO: 10549 - RNA, 20 nt, Artificial Sequence
  targeting sequence with CTCN PAM
uacccucccugggcucuaug

SEQ ID NO: 10550 - RNA, 20 nt, Artificial Sequence
  targeting sequence with CTCN PAM
cugggcucuauggaguucga

SEQ ID NO: 10551 - RNA, 20 nt, Artificial Sequence
  targeting sequence with CTCN PAM
auggaguucgagaccaucaa

SEQ ID NO: 10552 - RNA, 20 nt, Artificial Sequence
  targeting sequence with CTCN PAM
auagagcccagggaggguaa

SEQ ID NO: 10553 - RNA, 20 nt, Artificial Sequence
  targeting sequence with CTCN PAM
aacuccauagagcccaggga

SEQ ID NO: 10554 - RNA, 20 nt, Artificial Sequence
  targeting sequence with CTCN PAM
uugauggucucgaacuccau

SEQ ID NO: 10555 - RNA, 20 nt, Artificial Sequence
  targeting sequence with CTCN PAM
cuugaugguuuacaauuguc

SEQ ID NO: 10556 - RNA, 20 nt, Artificial Sequence
  targeting sequence with CTCN PAM
uuuccuccucucacuucccc

SEQ ID NO: 10557 - RNA, 20 nt, Artificial Sequence
  targeting sequence with CTCN PAM
ucucacuuccccauuuuugc

SEQ ID NO: 10558 - RNA, 20 nt, Artificial Sequence
  targeting sequence with CTCN PAM
cacuuccccauuuuugcugc

SEQ ID NO: 10559 - RNA, 20 nt, Artificial Sequence
  targeting sequence with CTCN PAM
cuuccccauuuuugcugcaa

SEQ ID NO: 10560 - RNA, 20 nt, Artificial Sequence
  targeting sequence with CTCN PAM
cgcuacagacuuaccuaccu

SEQ ID NO: 10561 - RNA, 20 nt, Artificial Sequence
  targeting sequence with CTCN PAM
cuacagacuuaccuaccugg

SEQ ID NO: 10562 - RNA, 20 nt, Artificial Sequence
  targeting sequence with CTCN PAM
caauguuuccaucacgguua

SEQ ID NO: 10563 - RNA, 20 nt, Artificial Sequence
  targeting sequence with CTCN PAM
ucuaccucacaauguuucca

SEQ ID NO: 10564 - RNA, 20 nt, Artificial Sequence
  targeting sequence with CTCN PAM
uucaacagaccugggcuggg

SEQ ID NO: 10565 - RNA, 20 nt, Artificial Sequence
  targeting sequence with CTCN PAM
gaacagcuacccaaguguuc

SEQ ID NO: 10566 - RNA, 20 nt, Artificial Sequence
  targeting sequence with CTCN PAM
gcacagaacacuuggguagc

SEQ ID NO: 10567 - RNA, 20 nt, Artificial Sequence
  targeting sequence with CTCN PAM
cugugcuguugagugcuaug

SEQ ID NO: 10568 - RNA, 20 nt, Artificial Sequence
  targeting sequence with CTCN PAM
gugcuguugagugcuauggu

SEQ ID NO: 10569 - RNA, 20 nt, Artificial Sequence
  targeting sequence with CTCN PAM
acagcacagagagcauuucc

SEQ ID NO: 10570 - RNA, 20 nt, Artificial Sequence
  targeting sequence with CTCN PAM
uagggacacaugaaaugugg

SEQ ID NO: 10571 - RNA, 20 nt, Artificial Sequence
  targeting sequence with CTCN PAM
aauuaauugaauggauuaau

SEQ ID NO: 10572 - RNA, 20 nt, Artificial Sequence
  targeting sequence with CTCN PAM
uuauuacuaacuuaauuaau

SEQ ID NO: 10573 - RNA, 20 nt, Artificial Sequence
  targeting sequence with CTCN PAM
cgguagugacugccacacag

SEQ ID NO: 10574 - RNA, 20 nt, Artificial Sequence
  targeting sequence with CTCN PAM
ucuguguggcagucacuacc

SEQ ID NO: 10575 - RNA, 20 nt, Artificial Sequence
  targeting sequence with CTCN PAM
gaagcugcgcucuucugugu

SEQ ID NO: 10576 - RNA, 20 nt, Artificial Sequence
  targeting sequence with CTCN PAM
gcaaggaaacaccaggguag

SEQ ID NO: 10577 - RNA, 20 nt, Artificial Sequence
  targeting sequence with CTCN PAM
gauccaaucauccauuuaug

SEQ ID NO: 10578 - RNA, 20 nt, Artificial Sequence
  targeting sequence with CTCN PAM
cauaaauggaugauuggauc

SEQ ID NO: 10579 - RNA, 20 nt, Artificial Sequence
  targeting sequence with CTCN PAM
gugaggccuggggaugcugc

SEQ ID NO: 10580 - RNA, 20 nt, Artificial Sequence
  targeting sequence with CTCN PAM
cagagggccuggccccugua

SEQ ID NO: 10581 - RNA, 20 nt, Artificial Sequence
  targeting sequence with CTCN PAM
ccguugcagcauccccaggc

SEQ ID NO: 10582 - RNA, 20 nt, Artificial Sequence
  targeting sequence with CTCN PAM
accuggaugcuguccucccc

SEQ ID NO: 10583 - RNA, 20 nt, Artificial Sequence
  targeting sequence with CTCN PAM
guguacaagugcagccccug

SEQ ID NO: 10584 - RNA, 20 nt, Artificial Sequence
  targeting sequence with CTCN PAM
gauccugucuggacaggguu

SEQ ID NO: 10585 - RNA, 20 nt, Artificial Sequence
  targeting sequence with CTCN PAM
gucccugcugcucugauccu

SEQ ID NO: 10586 - RNA, 20 nt, Artificial Sequence
  targeting sequence with CTCN PAM
ugaagacaguaaguuguccc

SEQ ID NO: 10587 - RNA, 20 nt, Artificial Sequence
  targeting sequence with CTCN PAM
ucuccucugacccuggauca

SEQ ID NO: 10588 - RNA, 20 nt, Artificial Sequence
  targeting sequence with CTCN PAM
ucugacccuggaucagagcc

SEQ ID NO: 10589 - RNA, 20 nt, Artificial Sequence
  targeting sequence with CTCN PAM
gacccuggaucagagcccga

SEQ ID NO: 10590 - RNA, 20 nt, Artificial Sequence
  targeting sequence with CTCN PAM
gauccagggucagaggagau

SEQ ID NO: 10591 - RNA, 20 nt, Artificial Sequence
  targeting sequence with CTCN PAM
ggcucugauccagggucaga

SEQ ID NO: 10592 - RNA, 20 nt, Artificial Sequence
  targeting sequence with CTCN PAM
cccugucuagccuguugggc

SEQ ID NO: 10593 - RNA, 20 nt, Artificial Sequence
  targeting sequence with CTCN PAM
ggcauggaaggguuucaucc

SEQ ID NO: 10594 - RNA, 20 nt, Artificial Sequence
  targeting sequence with CTCN PAM
gcccagcgaugugcuuauca

SEQ ID NO: 10595 - RNA, 20 nt, Artificial Sequence
  targeting sequence with CTCN PAM
uccccaggacuccugcccag

SEQ ID NO: 10596 - RNA, 20 nt, Artificial Sequence
  targeting sequence with CTCN PAM
ccaggacuccugcccagcuu

SEQ ID NO: 10597 - RNA, 20 nt, Artificial Sequence
  targeting sequence with CTCN PAM
ugcccagcuuggaaauagca

SEQ ID NO: 10598 - RNA, 20 nt, Artificial Sequence
  targeting sequence with CTCN PAM
cgaccuucccuguguaccca

SEQ ID NO: 10599 - RNA, 20 nt, Artificial Sequence
  targeting sequence with CTCN PAM
aggcucccgaccuucccugu

SEQ ID NO: 10600 - RNA, 20 nt, Artificial Sequence
  targeting sequence with CTCN PAM
gacuccaggcucccgaccuu

SEQ ID NO: 10601 - RNA, 20 nt, Artificial Sequence
  targeting sequence with CTCN PAM
ggucaccauccuuccuggcc

SEQ ID NO: 10602 - RNA, 20 nt, Artificial Sequence
  targeting sequence with CTCN PAM
cccaaggccacauggccagg

SEQ ID NO: 10603 - RNA, 20 nt, Artificial Sequence
  targeting sequence with CTCN PAM
aagaaacagaaauuggcucc

SEQ ID NO: 10604 - RNA, 20 nt, Artificial Sequence
  targeting sequence with CTCN PAM
cauucccccugcugcagaug

SEQ ID NO: 10605 - RNA, 20 nt, Artificial Sequence
  targeting sequence with CTCN PAM
uccaucugcagcagggggaa

SEQ ID NO: 10606 - RNA, 20 nt, Artificial Sequence
  targeting sequence with CTCN PAM
cucuuccaucugcagcaggg

SEQ ID NO: 10607 - RNA, 20 nt, Artificial Sequence
  targeting sequence with CTCN PAM
cgcauuuguugugcagagua

SEQ ID NO: 10608 - RNA, 20 nt, Artificial Sequence
  targeting sequence with CTCN PAM
uguuacagcuuuccacuguu

SEQ ID NO: 10609 - RNA, 20 nt, Artificial Sequence
  targeting sequence with CTCN PAM
cccuccuacgccugugaucu

SEQ ID NO: 10610 - RNA, 20 nt, Artificial Sequence
  targeting sequence with CTCN PAM
uacgccugugaucucauugg

SEQ ID NO: 10611 - RNA, 20 nt, Artificial Sequence
  targeting sequence with CTCN PAM
uuggaucgucccaagaaauu

SEQ ID NO: 10612 - RNA, 20 nt, Artificial Sequence
  targeting sequence with CTCN PAM
uuucuaaguuagaaaugaua

SEQ ID NO: 10613 - RNA, 20 nt, Artificial Sequence
  targeting sequence with CTCN PAM
uuucuaaguguguccucauu

SEQ ID NO: 10614 - RNA, 20 nt, Artificial Sequence
  targeting sequence with CTCN PAM
ggccuauaaucccagcauug

SEQ ID NO: 10615 - RNA, 20 nt, Artificial Sequence
  targeting sequence with CTCN PAM
agcaaugcugggauuauagg

SEQ ID NO: 10616 - RNA, 20 nt, Artificial Sequence
  targeting sequence with CTCN PAM
uggccucaagcaaugcuggg

SEQ ID NO: 10617 - RNA, 20 nt, Artificial Sequence
  targeting sequence with CTCN PAM
cuauguugccuaggccaguc

SEQ ID NO: 10618 - RNA, 20 nt, Artificial Sequence
  targeting sequence with CTCN PAM
accccaucccagcugcuugc

SEQ ID NO: 10619 - RNA, 20 nt, Artificial Sequence
  targeting sequence with CTCN PAM
gcaagcagcugggauggggu

SEQ ID NO: 10620 - RNA, 20 nt, Artificial Sequence
  targeting sequence with CTCN PAM
aggcaaagccaccaggaccu

SEQ ID NO: 10621 - RNA, 20 nt, Artificial Sequence
  targeting sequence with CTCN PAM
acuccaggcaaagccaccag

SEQ ID NO: 10622 - RNA, 20 nt, Artificial Sequence
  targeting sequence with CTCN PAM
gaugggggcaggguguccuc

SEQ ID NO: 10623 - RNA, 20 nt, Artificial Sequence
  targeting sequence with CTCN PAM
ugggcgagcaguuuccuaag

SEQ ID NO: 10624 - RNA, 20 nt, Artificial Sequence
  targeting sequence with CTCN PAM
cccacgaggacacccugccc

SEQ ID NO: 10625 - RNA, 20 nt, Artificial Sequence
  targeting sequence with CTCN PAM
uucaguguacuuuucagguc

SEQ ID NO: 10626 - RNA, 20 nt, Artificial Sequence
  targeting sequence with CTCN PAM
auuccuucccaccggccaag

SEQ ID NO: 10627 - RNA, 20 nt, Artificial Sequence
  targeting sequence with CTCN PAM
ccacuugcugugcuguggcc

SEQ ID NO: 10628 - RNA, 20 nt, Artificial Sequence
  targeting sequence with CTCN PAM
gccugccacuccccacuugc

SEQ ID NO: 10629 - RNA, 20 nt, Artificial Sequence
  targeting sequence with CTCN PAM
gagcugggcugcggggaaga

SEQ ID NO: 10630 - RNA, 20 nt, Artificial Sequence
  targeting sequence with CTCN PAM
gagcaucaccagugacuccg

SEQ ID NO: 10631 - RNA, 20 nt, Artificial Sequence
  targeting sequence with CTCN PAM
cugcaaccuccgccuccugg

SEQ ID NO: 10632 - RNA, 20 nt, Artificial Sequence
  targeting sequence with CTCN PAM
gccuccuggguucaagagau

SEQ ID NO: 10633 - RNA, 20 nt, Artificial Sequence
  targeting sequence with CTCN PAM
uggguucaagagaucuuuuc

SEQ ID NO: 10634 - RNA, 20 nt, Artificial Sequence
  targeting sequence with CTCN PAM
ugaacccaggaggcggaggu

SEQ ID NO: 10635 - RNA, 20 nt, Artificial Sequence
  targeting sequence with CTCN PAM
gccuccugaguagcugggac

SEQ ID NO: 10636 - RNA, 20 nt, Artificial Sequence
  targeting sequence with CTCN PAM
cagcugcagcagggagacgu

SEQ ID NO: 10637 - RNA, 20 nt, Artificial Sequence
  targeting sequence with CTCN PAM
agaucacuguguuuuggaca

SEQ ID NO: 10638 - RNA, 20 nt, Artificial Sequence
  targeting sequence with CTCN PAM
uuccaguaacagcaauagaa

SEQ ID NO: 10639 - RNA, 20 nt, Artificial Sequence
  targeting sequence with CTCN PAM
uuuauaaaucccugauuuug

SEQ ID NO: 10640 - RNA, 20 nt, Artificial Sequence
  targeting sequence with CTCN PAM
cuuuuauaaaucccugauuu

SEQ ID NO: 10641 - RNA, 20 nt, Artificial Sequence
  targeting sequence with CTCN PAM
ggcccagucccacccugugg

SEQ ID NO: 10642 - RNA, 20 nt, Artificial Sequence
  targeting sequence with CTCN PAM
agggcccaguuacaaaguuu

SEQ ID NO: 10643 - RNA, 20 nt, Artificial Sequence
  targeting sequence with CTCN PAM
uuuugagguuccuaucaguu

SEQ ID NO: 10644 - RNA, 20 nt, Artificial Sequence
  targeting sequence with CTCN PAM
aaaggagugcuugaaaccca

SEQ ID NO: 10645 - RNA, 20 nt, Artificial Sequence
  targeting sequence with CTCN PAM
guguuuacuuagccacagac

SEQ ID NO: 10646 - RNA, 20 nt, Artificial Sequence
  targeting sequence with CTCN PAM
aagccacucucccuuuuugu

SEQ ID NO: 10647 - RNA, 20 nt, Artificial Sequence
  targeting sequence with CTCN PAM
cccuuuuugucuaagccaug

SEQ ID NO: 10648 - RNA, 20 nt, Artificial Sequence
  targeting sequence with CTCN PAM
cuuuuugucuaagccauggu

SEQ ID NO: 10649 - RNA, 20 nt, Artificial Sequence
  targeting sequence with CTCN PAM
cccuuccaccauggcuuaga

SEQ ID NO: 10650 - RNA, 20 nt, Artificial Sequence
  targeting sequence with CTCN PAM
uucuacaacccucccccuuc

SEQ ID NO: 10651 - RNA, 20 nt, Artificial Sequence
  targeting sequence with CTCN PAM
ccaugccuuaguagcaaagg

SEQ ID NO: 10652 - RNA, 20 nt, Artificial Sequence
  targeting sequence with CTCN PAM
agacccagguguuucccuuu

SEQ ID NO: 10653 - RNA, 20 nt, Artificial Sequence
  targeting sequence with CTCN PAM
gauucccugcuuccccccag

SEQ ID NO: 10654 - RNA, 20 nt, Artificial Sequence
  targeting sequence with CTCN PAM
agacuguacuauccugccuc

SEQ ID NO: 10655 - RNA, 20 nt, Artificial Sequence
  targeting sequence with CTCN PAM
uugcuacagagucuguuuug

SEQ ID NO: 10656 - RNA, 20 nt, Artificial Sequence
  targeting sequence with CTCN PAM
guagcaaugaggcaggauag

SEQ ID NO: 10657 - RNA, 20 nt, Artificial Sequence
  targeting sequence with CTCN PAM
agacugacaaaacagacucu

SEQ ID NO: 10658 - RNA, 20 nt, Artificial Sequence
  targeting sequence with CTCN PAM
aaagggaggaggguaaaaug

SEQ ID NO: 10659 - RNA, 20 nt, Artificial Sequence
  targeting sequence with CTCN PAM
cuuuagaguuuagacacaau

SEQ ID NO: 10660 - RNA, 20 nt, Artificial Sequence
  targeting sequence with CTCN PAM
ucccuuuagaguuuagacac

SEQ ID NO: 10661 - RNA, 20 nt, Artificial Sequence
  targeting sequence with CTCN PAM
uuuuacccuccucccuuuag

SEQ ID NO: 10662 - RNA, 20 nt, Artificial Sequence
  targeting sequence with CTCN PAM
aaggggagggguucauucaa

SEQ ID NO: 10663 - RNA, 20 nt, Artificial Sequence
  targeting sequence with CTCN PAM
ccuuggagaaggggaauucc

SEQ ID NO: 10664 - RNA, 20 nt, Artificial Sequence
  targeting sequence with CTCN PAM
auugaaugaaccccuccccu

SEQ ID NO: 10665 - RNA, 20 nt, Artificial Sequence
  targeting sequence with CTCN PAM
gugccuccauugaaugaacc

SEQ ID NO: 10666 - RNA, 20 nt, Artificial Sequence
  targeting sequence with CTCN PAM
aagcccucugugccuccauu

SEQ ID NO: 10667 - RNA, 20 nt, Artificial Sequence
  targeting sequence with CTCN PAM
uuaagcuuguguaaaccaaa

SEQ ID NO: 10668 - RNA, 20 nt, Artificial Sequence
  targeting sequence with CTCN PAM
guuuggggucuuuaucuuug

SEQ ID NO: 10669 - RNA, 20 nt, Artificial Sequence
  targeting sequence with CTCN PAM
gugcuaaugguucccaaaug

SEQ ID NO: 10670 - RNA, 20 nt, Artificial Sequence
  targeting sequence with CTCN PAM
uuccugcccaggaagccagg

SEQ ID NO: 10671 - RNA, 20 nt, Artificial Sequence
  targeting sequence with CTCN PAM
uggcuuccugggcaggaaag

SEQ ID NO: 10672 - RNA, 20 nt, Artificial Sequence
  targeting sequence with CTCN PAM
ccuggcuuccugggcaggaa

SEQ ID NO: 10673 - RNA, 20 nt, Artificial Sequence
  targeting sequence with CTCN PAM
gacucguucuuguucccgca

SEQ ID NO: 10674 - RNA, 20 nt, Artificial Sequence
  targeting sequence with CTCN PAM
uucuuguucccgcaugacgc

SEQ ID NO: 10675 - RNA, 20 nt, Artificial Sequence
  targeting sequence with CTCN PAM
ugcgucaugcgggaacaaga

SEQ ID NO: 10676 - RNA, 20 nt, Artificial Sequence
  targeting sequence with CTCN PAM
agacccuauucuccugcguc

SEQ ID NO: 10677 - RNA, 20 nt, Artificial Sequence
  targeting sequence with CTCN PAM
cuccagacccuauucuccug

SEQ ID NO: 10678 - RNA, 20 nt, Artificial Sequence
  targeting sequence with CTCN PAM
ccucuucacacccaaguaac

SEQ ID NO: 10679 - RNA, 20 nt, Artificial Sequence
  targeting sequence with CTCN PAM
ucacacccaaguaacaaaag

SEQ ID NO: 10680 - RNA, 20 nt, Artificial Sequence
  targeting sequence with CTCN PAM
gauccuuuuguuacuugggu

SEQ ID NO: 10681 - RNA, 20 nt, Artificial Sequence
  targeting sequence with CTCN PAM
cuuugcacuacauagcagau

SEQ ID NO: 10682 - RNA, 20 nt, Artificial Sequence
  targeting sequence with CTCN PAM
gauugguccccuccugcaac

SEQ ID NO: 10683 - RNA, 20 nt, Artificial Sequence
  targeting sequence with CTCN PAM
ugcaaccaaucacaaugguu

SEQ ID NO: 10684 - RNA, 20 nt, Artificial Sequence
  targeting sequence with CTCN PAM
ggaagguacucaaacccuag

SEQ ID NO: 10685 - RNA, 20 nt, Artificial Sequence
  targeting sequence with CTCN PAM
aacccuagaagauuuugcaa

SEQ ID NO: 10686 - RNA, 20 nt, Artificial Sequence
  targeting sequence with CTCN PAM
ugagccacuuccucaagccu

SEQ ID NO: 10687 - RNA, 20 nt, Artificial Sequence
  targeting sequence with CTCN PAM
agagcaccaguugcaaaauc

SEQ ID NO: 10688 - RNA, 20 nt, Artificial Sequence
  targeting sequence with CTCN PAM
agccugcugucacucugugg

SEQ ID NO: 10689 - RNA, 20 nt, Artificial Sequence
  targeting sequence with CTCN PAM
guggaguguacuuugguuuc

SEQ ID NO: 10690 - RNA, 20 nt, Artificial Sequence
  targeting sequence with CTCN PAM
acagagugacagcaggcuug

SEQ ID NO: 10691 - RNA, 20 nt, Artificial Sequence
  targeting sequence with CTCN PAM
ccaggcauggguaaucgucc

SEQ ID NO: 10692 - RNA, 20 nt, Artificial Sequence
  targeting sequence with CTCN PAM
agaugcgugggacgauuacc

SEQ ID NO: 10693 - RNA, 20 nt, Artificial Sequence
  targeting sequence with CTCN PAM
guaugcaucugguucuuucc

SEQ ID NO: 10694 - RNA, 20 nt, Artificial Sequence
  targeting sequence with CTCN PAM
cauguaccaguaccuggaua

SEQ ID NO: 10695 - RNA, 20 nt, Artificial Sequence
  targeting sequence with CTCN PAM
ugcuggcuagaugcuuaccu

SEQ ID NO: 10696 - RNA, 20 nt, Artificial Sequence
  targeting sequence with CTCN PAM
agcuccugcuggcuagaugc

SEQ ID NO: 10697 - RNA, 20 nt, Artificial Sequence
  targeting sequence with CTCN PAM
gugccaccugcguccccauc

SEQ ID NO: 10698 - RNA, 20 nt, Artificial Sequence
  targeting sequence with CTCN PAM
ccgugccaccugcgucccca

SEQ ID NO: 10699 - RNA, 20 nt, Artificial Sequence
  targeting sequence with CTCN PAM
ggaguuaggcugaccugggc

SEQ ID NO: 10700 - RNA, 20 nt, Artificial Sequence
  targeting sequence with CTCN PAM
agagacugcugcagucuaug

SEQ ID NO: 10701 - RNA, 20 nt, Artificial Sequence
  targeting sequence with CTCN PAM
cugugggccuggguagguga

SEQ ID NO: 10702 - RNA, 20 nt, Artificial Sequence
  targeting sequence with CTCN PAM
auagacguagggugaugaca

SEQ ID NO: 10703 - RNA, 20 nt, Artificial Sequence
  targeting sequence with CTCN PAM
caaagcugugaggaucaaau

SEQ ID NO: 10704 - RNA, 20 nt, Artificial Sequence
  targeting sequence with CTCN PAM
cagcuuugugaggauggggc

SEQ ID NO: 10705 - RNA, 20 nt, Artificial Sequence
  targeting sequence with CTCN PAM
cauuugauccucacagcuuu

SEQ ID NO: 10706 - RNA, 20 nt, Artificial Sequence
  targeting sequence with CTCN PAM
ugggucaggcuuuacaggca

SEQ ID NO: 10707 - RNA, 20 nt, Artificial Sequence
  targeting sequence with CTCN PAM
uauuagcuguucucuauggg

SEQ ID NO: 10708 - RNA, 20 nt, Artificial Sequence
  targeting sequence with CTCN PAM
augggaagcaccugacuagu

SEQ ID NO: 10709 - RNA, 20 nt, Artificial Sequence
  targeting sequence with CTCN PAM
guaaauggcggcuuuuauua

SEQ ID NO: 10710 - RNA, 20 nt, Artificial Sequence
  targeting sequence with CTCN PAM
caccuuaguuggcagaugcu

SEQ ID NO: 10711 - RNA, 20 nt, Artificial Sequence
  targeting sequence with CTCN PAM
cccaccuuaguuggcagaug

SEQ ID NO: 10712 - RNA, 20 nt, Artificial Sequence
  targeting sequence with CTCN PAM
gauucugacagcaauguggg

SEQ ID NO: 10713 - RNA, 20 nt, Artificial Sequence
  targeting sequence with CTCN PAM
agcuuucauagacuaggcca

SEQ ID NO: 10714 - RNA, 20 nt, Artificial Sequence
  targeting sequence with CTCN PAM
cuagcuuucauagacuaggc

SEQ ID NO: 10715 - RNA, 20 nt, Artificial Sequence
  targeting sequence with CTCN PAM
cugcacauaaggaaaggccc

SEQ ID NO: 10716 - RNA, 20 nt, Artificial Sequence
  targeting sequence with CTCN PAM
gcacauaaggaaaggcccag

SEQ ID NO: 10717 - RNA, 20 nt, Artificial Sequence
  targeting sequence with CTCN PAM
ggaacauaccugggccuuuc

SEQ ID NO: 10718 - RNA, 20 nt, Artificial Sequence
  targeting sequence with CTCN PAM
gauggaggaaggaauggcuu

SEQ ID NO: 10719 - RNA, 20 nt, Artificial Sequence
  targeting sequence with CTCN PAM
aucugagguucuagauggaa

SEQ ID NO: 10720 - RNA, 20 nt, Artificial Sequence
  targeting sequence with CTCN PAM
acuccccuaccccuucccuc

SEQ ID NO: 10721 - RNA, 20 nt, Artificial Sequence
  targeting sequence with CTCN PAM
ccuaccccuucccucuuuau

SEQ ID NO: 10722 - RNA, 20 nt, Artificial Sequence
  targeting sequence with CTCN PAM
uuaucuccccacagucaauu

SEQ ID NO: 10723 - RNA, 20 nt, Artificial Sequence
  targeting sequence with CTCN PAM
ccacagucaauuaaggagcu

SEQ ID NO: 10724 - RNA, 20 nt, Artificial Sequence
  targeting sequence with CTCN PAM
uuaauugacuguggggagau

SEQ ID NO: 10725 - RNA, 20 nt, Artificial Sequence
  targeting sequence with CTCN PAM
uuuuguccauauuccugggc

SEQ ID NO: 10726 - RNA, 20 nt, Artificial Sequence
  targeting sequence with CTCN PAM
uucaaugucagcccaggaau

SEQ ID NO: 10727 - RNA, 20 nt, Artificial Sequence
  targeting sequence with CTCN PAM
uugccacuccuucaauguca

SEQ ID NO: 10728 - RNA, 20 nt, Artificial Sequence
  targeting sequence with CTCN PAM
ucaugccuacaagucuugau

SEQ ID NO: 10729 - RNA, 20 nt, Artificial Sequence
  targeting sequence with CTCN PAM
cuucaugccuacaagucuug

SEQ ID NO: 10730 - RNA, 20 nt, Artificial Sequence
  targeting sequence with CTCN PAM
ucucuucaugccuacaaguc

SEQ ID NO: 10731 - RNA, 20 nt, Artificial Sequence
  targeting sequence with CTCN PAM
gaagccggcugagagccagc

SEQ ID NO: 10732 - RNA, 20 nt, Artificial Sequence
  targeting sequence with CTCN PAM
gccggcuucugaguccuggu

SEQ ID NO: 10733 - RNA, 20 nt, Artificial Sequence
  targeting sequence with CTCN PAM
cagccggcuucugaguccug

SEQ ID NO: 10734 - RNA, 20 nt, Artificial Sequence
  targeting sequence with CTCN PAM
gggaccucaggccagcggcu

SEQ ID NO: 10735 - RNA, 20 nt, Artificial Sequence
  targeting sequence with CTCN PAM
ggccagcggcuucccucaga

SEQ ID NO: 10736 - RNA, 20 nt, Artificial Sequence
  targeting sequence with CTCN PAM
gagccccgguccucccaguu

SEQ ID NO: 10737 - RNA, 20 nt, Artificial Sequence
  targeting sequence with CTCN PAM
gagggaagccgcuggccuga

SEQ ID NO: 10738 - RNA, 20 nt, Artificial Sequence
  targeting sequence with CTCN PAM
caguucugaaauggggguag

SEQ ID NO: 10739 - RNA, 20 nt, Artificial Sequence
  targeting sequence with CTCN PAM
cuacccccauuucagaacug

SEQ ID NO: 10740 - RNA, 20 nt, Artificial Sequence
  targeting sequence with CTCN PAM
guuaagccuugugacugcag

SEQ ID NO: 10741 - RNA, 20 nt, Artificial Sequence
  targeting sequence with CTCN PAM
acuuuccuacacuggggaca

SEQ ID NO: 10742 - RNA, 20 nt, Artificial Sequence
  targeting sequence with CTCN PAM
aucuccacuuuccuacacug

SEQ ID NO: 10743 - RNA, 20 nt, Artificial Sequence
  targeting sequence with CTCN PAM
gaaucuuacagcuuccucca

SEQ ID NO: 10744 - RNA, 20 nt, Artificial Sequence
  targeting sequence with CTCN PAM
ucugaaucuuacagcuuccu

SEQ ID NO: 10745 - RNA, 20 nt, Artificial Sequence
  targeting sequence with CTCN PAM
cuccucugaaucuuacagcu

SEQ ID NO: 10746 - RNA, 20 nt, Artificial Sequence
  targeting sequence with CTCN PAM
ucccuccucugaaucuuaca

SEQ ID NO: 10747 - RNA, 20 nt, Artificial Sequence
  targeting sequence with CTCN PAM
auggggaugccuccucccuc

SEQ ID NO: 10748 - RNA, 20 nt, Artificial Sequence
  targeting sequence with CTCN PAM
cuccauggggaugccuccuc

SEQ ID NO: 10749 - RNA, 20 nt, Artificial Sequence
  targeting sequence with CTCN PAM
ccugccccacccagaaaugc

SEQ ID NO: 10750 - RNA, 20 nt, Artificial Sequence
  targeting sequence with CTCN PAM
ugccccacccagaaaugcca

SEQ ID NO: 10751 - RNA, 20 nt, Artificial Sequence
  targeting sequence with CTCN PAM
cugcuggcauuucugggugg

SEQ ID NO: 10752 - RNA, 20 nt, Artificial Sequence
  targeting sequence with CTCN PAM
agauugucaccuccuuacac

SEQ ID NO: 10753 - RNA, 20 nt, Artificial Sequence
  targeting sequence with CTCN PAM
uuacacccaggaaccaaaca

SEQ ID NO: 10754 - RNA, 20 nt, Artificial Sequence
  targeting sequence with CTCN PAM
ucuuaauaacacugcacacu

SEQ ID NO: 10755 - RNA, 20 nt, Artificial Sequence
  targeting sequence with CTCN PAM
acaaauauuugaauggauaa

SEQ ID NO: 10756 - RNA, 20 nt, Artificial Sequence
  targeting sequence with CTCN PAM
ccagccuguaucaccaaaac

SEQ ID NO: 10757 - RNA, 20 nt, Artificial Sequence
  targeting sequence with CTCN PAM
cugagaauugaaagggugua

SEQ ID NO: 10758 - RNA, 20 nt, Artificial Sequence
  targeting sequence with CTCN PAM
gggaguguuuuggugauaca

SEQ ID NO: 10759 - RNA, 20 nt, Artificial Sequence
  targeting sequence with CTCN PAM
ugccuguaaucccaguucuu

SEQ ID NO: 10760 - RNA, 20 nt, Artificial Sequence
  targeting sequence with CTCN PAM
caaagaacugggauuacagg

SEQ ID NO: 10761 - RNA, 20 nt, Artificial Sequence
  targeting sequence with CTCN PAM
gccucccaaagaacugggau

SEQ ID NO: 10762 - RNA, 20 nt, Artificial Sequence
  targeting sequence with CTCN PAM
acugaucugccugucucggc

SEQ ID NO: 10763 - RNA, 20 nt, Artificial Sequence
  targeting sequence with CTCN PAM
uggccucaacugaucugccu

SEQ ID NO: 10764 - RNA, 20 nt, Artificial Sequence
  targeting sequence with CTCN PAM
acuaaaaaaauacaaaacuu

SEQ ID NO: 10765 - RNA, 20 nt, Artificial Sequence
  targeting sequence with CTCN PAM
caaguagcugggacuacagg

SEQ ID NO: 10766 - RNA, 20 nt, Artificial Sequence
  targeting sequence with CTCN PAM
cugguucaagcaauucugcc

SEQ ID NO: 10767 - RNA, 20 nt, Artificial Sequence
  targeting sequence with CTCN PAM
gucucccugguucaagcaau

SEQ ID NO: 10768 - RNA, 20 nt, Artificial Sequence
  targeting sequence with CTCN PAM
cuguagccucugucucccug

SEQ ID NO: 10769 - RNA, 20 nt, Artificial Sequence
  targeting sequence with CTCN PAM
gcucacuguagccucugucu

SEQ ID NO: 10770 - RNA, 20 nt, Artificial Sequence
  targeting sequence with CTCN PAM
gucaaaaacacaaaaaaauc

SEQ ID NO: 10771 - RNA, 20 nt, Artificial Sequence
  targeting sequence with CTCN PAM
uacccuauugucaaaaucau

SEQ ID NO: 10772 - RNA, 20 nt, Artificial Sequence
  targeting sequence with CTCN PAM
gugacaggcacucaggcuca

SEQ ID NO: 10773 - RNA, 20 nt, Artificial Sequence
  targeting sequence with CTCN PAM
ggcucaccaguuugcacagg

SEQ ID NO: 10774 - RNA, 20 nt, Artificial Sequence
  targeting sequence with CTCN PAM
ccaguuugcacagggugguc

SEQ ID NO: 10775 - RNA, 20 nt, Artificial Sequence
  targeting sequence with CTCN PAM
gccaucuaguggggauggca

SEQ ID NO: 10776 - RNA, 20 nt, Artificial Sequence
  targeting sequence with CTCN PAM
ucucugccaucuagugggga

SEQ ID NO: 10777 - RNA, 20 nt, Artificial Sequence
  targeting sequence with CTCN PAM
gcagcucuucucugccaucu

SEQ ID NO: 10778 - RNA, 20 nt, Artificial Sequence
  targeting sequence with CTCN PAM
ggccaggccaugaguagagc

SEQ ID NO: 10779 - RNA, 20 nt, Artificial Sequence
  targeting sequence with CTCN PAM
uggccuggccagagcucagc

SEQ ID NO: 10780 - RNA, 20 nt, Artificial Sequence
  targeting sequence with CTCN PAM
acucauggccuggccagagc

SEQ ID NO: 10781 - RNA, 20 nt, Artificial Sequence
  targeting sequence with CTCN PAM
cuguucccaggcuucccucu

SEQ ID NO: 10782 - RNA, 20 nt, Artificial Sequence
  targeting sequence with CTCN PAM
acugagcucauucaggggcc

SEQ ID NO: 10783 - RNA, 20 nt, Artificial Sequence
  targeting sequence with CTCN PAM
guagagggaagccugggaac

SEQ ID NO: 10784 - RNA, 20 nt, Artificial Sequence
  targeting sequence with CTCN PAM
uucaggggccuucugaccac

SEQ ID NO: 10785 - RNA, 20 nt, Artificial Sequence
  targeting sequence with CTCN PAM
gaacagcugccgugaugcug

SEQ ID NO: 10786 - RNA, 20 nt, Artificial Sequence
  targeting sequence with CTCN PAM
gugggcaaauccuagacucc

SEQ ID NO: 10787 - RNA, 20 nt, Artificial Sequence
  targeting sequence with CTCN PAM
agcacagccgaccuagagcu

SEQ ID NO: 10788 - RNA, 20 nt, Artificial Sequence
  targeting sequence with CTCN PAM
aggucggcugugcuggaguc

SEQ ID NO: 10789 - RNA, 20 nt, Artificial Sequence
  targeting sequence with CTCN PAM
agggucuuuccagcucuagg

SEQ ID NO: 10790 - RNA, 20 nt, Artificial Sequence
  targeting sequence with CTCN PAM
caagggucuuuccagcucua

SEQ ID NO: 10791 - RNA, 20 nt, Artificial Sequence
  targeting sequence with CTCN PAM
agccaucuuuguggaaaggg

SEQ ID NO: 10792 - RNA, 20 nt, Artificial Sequence
  targeting sequence with CTCN PAM
gcuucugggcuccagccauc

SEQ ID NO: 10793 - RNA, 20 nt, Artificial Sequence
  targeting sequence with CTCN PAM
gagcgaggacugagaccucg

SEQ ID NO: 10794 - RNA, 20 nt, Artificial Sequence
  targeting sequence with CTCN PAM
gagccuacuucucugcuucu

SEQ ID NO: 10795 - RNA, 20 nt, Artificial Sequence
  targeting sequence with CTCN PAM
cucugagccuacuucucugc

SEQ ID NO: 10796 - RNA, 20 nt, Artificial Sequence
  targeting sequence with CTCN PAM
guccucgcucugagccuacu

SEQ ID NO: 10797 - RNA, 20 nt, Artificial Sequence
  targeting sequence with CTCN PAM
aaugcuccuuucccucucgg

SEQ ID NO: 10798 - RNA, 20 nt, Artificial Sequence
  targeting sequence with CTCN PAM
uuucccucucggccacugug

SEQ ID NO: 10799 - RNA, 20 nt, Artificial Sequence
  targeting sequence with CTCN PAM
cggccacugugccgugcuuu

SEQ ID NO: 10800 - RNA, 20 nt, Artificial Sequence
  targeting sequence with CTCN PAM
gccacugugccgugcuuugc

SEQ ID NO: 10801 - RNA, 20 nt, Artificial Sequence
  targeting sequence with CTCN PAM
caagguguuuuaaggaaacc

SEQ ID NO: 10802 - RNA, 20 nt, Artificial Sequence
  targeting sequence with CTCN PAM
agguguuuuaaggaaaccca

SEQ ID NO: 10803 - RNA, 20 nt, Artificial Sequence
  targeting sequence with CTCN PAM
agaucuggguuuccuuaaaa

SEQ ID NO: 10804 - RNA, 20 nt, Artificial Sequence
  targeting sequence with CTCN PAM
guuccuuagcccaugugaug

SEQ ID NO: 10805 - RNA, 20 nt, Artificial Sequence
  targeting sequence with CTCN PAM
gaugccucccuuaacgcugc

SEQ ID NO: 10806 - RNA, 20 nt, Artificial Sequence
  targeting sequence with CTCN PAM
cuuaacgcugccucccaccc

SEQ ID NO: 10807 - RNA, 20 nt, Artificial Sequence
  targeting sequence with CTCN PAM
caccccugcucaugcucaga

SEQ ID NO: 10808 - RNA, 20 nt, Artificial Sequence
  targeting sequence with CTCN PAM
ugcucagaccauucauccgu

SEQ ID NO: 10809 - RNA, 20 nt, Artificial Sequence
  targeting sequence with CTCN PAM
gaccauucauccguguucuc

SEQ ID NO: 10810 - RNA, 20 nt, Artificial Sequence
  targeting sequence with CTCN PAM
aggcaucugguucauagucg

SEQ ID NO: 10811 - RNA, 20 nt, Artificial Sequence
  targeting sequence with CTCN PAM
gacuaugaaccagaugccug

SEQ ID NO: 10812 - RNA, 20 nt, Artificial Sequence
  targeting sequence with CTCN PAM
ccgacuaugaaccagaugcc

SEQ ID NO: 10813 - RNA, 20 nt, Artificial Sequence
  targeting sequence with CTCN PAM
uagcucuaggaggugucauu

SEQ ID NO: 10814 - RNA, 20 nt, Artificial Sequence
  targeting sequence with CTCN PAM
aggaggugucauuaucuguu

SEQ ID NO: 10815 - RNA, 20 nt, Artificial Sequence
  targeting sequence with CTCN PAM
uagagcuaagagcucuccga

SEQ ID NO: 10816 - RNA, 20 nt, Artificial Sequence
  targeting sequence with CTCN PAM
ccuguuagaauguggccucu

SEQ ID NO: 10817 - RNA, 20 nt, Artificial Sequence
  targeting sequence with CTCN PAM
gaauuguggagggggacagg

SEQ ID NO: 10818 - RNA, 20 nt, Artificial Sequence
  targeting sequence with CTCN PAM
acaauucagaggccacauuc

SEQ ID NO: 10819 - RNA, 20 nt, Artificial Sequence
  targeting sequence with CTCN PAM
gccccugucccccuccacaa

SEQ ID NO: 10820 - RNA, 20 nt, Artificial Sequence
  targeting sequence with CTCN PAM
gucucugacaggaagccugg

SEQ ID NO: 10821 - RNA, 20 nt, Artificial Sequence
  targeting sequence with CTCN PAM
gacaggaagccugguccugu

SEQ ID NO: 10822 - RNA, 20 nt, Artificial Sequence
  targeting sequence with CTCN PAM
ggcugccuugcaggugacca

SEQ ID NO: 10823 - RNA, 20 nt, Artificial Sequence
  targeting sequence with CTCN PAM
cucauccccugaggucuuuu

SEQ ID NO: 10824 - RNA, 20 nt, Artificial Sequence
  targeting sequence with CTCN PAM
uccccugaggucuuuucagg

SEQ ID NO: 10825 - RNA, 20 nt, Artificial Sequence
  targeting sequence with CTCN PAM
ggggaugagcgaguccccag

SEQ ID NO: 10826 - RNA, 20 nt, Artificial Sequence
  targeting sequence with CTCN PAM
ugaaaagaccucaggggaug

SEQ ID NO: 10827 - RNA, 20 nt, Artificial Sequence
  targeting sequence with CTCN PAM
cuccugaaaagaccucaggg

SEQ ID NO: 10828 - RNA, 20 nt, Artificial Sequence
  targeting sequence with CTCN PAM
gcagcauggcauccucccuc

SEQ ID NO: 10829 - RNA, 20 nt, Artificial Sequence
  targeting sequence with CTCN PAM
gcucagcagcauggcauccu

SEQ ID NO: 10830 - RNA, 20 nt, Artificial Sequence
  targeting sequence with CTCN PAM
gcguguucgguucaaagggc

SEQ ID NO: 10831 - RNA, 20 nt, Artificial Sequence
  targeting sequence with CTCN PAM
ggagcugcugccuccucuag

SEQ ID NO: 10832 - RNA, 20 nt, Artificial Sequence
  targeting sequence with CTCN PAM
agagcccuuugaaccgaaca

SEQ ID NO: 10833 - RNA, 20 nt, Artificial Sequence
  targeting sequence with CTCN PAM
ucuaggcacaggucagccca

SEQ ID NO: 10834 - RNA, 20 nt, Artificial Sequence
  targeting sequence with CTCN PAM
aggcacaggucagcccauuu

SEQ ID NO: 10835 - RNA, 20 nt, Artificial Sequence
  targeting sequence with CTCN PAM
uccaaacccugggcagaauc

SEQ ID NO: 10836 - RNA, 20 nt, Artificial Sequence
  targeting sequence with CTCN PAM
aaacccugggcagaaucuga

SEQ ID NO: 10837 - RNA, 20 nt, Artificial Sequence
  targeting sequence with CTCN PAM
gaaacuucuagagguccaug

SEQ ID NO: 10838 - RNA, 20 nt, Artificial Sequence
  targeting sequence with CTCN PAM
agaaguuucugaggaacaag

SEQ ID NO: 10839 - RNA, 20 nt, Artificial Sequence
  targeting sequence with CTCN PAM
uggaccucuagaaguuucug

SEQ ID NO: 10840 - RNA, 20 nt, Artificial Sequence
  targeting sequence with CTCN PAM
ggcuuuacugugaguucaag

SEQ ID NO: 10841 - RNA, 20 nt, Artificial Sequence
  targeting sequence with CTCN PAM
caguaaagccagagacuuua

SEQ ID NO: 10842 - RNA, 20 nt, Artificial Sequence
  targeting sequence with CTCN PAM
uauauaaauccuaaaauugc

SEQ ID NO: 10843 - RNA, 20 nt, Artificial Sequence
  targeting sequence with CTCN PAM
accuucuccaagaaucugug

SEQ ID NO: 10844 - RNA, 20 nt, Artificial Sequence
  targeting sequence with CTCN PAM
aagaaucuguguuuaugccc

SEQ ID NO: 10845 - RNA, 20 nt, Artificial Sequence
  targeting sequence with CTCN PAM
cagcuuuccccuccuccacg

SEQ ID NO: 10846 - RNA, 20 nt, Artificial Sequence
  targeting sequence with CTCN PAM
gcuuuccccuccuccacgcc

SEQ ID NO: 10847 - RNA, 20 nt, Artificial Sequence
  targeting sequence with CTCN PAM
uccacgcccucugcaguacc

SEQ ID NO: 10848 - RNA, 20 nt, Artificial Sequence
  targeting sequence with CTCN PAM
acgcccucugcaguaccagg

SEQ ID NO: 10849 - RNA, 20 nt, Artificial Sequence
  targeting sequence with CTCN PAM
gcaguaccaggugcucuggg

SEQ ID NO: 10850 - RNA, 20 nt, Artificial Sequence
  targeting sequence with CTCN PAM
ggguccccugugucuguggc

SEQ ID NO: 10851 - RNA, 20 nt, Artificial Sequence
  targeting sequence with CTCN PAM
caucaguccaugcaucucuc

SEQ ID NO: 10852 - RNA, 20 nt, Artificial Sequence
  targeting sequence with CTCN PAM
ucaguccaugcaucucucuc

SEQ ID NO: 10853 - RNA, 20 nt, Artificial Sequence
  targeting sequence with CTCN PAM
cucucucuugcugugaugcu

SEQ ID NO: 10854 - RNA, 20 nt, Artificial Sequence
  targeting sequence with CTCN PAM
cucucuugcugugaugcugc

SEQ ID NO: 10855 - RNA, 20 nt, Artificial Sequence
  targeting sequence with CTCN PAM
cucuugcugugaugcugccu

SEQ ID NO: 10856 - RNA, 20 nt, Artificial Sequence
  targeting sequence with CTCN PAM
cuugcugugaugcugccugc

SEQ ID NO: 10857 - RNA, 20 nt, Artificial Sequence
  targeting sequence with CTCN PAM
ugcugugaugcugccugccc

SEQ ID NO: 10858 - RNA, 20 nt, Artificial Sequence
  targeting sequence with CTCN PAM
gcggggggcggggggggcgg

SEQ ID NO: 10859 - RNA, 20 nt, Artificial Sequence
  targeting sequence with CTCN PAM
agagucucccaaggaggcac

SEQ ID NO: 10860 - RNA, 20 nt, Artificial Sequence
  targeting sequence with CTCN PAM
agccaaagaagaagccaguu

SEQ ID NO: 10861 - RNA, 20 nt, Artificial Sequence
  targeting sequence with CTCN PAM
cgagccaaagaagaagccag

SEQ ID NO: 10862 - RNA, 20 nt, Artificial Sequence
  targeting sequence with CTCN PAM
caaggaggcaccgccacaga

SEQ ID NO: 10863 - RNA, 20 nt, Artificial Sequence
  targeting sequence with CTCN PAM
uugggagacucucgagccaa

SEQ ID NO: 10864 - RNA, 20 nt, Artificial Sequence
  targeting sequence with CTCN PAM
cugggugguauaaccuccug

SEQ ID NO: 10865 - RNA, 20 nt, Artificial Sequence
  targeting sequence with CTCN PAM
ugcacgcacgaugauuaauu

SEQ ID NO: 10866 - RNA, 20 nt, Artificial Sequence
  targeting sequence with CTCN PAM
cuuccucuccucuguggcuc

SEQ ID NO: 10867 - RNA, 20 nt, Artificial Sequence
  targeting sequence with CTCN PAM
ccucuguggcucacugucua

SEQ ID NO: 10868 - RNA, 20 nt, Artificial Sequence
  targeting sequence with CTCN PAM
ucuguggcucacugucuagg

SEQ ID NO: 10869 - RNA, 20 nt, Artificial Sequence
  targeting sequence with CTCN PAM
guggcucacugucuagguga

SEQ ID NO: 10870 - RNA, 20 nt, Artificial Sequence
  targeting sequence with CTCN PAM
cugucuaggugagcuugacu

SEQ ID NO: 10871 - RNA, 20 nt, Artificial Sequence
  targeting sequence with CTCN PAM
ccuagacagugagccacaga

SEQ ID NO: 10872 - RNA, 20 nt, Artificial Sequence
  targeting sequence with CTCN PAM
gaugaaagccuguggggaau

SEQ ID NO: 10873 - RNA, 20 nt, Artificial Sequence
  targeting sequence with CTCN PAM
ucagcagcauugagguaaaa

SEQ ID NO: 10874 - RNA, 20 nt, Artificial Sequence
  targeting sequence with CTCN PAM
augcugcugaugaggucuug

SEQ ID NO: 10875 - RNA, 20 nt, Artificial Sequence
  targeting sequence with CTCN PAM
cguacaucuuuuccagcagc

SEQ ID NO: 10876 - RNA, 20 nt, Artificial Sequence
  targeting sequence with CTCN PAM
uucuuuuguaaauugcccag

SEQ ID NO: 10877 - RNA, 20 nt, Artificial Sequence
  targeting sequence with CTCN PAM
ugaucauggcagaaggcaag

SEQ ID NO: 10878 - RNA, 20 nt, Artificial Sequence
  targeting sequence with CTCN PAM
uccuugccuucugccaugau

SEQ ID NO: 10879 - RNA, 20 nt, Artificial Sequence
  targeting sequence with CTCN PAM
guuugccugcugccauccau

SEQ ID NO: 10880 - RNA, 20 nt, Artificial Sequence
  targeting sequence with CTCN PAM
cuguuugccugcugccaucc

SEQ ID NO: 10881 - RNA, 20 nt, Artificial Sequence
  targeting sequence with CTCN PAM
ucuuuuuaaaaccaucagau

SEQ ID NO: 10882 - RNA, 20 nt, Artificial Sequence
  targeting sequence with CTCN PAM
uuuuaaaaccaucagaucuc

SEQ ID NO: 10883 - RNA, 20 nt, Artificial Sequence
  targeting sequence with CTCN PAM
ugagacuuacuaucaugaga

SEQ ID NO: 10884 - RNA, 20 nt, Artificial Sequence
  targeting sequence with CTCN PAM
cgagaucugaugguuuuaaa

SEQ ID NO: 10885 - RNA, 20 nt, Artificial Sequence
  targeting sequence with CTCN PAM
ugauaguaagucucacgaga

SEQ ID NO: 10886 - RNA, 20 nt, Artificial Sequence
  targeting sequence with CTCN PAM
cacaacacaugggaauucaa

SEQ ID NO: 10887 - RNA, 20 nt, Artificial Sequence
  targeting sequence with CTCN PAM
ucuugaauucccauguguug

SEQ ID NO: 10888 - RNA, 20 nt, Artificial Sequence
  targeting sequence with CTCN PAM
gggcuuuugccugcugauau

SEQ ID NO: 10889 - RNA, 20 nt, Artificial Sequence
  targeting sequence with CTCN PAM
cguguccucagggcuuuugc

SEQ ID NO: 10890 - RNA, 20 nt, Artificial Sequence
  targeting sequence with CTCN PAM
gcucccguguccucagggcu

SEQ ID NO: 10891 - RNA, 20 nt, Artificial Sequence
  targeting sequence with CTCN PAM
cuggcgucugggcaucuggg

SEQ ID NO: 10892 - RNA, 20 nt, Artificial Sequence
  targeting sequence with CTCN PAM
aggggcagaguggccacaca

SEQ ID NO: 10893 - RNA, 20 nt, Artificial Sequence
  targeting sequence with CTCN PAM
gccccuggagcaaggcugug

SEQ ID NO: 10894 - RNA, 20 nt, Artificial Sequence
  targeting sequence with CTCN PAM
uacuguguggccacucugcc

SEQ ID NO: 10895 - RNA, 20 nt, Artificial Sequence
  targeting sequence with CTCN PAM
cacugcccacugcugucucc

SEQ ID NO: 10896 - RNA, 20 nt, Artificial Sequence
  targeting sequence with CTCN PAM
gucaguuaccacgugacagc

SEQ ID NO: 10897 - RNA, 20 nt, Artificial Sequence
  targeting sequence with CTCN PAM
ccaggguuggguuucuuguc

SEQ ID NO: 10898 - RNA, 20 nt, Artificial Sequence
  targeting sequence with CTCN PAM
aggguuggguuucuugucug

SEQ ID NO: 10899 - RNA, 20 nt, Artificial Sequence
  targeting sequence with CTCN PAM
cagcagccugugacguaggu

SEQ ID NO: 10900 - RNA, 20 nt, Artificial Sequence
  targeting sequence with CTCN PAM
ggaacugguuugcauccucc

SEQ ID NO: 10901 - RNA, 20 nt, Artificial Sequence
  targeting sequence with CTCN PAM
ugguggcggauagcugguca

SEQ ID NO: 10902 - RNA, 20 nt, Artificial Sequence
  targeting sequence with CTCN PAM
cagacuccaguaaucugaua

SEQ ID NO: 10903 - RNA, 20 nt, Artificial Sequence
  targeting sequence with CTCN PAM
gacuccaguaaucugauagc

SEQ ID NO: 10904 - RNA, 20 nt, Artificial Sequence
  targeting sequence with CTCN PAM
aguaaucugauagcgcugga

SEQ ID NO: 10905 - RNA, 20 nt, Artificial Sequence
  targeting sequence with CTCN PAM
agcgcuaucagauuacugga

SEQ ID NO: 10906 - RNA, 20 nt, Artificial Sequence
  targeting sequence with CTCN PAM
uccagcgcuaucagauuacu

SEQ ID NO: 10907 - RNA, 20 nt, Artificial Sequence
  targeting sequence with CTCN PAM
ugugcauuugggaaacuccu

SEQ ID NO: 10908 - RNA, 20 nt, Artificial Sequence
  targeting sequence with CTCN PAM
gcucaugugcauuugggaaa

SEQ ID NO: 10909 - RNA, 20 nt, Artificial Sequence
  targeting sequence with CTCN PAM
auuccccagaaauggaccug

SEQ ID NO: 10910 - RNA, 20 nt, Artificial Sequence
  targeting sequence with CTCN PAM
ccagguccauuucuggggaa

SEQ ID NO: 10911 - RNA, 20 nt, Artificial Sequence
  targeting sequence with CTCN PAM
guucagacugugggccuugc

SEQ ID NO: 10912 - RNA, 20 nt, Artificial Sequence
  targeting sequence with CTCN PAM
ggggcgcucaguucagacug

SEQ ID NO: 10913 - RNA, 20 nt, Artificial Sequence
  targeting sequence with CTCN PAM
agaacucuggggcgcucagu

SEQ ID NO: 10914 - RNA, 20 nt, Artificial Sequence
  targeting sequence with CTCN PAM
cagcccuacuguuccuggcu

SEQ ID NO: 10915 - RNA, 20 nt, Artificial Sequence
  targeting sequence with CTCN PAM
gccaggaacaguagggcugg

SEQ ID NO: 10916 - RNA, 20 nt, Artificial Sequence
  targeting sequence with CTCN PAM
uuucuucaccccacacccau

SEQ ID NO: 10917 - RNA, 20 nt, Artificial Sequence
  targeting sequence with CTCN PAM
uuuugacgaucuugggcuuc

SEQ ID NO: 10918 - RNA, 20 nt, Artificial Sequence
  targeting sequence with CTCN PAM
gaucccuugugaagcccaag

SEQ ID NO: 10919 - RNA, 20 nt, Artificial Sequence
  targeting sequence with CTCN PAM
ccuggggcuacuucuucccc

SEQ ID NO: 10920 - RNA, 20 nt, Artificial Sequence
  targeting sequence with CTCN PAM
uuccaggauucuuccucacc

SEQ ID NO: 10921 - RNA, 20 nt, Artificial Sequence
  targeting sequence with CTCN PAM
gcgacaguguucagucccug

SEQ ID NO: 10922 - RNA, 20 nt, Artificial Sequence
  targeting sequence with CTCN PAM
guagcuggugauuggaagac

SEQ ID NO: 10923 - RNA, 20 nt, Artificial Sequence
  targeting sequence with CTCN PAM
gccaggcuugcuuucccucc

SEQ ID NO: 10924 - RNA, 20 nt, Artificial Sequence
  targeting sequence with CTCN PAM
cuuuccgaagcuggcagaau

SEQ ID NO: 10925 - RNA, 20 nt, Artificial Sequence
  targeting sequence with CTCN PAM
agaugcgaucccaggagguc

SEQ ID NO: 10926 - RNA, 20 nt, Artificial Sequence
  targeting sequence with CTCN PAM
ugggaucgcaucuggagacu

SEQ ID NO: 10927 - RNA, 20 nt, Artificial Sequence
  targeting sequence with CTCN PAM
cccacucagagcccaaagaa

SEQ ID NO: 10928 - RNA, 20 nt, Artificial Sequence
  targeting sequence with CTCN PAM
gagcccaaagaaugccaaca

SEQ ID NO: 10929 - RNA, 20 nt, Artificial Sequence
  targeting sequence with CTCN PAM
gagugggugaggugacccuu

SEQ ID NO: 10930 - RNA, 20 nt, Artificial Sequence
  targeting sequence with CTCN PAM
gcuguuggcauucuuugggc

SEQ ID NO: 10931 - RNA, 20 nt, Artificial Sequence
  targeting sequence with CTCN PAM
caauuugcaaggggcagcaa

SEQ ID NO: 10932 - RNA, 20 nt, Artificial Sequence
  targeting sequence with CTCN PAM
auuugcaaggggcagcaaau

SEQ ID NO: 10933 - RNA, 20 nt, Artificial Sequence
  targeting sequence with CTCN PAM
aguucaaguagauggucaag

SEQ ID NO: 10934 - RNA, 20 nt, Artificial Sequence
  targeting sequence with CTCN PAM
guuuccucaccuguaaaaug

SEQ ID NO: 10935 - RNA, 20 nt, Artificial Sequence
  targeting sequence with CTCN PAM
ccuguaaaauggagacgaca

SEQ ID NO: 10936 - RNA, 20 nt, Artificial Sequence
  targeting sequence with CTCN PAM
auuuuacaggugaggaaacu

SEQ ID NO: 10937 - RNA, 20 nt, Artificial Sequence
  targeting sequence with CTCN PAM
aaggaugccucaaaccugga

SEQ ID NO: 10938 - RNA, 20 nt, Artificial Sequence
  targeting sequence with CTCN PAM
aaccuggagaucuuccauua

SEQ ID NO: 10939 - RNA, 20 nt, Artificial Sequence
  targeting sequence with CTCN PAM
agguuugaggcauccuuaga

SEQ ID NO: 10940 - RNA, 20 nt, Artificial Sequence
  targeting sequence with CTCN PAM
caacuuccucaguguggucu

SEQ ID NO: 10941 - RNA, 20 nt, Artificial Sequence
  targeting sequence with CTCN PAM
guguggucuucugagccauu

SEQ ID NO: 10942 - RNA, 20 nt, Artificial Sequence
  targeting sequence with CTCN PAM
gaagaccacacugaggaagu

SEQ ID NO: 10943 - RNA, 20 nt, Artificial Sequence
  targeting sequence with CTCN PAM
uugcagccaucaguuggcac

SEQ ID NO: 10944 - RNA, 20 nt, Artificial Sequence
  targeting sequence with CTCN PAM
gugccaacugauggcugcaa

SEQ ID NO: 10945 - RNA, 20 nt, Artificial Sequence
  targeting sequence with CTCN PAM
augaaccacguauucaaaac

SEQ ID NO: 10946 - RNA, 20 nt, Artificial Sequence
  targeting sequence with CTCN PAM
gggaauauaaagaugaaacu

SEQ ID NO: 10947 - RNA, 20 nt, Artificial Sequence
  targeting sequence with CTCN PAM
ugacgaucaaaaucucuguu

SEQ ID NO: 10948 - RNA, 20 nt, Artificial Sequence
  targeting sequence with CTCN PAM
guuaacaacugagugagcug

SEQ ID NO: 10949 - RNA, 20 nt, Artificial Sequence
  targeting sequence with CTCN PAM
guuguuaacagagauuuuga

SEQ ID NO: 10950 - RNA, 20 nt, Artificial Sequence
  targeting sequence with CTCN PAM
cucaguuguuaacagagauu

SEQ ID NO: 10951 - RNA, 20 nt, Artificial Sequence
  targeting sequence with CTCN PAM
ugcucuuggccaagggcauu

SEQ ID NO: 10952 - RNA, 20 nt, Artificial Sequence
  targeting sequence with CTCN PAM
uggccaagggcauuccaaag

SEQ ID NO: 10953 - RNA, 20 nt, Artificial Sequence
  targeting sequence with CTCN PAM
uuaugcccuucucccuaugg

SEQ ID NO: 10954 - RNA, 20 nt, Artificial Sequence
  targeting sequence with CTCN PAM
cuauggaauucaggcacagc

SEQ ID NO: 10955 - RNA, 20 nt, Artificial Sequence
  targeting sequence with CTCN PAM
uuuaaugcuaacgcugguca

SEQ ID NO: 10956 - RNA, 20 nt, Artificial Sequence
  targeting sequence with CTCN PAM
aguauagcaucacaugacag

SEQ ID NO: 10957 - RNA, 20 nt, Artificial Sequence
  targeting sequence with CTCN PAM
uguggggacaaucuacgucc

SEQ ID NO: 10958 - RNA, 20 nt, Artificial Sequence
  targeting sequence with CTCN PAM
cuuuccaggucuucucccug

SEQ ID NO: 10959 - RNA, 20 nt, Artificial Sequence
  targeting sequence with CTCN PAM
cugagccaggagaggcucca

SEQ ID NO: 10960 - RNA, 20 nt, Artificial Sequence
  targeting sequence with CTCN PAM
gggagaagaccuggaaaggg

SEQ ID NO: 10961 - RNA, 20 nt, Artificial Sequence
  targeting sequence with CTCN PAM
uggcucagggagaagaccug

SEQ ID NO: 10962 - RNA, 20 nt, Artificial Sequence
  targeting sequence with CTCN PAM
ccuggcucagggagaagacc

SEQ ID NO: 10963 - RNA, 20 nt, Artificial Sequence
  targeting sequence with CTCN PAM
acuaagacuuuggcaccuuu

SEQ ID NO: 10964 - RNA, 20 nt, Artificial Sequence
  targeting sequence with CTCN PAM
cuuugaagcccgcuaccugg

SEQ ID NO: 10965 - RNA, 20 nt, Artificial Sequence
  targeting sequence with CTCN PAM
uugaagcccgcuaccuggag

SEQ ID NO: 10966 - RNA, 20 nt, Artificial Sequence
  targeting sequence with CTCN PAM
agguagcgggcuucaaagag

SEQ ID NO: 10967 - RNA, 20 nt, Artificial Sequence
  targeting sequence with CTCN PAM
gcauaaauaagaaccuuggu

SEQ ID NO: 10968 - RNA, 20 nt, Artificial Sequence
  targeting sequence with CTCN PAM
acaaccucuuaucugaaccc

SEQ ID NO: 10969 - RNA, 20 nt, Artificial Sequence
  targeting sequence with CTCN PAM
uaucugaacccaggcauucc

SEQ ID NO: 10970 - RNA, 20 nt, Artificial Sequence
  targeting sequence with CTCN PAM
accaauugucaaaucuacca

SEQ ID NO: 10971 - RNA, 20 nt, Artificial Sequence
  targeting sequence with CTCN PAM
cuaaaauguacaaaaccaag

SEQ ID NO: 10972 - RNA, 20 nt, Artificial Sequence
  targeting sequence with CTCN PAM
ggacuuccugagggcuuugu

SEQ ID NO: 10973 - RNA, 20 nt, Artificial Sequence
  targeting sequence with CTCN PAM
ggaaguccugagaacaugug

SEQ ID NO: 10974 - RNA, 20 nt, Artificial Sequence
  targeting sequence with CTCN PAM
uacuggacucagaauaaguc

SEQ ID NO: 10975 - RNA, 20 nt, Artificial Sequence
  targeting sequence with CTCN PAM
gaauaagucuuuucaaauac

SEQ ID NO: 10976 - RNA, 20 nt, Artificial Sequence
  targeting sequence with CTCN PAM
uuucgucaauagacgcaaag

SEQ ID NO: 10977 - RNA, 20 nt, Artificial Sequence
  targeting sequence with CTCN PAM
guucguguacgcgcuccagc

SEQ ID NO: 10978 - RNA, 20 nt, Artificial Sequence
  targeting sequence with CTCN PAM
agcaagccgacaauacccac

SEQ ID NO: 10979 - RNA, 20 nt, Artificial Sequence
  targeting sequence with CTCN PAM
gugucuguggguauugucgg

SEQ ID NO: 10980 - RNA, 20 nt, Artificial Sequence
  targeting sequence with CTCN PAM
uuaccaggggaccauagggc

SEQ ID NO: 10981 - RNA, 20 nt, Artificial Sequence
  targeting sequence with CTCN PAM
cucaggccgggcgcgguggc

SEQ ID NO: 10982 - RNA, 20 nt, Artificial Sequence
  targeting sequence with CTCN PAM
ggccgggcgcgguggcucac

SEQ ID NO: 10983 - RNA, 20 nt, Artificial Sequence
  targeting sequence with CTCN PAM
cgccuguaaucccagaacuu

SEQ ID NO: 10984 - RNA, 20 nt, Artificial Sequence
  targeting sequence with CTCN PAM
gccuuccaaaguucugggau

SEQ ID NO: 10985 - RNA, 20 nt, Artificial Sequence
  targeting sequence with CTCN PAM
agugauccguccgccucggc

SEQ ID NO: 10986 - RNA, 20 nt, Artificial Sequence
  targeting sequence with CTCN PAM
cuacuaaaaauucaaaaauu

SEQ ID NO: 10987 - RNA, 20 nt, Artificial Sequence
  targeting sequence with CTCN PAM
acuaaaaauucaaaaauuag

SEQ ID NO: 10988 - RNA, 20 nt, Artificial Sequence
  targeting sequence with CTCN PAM
gccugccaaguagcugggac

SEQ ID NO: 10989 - RNA, 20 nt, Artificial Sequence
  targeting sequence with CTCN PAM
ugccucagccugccaaguag

SEQ ID NO: 10990 - RNA, 20 nt, Artificial Sequence
  targeting sequence with CTCN PAM
gcuuccgggguucaagcgau

SEQ ID NO: 10991 - RNA, 20 nt, Artificial Sequence
  targeting sequence with CTCN PAM
gcuuacugcagccuccgcuu

SEQ ID NO: 10992 - RNA, 20 nt, Artificial Sequence
  targeting sequence with CTCN PAM
agccugggaagcaaagugag

SEQ ID NO: 10993 - RNA, 20 nt, Artificial Sequence
  targeting sequence with CTCN PAM
cuuugcuucccaggcuggag

SEQ ID NO: 10994 - RNA, 20 nt, Artificial Sequence
  targeting sequence with CTCN PAM
gucucaaaaacaaacaaaca

SEQ ID NO: 10995 - RNA, 20 nt, Artificial Sequence
  targeting sequence with CTCN PAM
aaaacaaacaaacaaacaaa

SEQ ID NO: 10996 - RNA, 20 nt, Artificial Sequence
  targeting sequence with CTCN PAM
ccgagcaggaaaaagaagca

SEQ ID NO: 10997 - RNA, 20 nt, Artificial Sequence
  targeting sequence with CTCN PAM
gugaguuuguuuguuuguuu

SEQ ID NO: 10998 - RNA, 20 nt, Artificial Sequence
  targeting sequence with CTCN PAM
uccuuggugcuucuuuuucc

SEQ ID NO: 10999 - RNA, 20 nt, Artificial Sequence
  targeting sequence with CTCN PAM
cuuccuuggugcuucuuuuu

SEQ ID NO: 11000 - RNA, 20 nt, Artificial Sequence
  targeting sequence with CTCN PAM
ucccuucucucuuccuuggu

SEQ ID NO: 11001 - RNA, 20 nt, Artificial Sequence
  targeting sequence with CTCN PAM
caucccuucucucuuccuug

SEQ ID NO: 11002 - RNA, 20 nt, Artificial Sequence
  targeting sequence with CTCN PAM
cucaucccuucucucuuccu

SEQ ID NO: 11003 - RNA, 20 nt, Artificial Sequence
  targeting sequence with CTCN PAM
caucagccccggcgcucucu

SEQ ID NO: 11004 - RNA, 20 nt, Artificial Sequence
  targeting sequence with CTCN PAM
ggguccugacagggaaaagg

SEQ ID NO: 11005 - RNA, 20 nt, Artificial Sequence
  targeting sequence with CTCN PAM
ggguccuuaaaaaaaagaca

SEQ ID NO: 11006 - RNA, 20 nt, Artificial Sequence
  targeting sequence with CTCN PAM
uucuuugacaugucuuuuuu

SEQ ID NO: 11007 - RNA, 20 nt, Artificial Sequence
  targeting sequence with CTCN PAM
auuaaaacaguuaaauucgg

SEQ ID NO: 11008 - RNA, 20 nt, Artificial Sequence
  targeting sequence with CTCN PAM
cuauuaaaacaguuaaauuc

SEQ ID NO: 11009 - RNA, 20 nt, Artificial Sequence
  targeting sequence with CTCN PAM
gaaagaauuccaacuuucua

SEQ ID NO: 11010 - RNA, 20 nt, Artificial Sequence
  targeting sequence with CTCN PAM
acucagaaagaauuccaacu

SEQ ID NO: 11011 - RNA, 20 nt, Artificial Sequence
  targeting sequence with CTCN PAM
cuacaccaggucucaacuca

SEQ ID NO: 11012 - RNA, 20 nt, Artificial Sequence
  targeting sequence with CTCN PAM
acuccgaagugcgcuuccua

SEQ ID NO: 11013 - RNA, 20 nt, Artificial Sequence
  targeting sequence with CTCN PAM
gaagugcgcuuccuagcggu

SEQ ID NO: 11014 - RNA, 20 nt, Artificial Sequence
  targeting sequence with CTCN PAM
ugaccgcuaggaagcgcacu

SEQ ID NO: 11015 - RNA, 20 nt, Artificial Sequence
  targeting sequence with CTCN PAM
ccugaccgcuaggaagcgca

SEQ ID NO: 11016 - RNA, 20 nt, Artificial Sequence
  targeting sequence with CTCN PAM
cugaauuuacauaguaaaua

SEQ ID NO: 11017 - RNA, 20 nt, Artificial Sequence
  targeting sequence with CTCN PAM
ucacuauuuacuauguaaau

SEQ ID NO: 11018 - RNA, 20 nt, Artificial Sequence
  targeting sequence with CTCN PAM
auuuugcauauguggaagga

SEQ ID NO: 11019 - RNA, 20 nt, Artificial Sequence
  targeting sequence with CTCN PAM
uuccacauaugcaaaauaga

SEQ ID NO: 11020 - RNA, 20 nt, Artificial Sequence
  targeting sequence with CTCN PAM
aaaauucuccuuccacauau

SEQ ID NO: 11021 - RNA, 20 nt, Artificial Sequence
  targeting sequence with CTCN PAM
aagcuccacgcuucuaacca

SEQ ID NO: 11022 - RNA, 20 nt, Artificial Sequence
  targeting sequence with CTCN PAM
acgcuucuaaccauuagucu

SEQ ID NO: 11023 - RNA, 20 nt, Artificial Sequence
  targeting sequence with CTCN PAM
acaaaacaaccaacaaaaca

SEQ ID NO: 11024 - RNA, 20 nt, Artificial Sequence
  targeting sequence with CTCN PAM
cgccucagccuccugaguag

SEQ ID NO: 11025 - RNA, 20 nt, Artificial Sequence
  targeting sequence with CTCN PAM
ccucagccuccugaguagcg

SEQ ID NO: 11026 - RNA, 20 nt, Artificial Sequence
  targeting sequence with CTCN PAM
gccuccugaguagcggggau

SEQ ID NO: 11027 - RNA, 20 nt, Artificial Sequence
  targeting sequence with CTCN PAM
ugaguagcggggauuacaaa

SEQ ID NO: 11028 - RNA, 20 nt, Artificial Sequence
  targeting sequence with CTCN PAM
ggaggcugaggcgagagauc

SEQ ID NO: 11029 - RNA, 20 nt, Artificial Sequence
  targeting sequence with CTCN PAM
uauuuguaauccccgcuacu

SEQ ID NO: 11030 - RNA, 20 nt, Artificial Sequence
  targeting sequence with CTCN PAM
aaaaaaaaaaaaaaaaaaaa

SEQ ID NO: 11031 - RNA, 20 nt, Artificial Sequence
  targeting sequence with CTCN PAM
caaaaaaaaaaaaaaaaaaa

SEQ ID NO: 11032 - RNA, 20 nt, Artificial Sequence
  targeting sequence with CTCN PAM
cucucaaaaaaaaaaaaaaa

SEQ ID NO: 11033 - RNA, 20 nt, Artificial Sequence
  targeting sequence with CTCN PAM
cucuguugcacaggcuggag

SEQ ID NO: 11034 - RNA, 20 nt, Artificial Sequence
  targeting sequence with CTCN PAM
guugcacaggcuggagugca

SEQ ID NO: 11035 - RNA, 20 nt, Artificial Sequence
  targeting sequence with CTCN PAM
agccugugcaacagagugag

SEQ ID NO: 11036 - RNA, 20 nt, Artificial Sequence
  targeting sequence with CTCN PAM
acugcacuccagccugugca

SEQ ID NO: 11037 - RNA, 20 nt, Artificial Sequence
  targeting sequence with CTCN PAM
gcucacugcaacuucugccu

SEQ ID NO: 11038 - RNA, 20 nt, Artificial Sequence
  targeting sequence with CTCN PAM
cugcaacuucugccucccag

SEQ ID NO: 11039 - RNA, 20 nt, Artificial Sequence
  targeting sequence with CTCN PAM
cagguucaagggacaaggga

SEQ ID NO: 11040 - RNA, 20 nt, Artificial Sequence
  targeting sequence with CTCN PAM
ugccucaggcuccguaguag

SEQ ID NO: 11041 - RNA, 20 nt, Artificial Sequence
  targeting sequence with CTCN PAM
ggcuccguaguagcugggau

SEQ ID NO: 11042 - RNA, 20 nt, Artificial Sequence
  targeting sequence with CTCN PAM
guaguagcugggauuacagg

SEQ ID NO: 11043 - RNA, 20 nt, Artificial Sequence
  targeting sequence with CTCN PAM
acuaauuuuuuuuaauuuuc

SEQ ID NO: 11044 - RNA, 20 nt, Artificial Sequence
  targeting sequence with CTCN PAM
acugaaaauuaaaaaaaauu

SEQ ID NO: 11045 - RNA, 20 nt, Artificial Sequence
  targeting sequence with CTCN PAM
cuauguuggucaaccugguc

SEQ ID NO: 11046 - RNA, 20 nt, Artificial Sequence
  targeting sequence with CTCN PAM
aacuccugaccucaggugau

SEQ ID NO: 11047 - RNA, 20 nt, Artificial Sequence
  targeting sequence with CTCN PAM
ugaccucaggugaucugccc

SEQ ID NO: 11048 - RNA, 20 nt, Artificial Sequence
  targeting sequence with CTCN PAM
ggugaucugcccaccuuggc

SEQ ID NO: 11049 - RNA, 20 nt, Artificial Sequence
  targeting sequence with CTCN PAM
caaaaugcugggauuacagg

SEQ ID NO: 11050 - RNA, 20 nt, Artificial Sequence
  targeting sequence with CTCN PAM
cuguguugugucacugccuc

SEQ ID NO: 11051 - RNA, 20 nt, Artificial Sequence
  targeting sequence with CTCN PAM
guguugugucacugccucuc

SEQ ID NO: 11052 - RNA, 20 nt, Artificial Sequence
  targeting sequence with CTCN PAM
caggccagggcaccgagccc

SEQ ID NO: 11053 - RNA, 20 nt, Artificial Sequence
  targeting sequence with CTCN PAM
ggccagggcaccgagcccca

SEQ ID NO: 11054 - RNA, 20 nt, Artificial Sequence
  targeting sequence with CTCN PAM
gugcccuggccugagaggca

SEQ ID NO: 11055 - RNA, 20 nt, Artificial Sequence
  targeting sequence with CTCN PAM
uggcacaacagcuggggcuc

SEQ ID NO: 11056 - RNA, 20 nt, Artificial Sequence
  targeting sequence with CTCN PAM
gcacuccuggcacaacagcu

SEQ ID NO: 11057 - RNA, 20 nt, Artificial Sequence
  targeting sequence with CTCN PAM
ggcgaagcugccccuccucc

SEQ ID NO: 11058 - RNA, 20 nt, Artificial Sequence
  targeting sequence with CTCN PAM
ucccaccuuccuuccuugug

SEQ ID NO: 11059 - RNA, 20 nt, Artificial Sequence
  targeting sequence with CTCN PAM
caccuuccuuccuuguggag

SEQ ID NO: 11060 - RNA, 20 nt, Artificial Sequence
  targeting sequence with CTCN PAM
acaaggaaggaaggugggag

SEQ ID NO: 11061 - RNA, 20 nt, Artificial Sequence
  targeting sequence with CTCN PAM
aacuccuuaaagcgcauuuu

SEQ ID NO: 11062 - RNA, 20 nt, Artificial Sequence
  targeting sequence with CTCN PAM
uuaaagcgcauuuucuugcu

SEQ ID NO: 11063 - RNA, 20 nt, Artificial Sequence
  targeting sequence with CTCN PAM
acuaggaaaacgccaaagaa

SEQ ID NO: 11064 - RNA, 20 nt, Artificial Sequence
  targeting sequence with CTCN PAM
ucuccacuaggaaaacgcca

SEQ ID NO: 11065 - RNA, 20 nt, Artificial Sequence
  targeting sequence with CTCN PAM
cuucuccacuaggaaaacgc

SEQ ID NO: 11066 - RNA, 20 nt, Artificial Sequence
  targeting sequence with CTCN PAM
cucuucuccacuaggaaaac

SEQ ID NO: 11067 - RNA, 20 nt, Artificial Sequence
  targeting sequence with CTCN PAM
caaaaugccucucucuucuc

SEQ ID NO: 11068 - RNA, 20 nt, Artificial Sequence
  targeting sequence with CTCN PAM
ucacaaaaugccucucucuu

SEQ ID NO: 11069 - RNA, 20 nt, Artificial Sequence
  targeting sequence with CTCN PAM
ccucacaaaaugccucucuc

SEQ ID NO: 11070 - RNA, 20 nt, Artificial Sequence
  targeting sequence with CTCN PAM
uaccauacacuaugaggauc

SEQ ID NO: 11071 - RNA, 20 nt, Artificial Sequence
  targeting sequence with CTCN PAM
gagaagugccuuguccauuu

SEQ ID NO: 11072 - RNA, 20 nt, Artificial Sequence
  targeting sequence with CTCN PAM
gagucuuagcaucuucauau

SEQ ID NO: 11073 - RNA, 20 nt, Artificial Sequence
  targeting sequence with CTCN PAM
acagggcccugcuguguccc

SEQ ID NO: 11074 - RNA, 20 nt, Artificial Sequence
  targeting sequence with CTCN PAM
caccucaugguauccggcca

SEQ ID NO: 11075 - RNA, 20 nt, Artificial Sequence
  targeting sequence with CTCN PAM
ugguauccggccagcugggc

SEQ ID NO: 11076 - RNA, 20 nt, Artificial Sequence
  targeting sequence with CTCN PAM
ccuccucccaugccgcgccc

SEQ ID NO: 11077 - RNA, 20 nt, Artificial Sequence
  targeting sequence with CTCN PAM
uccucccaugccgcgccccu

SEQ ID NO: 11078 - RNA, 20 nt, Artificial Sequence
  targeting sequence with CTCN PAM
ucccaugccgcgccccugcc

SEQ ID NO: 11079 - RNA, 20 nt, Artificial Sequence
  targeting sequence with CTCN PAM
caugccgcgccccugccucu

SEQ ID NO: 11080 - RNA, 20 nt, Artificial Sequence
  targeting sequence with CTCN PAM
gcagggaugcugccuuguuc

SEQ ID NO: 11081 - RNA, 20 nt, Artificial Sequence
  targeting sequence with CTCN PAM
gcagucacccacggaugcug

SEQ ID NO: 11082 - RNA, 20 nt, Artificial Sequence
  targeting sequence with CTCN PAM
aaucuggguagcucaggcuu

SEQ ID NO: 11083 - RNA, 20 nt, Artificial Sequence
  targeting sequence with CTCN PAM
ggcuuuggaguaccaaagga

SEQ ID NO: 11084 - RNA, 20 nt, Artificial Sequence
  targeting sequence with CTCN PAM
aaagccugagcuacccagau

SEQ ID NO: 11085 - RNA, 20 nt, Artificial Sequence
  targeting sequence with CTCN PAM
uuugguacuccaaagccuga

SEQ ID NO: 11086 - RNA, 20 nt, Artificial Sequence
  targeting sequence with CTCN PAM
aagaaaauggccuccuuugg

SEQ ID NO: 11087 - RNA, 20 nt, Artificial Sequence
  targeting sequence with CTCN PAM
gguuggccucucgaaagggc

SEQ ID NO: 11088 - RNA, 20 nt, Artificial Sequence
  targeting sequence with CTCN PAM
cgaaagggcuggaggcaggu

SEQ ID NO: 11089 - RNA, 20 nt, Artificial Sequence
  targeting sequence with CTCN PAM
aaagggcuggaggcaggucc

SEQ ID NO: 11090 - RNA, 20 nt, Artificial Sequence
  targeting sequence with CTCN PAM
agcccuuucgagaggccaac

SEQ ID NO: 11091 - RNA, 20 nt, Artificial Sequence
  targeting sequence with CTCN PAM
uaugagcugcaagcccaccu

SEQ ID NO: 11092 - RNA, 20 nt, Artificial Sequence
  targeting sequence with CTCN PAM
uaggaggauaaaagaacauu

SEQ ID NO: 11093 - RNA, 20 nt, Artificial Sequence
  targeting sequence with CTCN PAM
ugggcuggucuuugcugauu

SEQ ID NO: 11094 - RNA, 20 nt, Artificial Sequence
  targeting sequence with CTCN PAM
aacaaaacuuuauaaaaaca

SEQ ID NO: 11095 - RNA, 20 nt, Artificial Sequence
  targeting sequence with CTCN PAM
uuuguuaaggugcugucugu

SEQ ID NO: 11096 - RNA, 20 nt, Artificial Sequence
  targeting sequence with CTCN PAM
guguugcagcaggaaagcag

SEQ ID NO: 11097 - RNA, 20 nt, Artificial Sequence
  targeting sequence with CTCN PAM
gcucuguguugcagcaggaa

SEQ ID NO: 11098 - RNA, 20 nt, Artificial Sequence
  targeting sequence with CTCN PAM
gccauccagguuugagugca

SEQ ID NO: 11099 - RNA, 20 nt, Artificial Sequence
  targeting sequence with CTCN PAM
auccccccccaaaaauauau

SEQ ID NO: 11100 - RNA, 20 nt, Artificial Sequence
  targeting sequence with CTCN PAM
ggaagcugaagugggaggau

SEQ ID NO: 11101 - RNA, 20 nt, Artificial Sequence
  targeting sequence with CTCN PAM
cacuucagcuuccugaguag

SEQ ID NO: 11102 - RNA, 20 nt, Artificial Sequence
  targeting sequence with CTCN PAM
aauuccugggcauaagcaau

SEQ ID NO: 11103 - RNA, 20 nt, Artificial Sequence
  targeting sequence with CTCN PAM
agccuaggcaacauaaggag

SEQ ID NO: 11104 - RNA, 20 nt, Artificial Sequence
  targeting sequence with CTCN PAM
uuauguugccuaggcuggag

SEQ ID NO: 11105 - RNA, 20 nt, Artificial Sequence
  targeting sequence with CTCN PAM
ugcaauggggucuccuuaug

SEQ ID NO: 11106 - RNA, 20 nt, Artificial Sequence
  targeting sequence with CTCN PAM
uuauguuggauauguguaga

SEQ ID NO: 11107 - RNA, 20 nt, Artificial Sequence
  targeting sequence with CTCN PAM
uucccuuggcuucccacagc

SEQ ID NO: 11108 - RNA, 20 nt, Artificial Sequence
  targeting sequence with CTCN PAM
ggguuuuggucuaaaugcug

SEQ ID NO: 11109 - RNA, 20 nt, Artificial Sequence
  targeting sequence with CTCN PAM
cccugggcuacaaggcccug

SEQ ID NO: 11110 - RNA, 20 nt, Artificial Sequence
  targeting sequence with CTCN PAM
cugggcuacaaggcccugcu

SEQ ID NO: 11111 - RNA, 20 nt, Artificial Sequence
  targeting sequence with CTCN PAM
gcugccuucccaccuggucc

SEQ ID NO: 11112 - RNA, 20 nt, Artificial Sequence
  targeting sequence with CTCN PAM
ugcaagcuauccuaccccag

SEQ ID NO: 11113 - RNA, 20 nt, Artificial Sequence
  targeting sequence with CTCN PAM
gaugucagcuccaaugucug

SEQ ID NO: 11114 - RNA, 20 nt, Artificial Sequence
  targeting sequence with CTCN PAM
aaugucugcuucucagagag

SEQ ID NO: 11115 - RNA, 20 nt, Artificial Sequence
  targeting sequence with CTCN PAM
gagaggccgucccugaccac

SEQ ID NO: 11116 - RNA, 20 nt, Artificial Sequence
  targeting sequence with CTCN PAM
gagaagcagacauuggagcu

SEQ ID NO: 11117 - RNA, 20 nt, Artificial Sequence
  targeting sequence with CTCN PAM
cugagaagcagacauuggag

SEQ ID NO: 11118 - RNA, 20 nt, Artificial Sequence
  targeting sequence with CTCN PAM
ucgaaagcuggggcuuuggc

SEQ ID NO: 11119 - RNA, 20 nt, Artificial Sequence
  targeting sequence with CTCN PAM
acaaagauuccaaugaauga

SEQ ID NO: 11120 - RNA, 20 nt, Artificial Sequence
  targeting sequence with CTCN PAM
agcugaaauaauauccugac

SEQ ID NO: 11121 - RNA, 20 nt, Artificial Sequence
  targeting sequence with CTCN PAM
auagaaggugguaaggucag

SEQ ID NO: 11122 - RNA, 20 nt, Artificial Sequence
  targeting sequence with CTCN PAM
gccucucugagcuccagcuu

SEQ ID NO: 11123 - RNA, 20 nt, Artificial Sequence
  targeting sequence with CTCN PAM
cugagcuccagcuuccuccu

SEQ ID NO: 11124 - RNA, 20 nt, Artificial Sequence
  targeting sequence with CTCN PAM
gagcuccagcuuccuccucg

SEQ ID NO: 11125 - RNA, 20 nt, Artificial Sequence
  targeting sequence with CTCN PAM
gagaggcugagccacuuguu

SEQ ID NO: 11126 - RNA, 20 nt, Artificial Sequence
  targeting sequence with CTCN PAM
agcuuccuccucguaaagca

SEQ ID NO: 11127 - RNA, 20 nt, Artificial Sequence
  targeting sequence with CTCN PAM
ucguaaagcaggaauagcaa

SEQ ID NO: 11128 - RNA, 20 nt, Artificial Sequence
  targeting sequence with CTCN PAM
uaaagcaggaauagcaaucc

SEQ ID NO: 11129 - RNA, 20 nt, Artificial Sequence
  targeting sequence with CTCN PAM
gcggacauaaaggauaaacu

SEQ ID NO: 11130 - RNA, 20 nt, Artificial Sequence
  targeting sequence with CTCN PAM
guuuauccuuuauguccgca

SEQ ID NO: 11131 - RNA, 20 nt, Artificial Sequence
  targeting sequence with CTCN PAM
ucuucauucuugcagaauga

SEQ ID NO: 11132 - RNA, 20 nt, Artificial Sequence
  targeting sequence with CTCN PAM
aacucuugccucuuuagaca

SEQ ID NO: 11133 - RNA, 20 nt, Artificial Sequence
  targeting sequence with CTCN PAM
ugccucuuuagacaaaguga

SEQ ID NO: 11134 - RNA, 20 nt, Artificial Sequence
  targeting sequence with CTCN PAM
uuagacaaagugagagacac

SEQ ID NO: 11135 - RNA, 20 nt, Artificial Sequence
  targeting sequence with CTCN PAM
cuuugucuaaagaggcaaga

SEQ ID NO: 11136 - RNA, 20 nt, Artificial Sequence
  targeting sequence with CTCN PAM
cacuuugucuaaagaggcaa

SEQ ID NO: 11137 - RNA, 20 nt, Artificial Sequence
  targeting sequence with CTCN PAM
guccgggugucucucacuuu

SEQ ID NO: 11138 - RNA, 20 nt, Artificial Sequence
  targeting sequence with CTCN PAM
ugcucuguccgggugucucu

SEQ ID NO: 11139 - RNA, 20 nt, Artificial Sequence
  targeting sequence with CTCN PAM
cuuucuagccucaugcauuu

SEQ ID NO: 11140 - RNA, 20 nt, Artificial Sequence
  targeting sequence with CTCN PAM
ugcauuucaaggaaaucacu

SEQ ID NO: 11141 - RNA, 20 nt, Artificial Sequence
  targeting sequence with CTCN PAM
ucuaacuauaagcagccaga

SEQ ID NO: 11142 - RNA, 20 nt, Artificial Sequence
  targeting sequence with CTCN PAM
uucuggcugcuuauaguuag

SEQ ID NO: 11143 - RNA, 20 nt, Artificial Sequence
  targeting sequence with CTCN PAM
ggcacagagggaggucgggg

SEQ ID NO: 11144 - RNA, 20 nt, Artificial Sequence
  targeting sequence with CTCN PAM
gugccugagcugucuugucu

SEQ ID NO: 11145 - RNA, 20 nt, Artificial Sequence
  targeting sequence with CTCN PAM
cucugugccugagcugucuu

SEQ ID NO: 11146 - RNA, 20 nt, Artificial Sequence
  targeting sequence with CTCN PAM
ugggugacugccaaacuuca

SEQ ID NO: 11147 - RNA, 20 nt, Artificial Sequence
  targeting sequence with CTCN PAM
uacaaugggccccaguaaaa

SEQ ID NO: 11148 - RNA, 20 nt, Artificial Sequence
  targeting sequence with CTCN PAM
gccucccagauaaacacaac

SEQ ID NO: 11149 - RNA, 20 nt, Artificial Sequence
  targeting sequence with CTCN PAM
cagauaaacacaacaaagag

SEQ ID NO: 11150 - RNA, 20 nt, Artificial Sequence
  targeting sequence with CTCN PAM
uuguuguguuuaucugggag

SEQ ID NO: 11151 - RNA, 20 nt, Artificial Sequence
  targeting sequence with CTCN PAM
gucucuuuguuguguuuauc

SEQ ID NO: 11152 - RNA, 20 nt, Artificial Sequence
  targeting sequence with CTCN PAM
gauaaacucuuccacuguga

SEQ ID NO: 11153 - RNA, 20 nt, Artificial Sequence
  targeting sequence with CTCN PAM
uccacugugaauccuuaaaa

SEQ ID NO: 11154 - RNA, 20 nt, Artificial Sequence
  targeting sequence with CTCN PAM
uagucuguaagagaaugugg

SEQ ID NO: 11155 - RNA, 20 nt, Artificial Sequence
  targeting sequence with CTCN PAM
uacagacuaagaguuuuuaa

SEQ ID NO: 11156 - RNA, 20 nt, Artificial Sequence
  targeting sequence with CTCN PAM
gaccuaacucagccagcagc

SEQ ID NO: 11157 - RNA, 20 nt, Artificial Sequence
  targeting sequence with CTCN PAM
gccagcagccccucucaggu

SEQ ID NO: 11158 - RNA, 20 nt, Artificial Sequence
  targeting sequence with CTCN PAM
cagguuuguuuucucuaaaa

SEQ ID NO: 11159 - RNA, 20 nt, Artificial Sequence
  targeting sequence with CTCN PAM
gguuuguuuucucuaaaaua

SEQ ID NO: 11160 - RNA, 20 nt, Artificial Sequence
  targeting sequence with CTCN PAM
aaaauaaaccugucuuugac

SEQ ID NO: 11161 - RNA, 20 nt, Artificial Sequence
  targeting sequence with CTCN PAM
auagucaaagacagguuuau

SEQ ID NO: 11162 - RNA, 20 nt, Artificial Sequence
  targeting sequence with CTCN PAM
uucuuuaauucuuacacacc

SEQ ID NO: 11163 - RNA, 20 nt, Artificial Sequence
  targeting sequence with CTCN PAM
ccagggaaaaagaacucagu

SEQ ID NO: 11164 - RNA, 20 nt, Artificial Sequence
  targeting sequence with CTCN PAM
gugaugacgccaaaguagca

SEQ ID NO: 11165 - RNA, 20 nt, Artificial Sequence
  targeting sequence with CTCN PAM
uggugcuacuuuggcgucau

SEQ ID NO: 11166 - RNA, 20 nt, Artificial Sequence
  targeting sequence with CTCN PAM
cauggugcuacuuuggcguc

SEQ ID NO: 11167 - RNA, 20 nt, Artificial Sequence
  targeting sequence with CTCN PAM
gcugcgaauaugcaucacag

SEQ ID NO: 11168 - RNA, 20 nt, Artificial Sequence
  targeting sequence with CTCN PAM
cagccagcuacacagauaau

SEQ ID NO: 11169 - RNA, 20 nt, Artificial Sequence
  targeting sequence with CTCN PAM
uugugccuuuuuguuauaaa

SEQ ID NO: 11170 - RNA, 20 nt, Artificial Sequence
  targeting sequence with CTCN PAM
gauacucuuugugccuuuuu

SEQ ID NO: 11171 - RNA, 20 nt, Artificial Sequence
  targeting sequence with CTCN PAM
aguugggcugcuuucccucu

SEQ ID NO: 11172 - RNA, 20 nt, Artificial Sequence
  targeting sequence with CTCN PAM
uuuauguccagcacauuuuu

SEQ ID NO: 11173 - RNA, 20 nt, Artificial Sequence
  targeting sequence with CTCN PAM
ugcaugugucaccaccccaa

SEQ ID NO: 11174 - RNA, 20 nt, Artificial Sequence
  targeting sequence with CTCN PAM
gcaccccaacagucgcuccu

SEQ ID NO: 11175 - RNA, 20 nt, Artificial Sequence
  targeting sequence with CTCN PAM
gggaagcucagcaccccaac

SEQ ID NO: 11176 - RNA, 20 nt, Artificial Sequence
  targeting sequence with CTCN PAM
gagagaggcagagacccugc

SEQ ID NO: 11177 - RNA, 20 nt, Artificial Sequence
  targeting sequence with CTCN PAM
gagcucagggaagcucagca

SEQ ID NO: 11178 - RNA, 20 nt, Artificial Sequence
  targeting sequence with CTCN PAM
cagagcucagggaagcucag

SEQ ID NO: 11179 - RNA, 20 nt, Artificial Sequence
  targeting sequence with CTCN PAM
cucagagcucagggaagcuc

SEQ ID NO: 11180 - RNA, 20 nt, Artificial Sequence
  targeting sequence with CTCN PAM
gccucucucagagcucaggg

SEQ ID NO: 11181 - RNA, 20 nt, Artificial Sequence
  targeting sequence with CTCN PAM
caagcagggucucugccucu

SEQ ID NO: 11182 - RNA, 20 nt, Artificial Sequence
  targeting sequence with CTCN PAM
gcagggcagcugguugagac

SEQ ID NO: 11183 - RNA, 20 nt, Artificial Sequence
  targeting sequence with CTCN PAM
accagcugcccugcagagaa

SEQ ID NO: 11184 - RNA, 20 nt, Artificial Sequence
  targeting sequence with CTCN PAM
uggaggacugaggaauggau

SEQ ID NO: 11185 - RNA, 20 nt, Artificial Sequence
  targeting sequence with CTCN PAM
aggagauuuucaauguccag

SEQ ID NO: 11186 - RNA, 20 nt, Artificial Sequence
  targeting sequence with CTCN PAM
guccuccaggagauuuucaa

SEQ ID NO: 11187 - RNA, 20 nt, Artificial Sequence
  targeting sequence with CTCN PAM
gagcugccugcuguccccaa

SEQ ID NO: 11188 - RNA, 20 nt, Artificial Sequence
  targeting sequence with CTCN PAM
gagcauccauuccucagucc

SEQ ID NO: 11189 - RNA, 20 nt, Artificial Sequence
  targeting sequence with CTCN PAM
uuuggggacagcaggcagcu

SEQ ID NO: 11190 - RNA, 20 nt, Artificial Sequence
  targeting sequence with CTCN PAM
agugaggaugcugaguaacu

SEQ ID NO: 11191 - RNA, 20 nt, Artificial Sequence
  targeting sequence with CTCN PAM
cuggaguggcucauuugggg

SEQ ID NO: 11192 - RNA, 20 nt, Artificial Sequence
  targeting sequence with CTCN PAM
gcauccucacuggaguggcu

SEQ ID NO: 11193 - RNA, 20 nt, Artificial Sequence
  targeting sequence with CTCN PAM
ucuuggugugacuguaaacu

SEQ ID NO: 11194 - RNA, 20 nt, Artificial Sequence
  targeting sequence with CTCN PAM
uggugugacuguaaacucca

SEQ ID NO: 11195 - RNA, 20 nt, Artificial Sequence
  targeting sequence with CTCN PAM
aacggccucaccccagaucu

SEQ ID NO: 11196 - RNA, 20 nt, Artificial Sequence
  targeting sequence with CTCN PAM
ccccagaucuuuaccauugu

SEQ ID NO: 11197 - RNA, 20 nt, Artificial Sequence
  targeting sequence with CTCN PAM
acugccuccuccagggcucc

SEQ ID NO: 11198 - RNA, 20 nt, Artificial Sequence
  targeting sequence with CTCN PAM
uccagggcuccugugugacu

SEQ ID NO: 11199 - RNA, 20 nt, Artificial Sequence
  targeting sequence with CTCN PAM
agggcuccugugugacucag

SEQ ID NO: 11200 - RNA, 20 nt, Artificial Sequence
  targeting sequence with CTCN PAM
ugugugacucagggaggaca

SEQ ID NO: 11201 - RNA, 20 nt, Artificial Sequence
  targeting sequence with CTCN PAM
gggaggacaaggaagcccca

SEQ ID NO: 11202 - RNA, 20 nt, Artificial Sequence
  targeting sequence with CTCN PAM
cugagucacacaggagcccu

SEQ ID NO: 11203 - RNA, 20 nt, Artificial Sequence
  targeting sequence with CTCN PAM
ugcauguuuggggcuuccuu

SEQ ID NO: 11204 - RNA, 20 nt, Artificial Sequence
  targeting sequence with CTCN PAM
guucccaucuaccagguugg

SEQ ID NO: 11205 - RNA, 20 nt, Artificial Sequence
  targeting sequence with CTCN PAM
acaacacaaaggugcauugu

SEQ ID NO: 11206 - RNA, 20 nt, Artificial Sequence
  targeting sequence with CTCN PAM
ggcugugaauuuacucuaca

SEQ ID NO: 11207 - RNA, 20 nt, Artificial Sequence
  targeting sequence with CTCN PAM
gugccuugucuggacagaug

SEQ ID NO: 11208 - RNA, 20 nt, Artificial Sequence
  targeting sequence with CTCN PAM
aguuccaucugccaagcaau

SEQ ID NO: 11209 - RNA, 20 nt, Artificial Sequence
  targeting sequence with CTCN PAM
cuauuaauccauagcuuauu

SEQ ID NO: 11210 - RNA, 20 nt, Artificial Sequence
  targeting sequence with CTCN PAM
ucacuauuaauccauagcuu

SEQ ID NO: 11211 - RNA, 20 nt, Artificial Sequence
  targeting sequence with CTCN PAM
ggaaaggcuugccauuuggg

SEQ ID NO: 11212 - RNA, 20 nt, Artificial Sequence
  targeting sequence with CTCN PAM
gccucucaggugggcucugg

SEQ ID NO: 11213 - RNA, 20 nt, Artificial Sequence
  targeting sequence with CTCN PAM
caggugggcucuggugggcu

SEQ ID NO: 11214 - RNA, 20 nt, Artificial Sequence
  targeting sequence with CTCN PAM
ggugggcucuggugggcuga

SEQ ID NO: 11215 - RNA, 20 nt, Artificial Sequence
  targeting sequence with CTCN PAM
ggugggcugaguauccuccu

SEQ ID NO: 11216 - RNA, 20 nt, Artificial Sequence
  targeting sequence with CTCN PAM
gcccaccagagcccaccuga

SEQ ID NO: 11217 - RNA, 20 nt, Artificial Sequence
  targeting sequence with CTCN PAM
ucuaagaacaagggcuggga

SEQ ID NO: 11218 - RNA, 20 nt, Artificial Sequence
  targeting sequence with CTCN PAM
aagaacaagggcugggacuc

SEQ ID NO: 11219 - RNA, 20 nt, Artificial Sequence
  targeting sequence with CTCN PAM
uuugucuuugaauggacaca

SEQ ID NO: 11220 - RNA, 20 nt, Artificial Sequence
  targeting sequence with CTCN PAM
agggaauaucuacuccuuag

SEQ ID NO: 11221 - RNA, 20 nt, Artificial Sequence
  targeting sequence with CTCN PAM
uuaguuaaucucugggccug

SEQ ID NO: 11222 - RNA, 20 nt, Artificial Sequence
  targeting sequence with CTCN PAM
gggccugaaaauuuccagag

SEQ ID NO: 11223 - RNA, 20 nt, Artificial Sequence
  targeting sequence with CTCN PAM
ggaaauuuucaggcccagag

SEQ ID NO: 11224 - RNA, 20 nt, Artificial Sequence
  targeting sequence with CTCN PAM
guguguuccccaguuuuggc

SEQ ID NO: 11225 - RNA, 20 nt, Artificial Sequence
  targeting sequence with CTCN PAM
cuuccucaguguguucccca

SEQ ID NO: 11226 - RNA, 20 nt, Artificial Sequence
  targeting sequence with CTCN PAM
aaacucacuuccucagugug

SEQ ID NO: 11227 - RNA, 20 nt, Artificial Sequence
  targeting sequence with CTCN PAM
uccaaacucacuuccucagu

SEQ ID NO: 11228 - RNA, 20 nt, Artificial Sequence
  targeting sequence with CTCN PAM
ccuccaaacucacuuccuca

SEQ ID NO: 11229 - RNA, 20 nt, Artificial Sequence
  targeting sequence with CTCN PAM
caggacggggagguggaggc

SEQ ID NO: 11230 - RNA, 20 nt, Artificial Sequence
  targeting sequence with CTCN PAM
ccguccugggagcaagcaug

SEQ ID NO: 11231 - RNA, 20 nt, Artificial Sequence
  targeting sequence with CTCN PAM
accuccccguccugggagca

SEQ ID NO: 11232 - RNA, 20 nt, Artificial Sequence
  targeting sequence with CTCN PAM
ccauccugugccuccaccuc

SEQ ID NO: 11233 - RNA, 20 nt, Artificial Sequence
  targeting sequence with CTCN PAM
cuugcaguggccaggcugcu

SEQ ID NO: 11234 - RNA, 20 nt, Artificial Sequence
  targeting sequence with CTCN PAM
uuugcugagccauagaccac

SEQ ID NO: 11235 - RNA, 20 nt, Artificial Sequence
  targeting sequence with CTCN PAM
gcaaaggagcagccuggcca

SEQ ID NO: 11236 - RNA, 20 nt, Artificial Sequence
  targeting sequence with CTCN PAM
ugggaagcacaacaccauca

SEQ ID NO: 11237 - RNA, 20 nt, Artificial Sequence
  targeting sequence with CTCN PAM
cuugggaagcacaacaccau

SEQ ID NO: 11238 - RNA, 20 nt, Artificial Sequence
  targeting sequence with CTCN PAM
gcucucuugggaagcacaac

SEQ ID NO: 11239 - RNA, 20 nt, Artificial Sequence
  targeting sequence with CTCN PAM
accucuugguucuucagagg

SEQ ID NO: 11240 - RNA, 20 nt, Artificial Sequence
  targeting sequence with CTCN PAM
ugguucuucagagggacucc

SEQ ID NO: 11241 - RNA, 20 nt, Artificial Sequence
  targeting sequence with CTCN PAM
gaagaaccaagagguggagg

SEQ ID NO: 11242 - RNA, 20 nt, Artificial Sequence
  targeting sequence with CTCN PAM
gaccugaggagagagaagac

SEQ ID NO: 11243 - RNA, 20 nt, Artificial Sequence
  targeting sequence with CTCN PAM
ggucggagucccucugaaga

SEQ ID NO: 11244 - RNA, 20 nt, Artificial Sequence
  targeting sequence with CTCN PAM
ucaggucggagucccucuga

SEQ ID NO: 11245 - RNA, 20 nt, Artificial Sequence
  targeting sequence with CTCN PAM
ccucaggucggagucccucu

SEQ ID NO: 11246 - RNA, 20 nt, Artificial Sequence
  targeting sequence with CTCN PAM
cuccucaggucggagucccu

SEQ ID NO: 11247 - RNA, 20 nt, Artificial Sequence
  targeting sequence with CTCN PAM
cuaaaguuguuuaagguauu

SEQ ID NO: 11248 - RNA, 20 nt, Artificial Sequence
  targeting sequence with CTCN PAM
acuuaaaagaaacccaaaca

SEQ ID NO: 11249 - RNA, 20 nt, Artificial Sequence
  targeting sequence with CTCN PAM
gucacccaggcuggagugua

SEQ ID NO: 11250 - RNA, 20 nt, Artificial Sequence
  targeting sequence with CTCN PAM
agccugggugacagagcaag

SEQ ID NO: 11251 - RNA, 20 nt, Artificial Sequence
  targeting sequence with CTCN PAM
cugcagccucuaacucccgg

SEQ ID NO: 11252 - RNA, 20 nt, Artificial Sequence
  targeting sequence with CTCN PAM
aacucccgggcucaagugau

SEQ ID NO: 11253 - RNA, 20 nt, Artificial Sequence
  targeting sequence with CTCN PAM
cgggcucaagugauccuccc

SEQ ID NO: 11254 - RNA, 20 nt, Artificial Sequence
  targeting sequence with CTCN PAM
agugauccucccaucugacc

SEQ ID NO: 11255 - RNA, 20 nt, Artificial Sequence
  targeting sequence with CTCN PAM
caucugacccucccauguag

SEQ ID NO: 11256 - RNA, 20 nt, Artificial Sequence
  targeting sequence with CTCN PAM
cauguagcugggacgacagg

SEQ ID NO: 11257 - RNA, 20 nt, Artificial Sequence
  targeting sequence with CTCN PAM
acaaaaaauuaaaaaacuua

SEQ ID NO: 11258 - RNA, 20 nt, Artificial Sequence
  targeting sequence with CTCN PAM
cuguguuacccaggcugauc

SEQ ID NO: 11259 - RNA, 20 nt, Artificial Sequence
  targeting sequence with CTCN PAM
agcucuuggccucaagcagu

SEQ ID NO: 11260 - RNA, 20 nt, Artificial Sequence
  targeting sequence with CTCN PAM
uggccucaagcagucuucuc

SEQ ID NO: 11261 - RNA, 20 nt, Artificial Sequence
  targeting sequence with CTCN PAM
agcagucuucucacuuuggc

SEQ ID NO: 11262 - RNA, 20 nt, Artificial Sequence
  targeting sequence with CTCN PAM
cuuuggccuuccaaaguguu

SEQ ID NO: 11263 - RNA, 20 nt, Artificial Sequence
  targeting sequence with CTCN PAM
ugccuguaaucccccaacac

SEQ ID NO: 11264 - RNA, 20 nt, Artificial Sequence
  targeting sequence with CTCN PAM
ugccuguaaucccagcacuu

SEQ ID NO: 11265 - RNA, 20 nt, Artificial Sequence
  targeting sequence with CTCN PAM
caaagugcugggauuacagg

SEQ ID NO: 11266 - RNA, 20 nt, Artificial Sequence
  targeting sequence with CTCN PAM
gccucccaaagugcugggau

SEQ ID NO: 11267 - RNA, 20 nt, Artificial Sequence
  targeting sequence with CTCN PAM
ugaccuugugauccaccugc

SEQ ID NO: 11268 - RNA, 20 nt, Artificial Sequence
  targeting sequence with CTCN PAM
acuaaaaauacaaaaauuag

SEQ ID NO: 11269 - RNA, 20 nt, Artificial Sequence
  targeting sequence with CTCN PAM
ggagucugaggcaggaaaau

SEQ ID NO: 11270 - RNA, 20 nt, Artificial Sequence
  targeting sequence with CTCN PAM
cgaguaguugggacuauagg

SEQ ID NO: 11271 - RNA, 20 nt, Artificial Sequence
  targeting sequence with CTCN PAM
gacucccgaguaguugggac

SEQ ID NO: 11272 - RNA, 20 nt, Artificial Sequence
  targeting sequence with CTCN PAM
cagguucaagcaauuuuccu

SEQ ID NO: 11273 - RNA, 20 nt, Artificial Sequence
  targeting sequence with CTCN PAM
gccucccagguucaagcaau

SEQ ID NO: 11274 - RNA, 20 nt, Artificial Sequence
  targeting sequence with CTCN PAM
cugcaaccuccgccucccag

SEQ ID NO: 11275 - RNA, 20 nt, Artificial Sequence
  targeting sequence with CTCN PAM
agccuggugacagagugaga

SEQ ID NO: 11276 - RNA, 20 nt, Artificial Sequence
  targeting sequence with CTCN PAM
gucaccaggcuggagugcgg

SEQ ID NO: 11277 - RNA, 20 nt, Artificial Sequence
  targeting sequence with CTCN PAM
cucugucaccaggcuggagu

SEQ ID NO: 11278 - RNA, 20 nt, Artificial Sequence
  targeting sequence with CTCN PAM
gccucaaaaaaaaaaaaaaa

SEQ ID NO: 11279 - RNA, 20 nt, Artificial Sequence
  targeting sequence with CTCN PAM
aaaaaaaaaaaaaaaccaaa

SEQ ID NO: 11280 - RNA, 20 nt, Artificial Sequence
  targeting sequence with CTCN PAM
gauaguaaauauuuuagguu

SEQ ID NO: 11281 - RNA, 20 nt, Artificial Sequence
  targeting sequence with CTCN PAM
acucugccauuguagcauga

SEQ ID NO: 11282 - RNA, 20 nt, Artificial Sequence
  targeting sequence with CTCN PAM
gccauuguagcaugaaagca

SEQ ID NO: 11283 - RNA, 20 nt, Artificial Sequence
  targeting sequence with CTCN PAM
uucauccuugaauugucuau

SEQ ID NO: 11284 - RNA, 20 nt, Artificial Sequence
  targeting sequence with CTCN PAM
auuuaaaaaacaggaagcag

SEQ ID NO: 11285 - RNA, 20 nt, Artificial Sequence
  targeting sequence with CTCN PAM
ugagccacaguuugcagacc

SEQ ID NO: 11286 - RNA, 20 nt, Artificial Sequence
  targeting sequence with CTCN PAM
agagacaaguccagccugcu

SEQ ID NO: 11287 - RNA, 20 nt, Artificial Sequence
  targeting sequence with CTCN PAM
gcuaggccgauacaacuuuc

SEQ ID NO: 11288 - RNA, 20 nt, Artificial Sequence
  targeting sequence with CTCN PAM
acuggacugcacagaugugg

SEQ ID NO: 11289 - RNA, 20 nt, Artificial Sequence
  targeting sequence with CTCN PAM
ucuacuggacugcacagaug

SEQ ID NO: 11290 - RNA, 20 nt, Artificial Sequence
  targeting sequence with CTCN PAM
guagucacauguggcaagua

SEQ ID NO: 11291 - RNA, 20 nt, Artificial Sequence
  targeting sequence with CTCN PAM
aaauauguggcuggugugau

SEQ ID NO: 11292 - RNA, 20 nt, Artificial Sequence
  targeting sequence with CTCN PAM
uggugaugccuguaguacug

SEQ ID NO: 11293 - RNA, 20 nt, Artificial Sequence
  targeting sequence with CTCN PAM
uuagaaauacagcaucuuuu

SEQ ID NO: 11294 - RNA, 20 nt, Artificial Sequence
  targeting sequence with CTCN PAM
aacugucacuggcauauaag

SEQ ID NO: 11295 - RNA, 20 nt, Artificial Sequence
  targeting sequence with CTCN PAM
accagcuuucucugaucuua

SEQ ID NO: 11296 - RNA, 20 nt, Artificial Sequence
  targeting sequence with CTCN PAM
gaucuuaguuuuggggucug

SEQ ID NO: 11297 - RNA, 20 nt, Artificial Sequence
  targeting sequence with CTCN PAM
aagguagcuggcugguuaug

SEQ ID NO: 11298 - RNA, 20 nt, Artificial Sequence
  targeting sequence with CTCN PAM
uaaccagccagcuaccuugg

SEQ ID NO: 11299 - RNA, 20 nt, Artificial Sequence
  targeting sequence with CTCN PAM
acagacuuuccacucaggug

SEQ ID NO: 11300 - RNA, 20 nt, Artificial Sequence
  targeting sequence with CTCN PAM
gguggggguuuucaagguca

SEQ ID NO: 11301 - RNA, 20 nt, Artificial Sequence
  targeting sequence with CTCN PAM
auaucugccccgcaccaguc

SEQ ID NO: 11302 - RNA, 20 nt, Artificial Sequence
  targeting sequence with CTCN PAM
uugugucuacuucucaguug

SEQ ID NO: 11303 - RNA, 20 nt, Artificial Sequence
  targeting sequence with CTCN PAM
guugaaccagaacccagcau

SEQ ID NO: 11304 - RNA, 20 nt, Artificial Sequence
  targeting sequence with CTCN PAM
cccgccaugcuggguucugg

SEQ ID NO: 11305 - RNA, 20 nt, Artificial Sequence
  targeting sequence with CTCN PAM
uugccacccccgccccuccc

SEQ ID NO: 11306 - RNA, 20 nt, Artificial Sequence
  targeting sequence with CTCN PAM
cucuuugccacccccgcccc

SEQ ID NO: 11307 - RNA, 20 nt, Artificial Sequence
  targeting sequence with CTCN PAM
ggaugggccuaagugggcag

SEQ ID NO: 11308 - RNA, 20 nt, Artificial Sequence
  targeting sequence with CTCN PAM
ucccuggugauucucugguu

SEQ ID NO: 11309 - RNA, 20 nt, Artificial Sequence
  targeting sequence with CTCN PAM
cuggugauucucugguucuc

SEQ ID NO: 11310 - RNA, 20 nt, Artificial Sequence
  targeting sequence with CTCN PAM
gguucucacccuggcccacc

SEQ ID NO: 11311 - RNA, 20 nt, Artificial Sequence
  targeting sequence with CTCN PAM
cccuggcccaccuugugaaa

SEQ ID NO: 11312 - RNA, 20 nt, Artificial Sequence
  targeting sequence with CTCN PAM
aggaucuugaucuugcggcu

SEQ ID NO: 11313 - RNA, 20 nt, Artificial Sequence
  targeting sequence with CTCN PAM
uaccugcauagccgcaagau

SEQ ID NO: 11314 - RNA, 20 nt, Artificial Sequence
  targeting sequence with CTCN PAM
ggcagcuggagcuggggcac

SEQ ID NO: 11315 - RNA, 20 nt, Artificial Sequence
  targeting sequence with CTCN PAM
agcugcccgagcccccugcc

SEQ ID NO: 11316 - RNA, 20 nt, Artificial Sequence
  targeting sequence with CTCN PAM
cggcugucccgccagauggu

SEQ ID NO: 11317 - RNA, 20 nt, Artificial Sequence
  targeting sequence with CTCN PAM
cccggcugucccgccagaug

SEQ ID NO: 11318 - RNA, 20 nt, Artificial Sequence
  targeting sequence with CTCN PAM
uccagaagaaagcccccagg

SEQ ID NO: 11319 - RNA, 20 nt, Artificial Sequence
  targeting sequence with CTCN PAM
ccucuuccagaagaaagccc

SEQ ID NO: 11320 - RNA, 20 nt, Artificial Sequence
  targeting sequence with CTCN PAM
caccucuuccagaagaaagc

SEQ ID NO: 11321 - RNA, 20 nt, Artificial Sequence
  targeting sequence with CTCN PAM
gcccuacccucucaccucuu

SEQ ID NO: 11322 - RNA, 20 nt, Artificial Sequence
  targeting sequence with CTCN PAM
ucugcccuacccucucaccu

SEQ ID NO: 11323 - RNA, 20 nt, Artificial Sequence
  targeting sequence with CTCN PAM
ccucugcccuacccucucac

SEQ ID NO: 11324 - RNA, 20 nt, Artificial Sequence
  targeting sequence with CTCN PAM
cuccucugcccuacccucuc

SEQ ID NO: 11325 - RNA, 20 nt, Artificial Sequence
  targeting sequence with CTCN PAM
uuugaacucucuccucugcc

SEQ ID NO: 11326 - RNA, 20 nt, Artificial Sequence
  targeting sequence with CTCN PAM
ggggacugcauccgccuggc

SEQ ID NO: 11327 - RNA, 20 nt, Artificial Sequence
  targeting sequence with CTCN PAM
uuagucccuaacucugggga

SEQ ID NO: 11328 - RNA, 20 nt, Artificial Sequence
  targeting sequence with CTCN PAM
ccuuagucccuaacucuggg

SEQ ID NO: 11329 - RNA, 20 nt, Artificial Sequence
  targeting sequence with CTCN PAM
uccucuccuuagucccuaac

SEQ ID NO: 11330 - RNA, 20 nt, Artificial Sequence
  targeting sequence with CTCN PAM
aaauagcaggauagaguaca

SEQ ID NO: 11331 - RNA, 20 nt, Artificial Sequence
  targeting sequence with CTCN PAM
auccugcuauuuagagcugc

SEQ ID NO: 11332 - RNA, 20 nt, Artificial Sequence
  targeting sequence with CTCN PAM
caggcauuuuguggccaaac

SEQ ID NO: 11333 - RNA, 20 nt, Artificial Sequence
  targeting sequence with CTCN PAM
gagccuugguuuucucaucu

SEQ ID NO: 11334 - RNA, 20 nt, Artificial Sequence
  targeting sequence with CTCN PAM
gagaagcaaagucucccagg

SEQ ID NO: 11335 - RNA, 20 nt, Artificial Sequence
  targeting sequence with CTCN PAM
ucugaaaaacacaaggcuug

SEQ ID NO: 11336 - RNA, 20 nt, Artificial Sequence
  targeting sequence with CTCN PAM
ccugucaaaccagucaguau

SEQ ID NO: 11337 - RNA, 20 nt, Artificial Sequence
  targeting sequence with CTCN PAM
ugucaaaccagucaguaugc

SEQ ID NO: 11338 - RNA, 20 nt, Artificial Sequence
  targeting sequence with CTCN PAM
cagugcaccaaaaccuauac

SEQ ID NO: 11339 - RNA, 20 nt, Artificial Sequence
  targeting sequence with CTCN PAM
gugcaccaaaaccuauaccc

SEQ ID NO: 11340 - RNA, 20 nt, Artificial Sequence
  targeting sequence with CTCN PAM
agggaaggguauagguuuug

SEQ ID NO: 11341 - RNA, 20 nt, Artificial Sequence
  targeting sequence with CTCN PAM
accuggcuccagggaagggu

SEQ ID NO: 11342 - RNA, 20 nt, Artificial Sequence
  targeting sequence with CTCN PAM
gcucagacugcagaagcaac

SEQ ID NO: 11343 - RNA, 20 nt, Artificial Sequence
  targeting sequence with CTCN PAM
gacugcagaagcaaccuguu

SEQ ID NO: 11344 - RNA, 20 nt, Artificial Sequence
  targeting sequence with CTCN PAM
gccaauuggcgcggggcguc

SEQ ID NO: 11345 - RNA, 20 nt, Artificial Sequence
  targeting sequence with CTCN PAM
uaacacgugacagcgcucag

SEQ ID NO: 11346 - RNA, 20 nt, Artificial Sequence
  targeting sequence with CTCN PAM
cucuuaacacgugacagcgc

SEQ ID NO: 11347 - RNA, 20 nt, Artificial Sequence
  targeting sequence with CTCN PAM
cucuuuuaccuuggucccuu

SEQ ID NO: 11348 - RNA, 20 nt, Artificial Sequence
  targeting sequence with CTCN PAM
cucacucuuuuaccuugguc

SEQ ID NO: 11349 - RNA, 20 nt, Artificial Sequence
  targeting sequence with CTCN PAM
auuucagcucacucacucuu

SEQ ID NO: 11350 - RNA, 20 nt, Artificial Sequence
  targeting sequence with CTCN PAM
aaacauguucaaacacauuc

SEQ ID NO: 11351 - RNA, 20 nt, Artificial Sequence
  targeting sequence with CTCN PAM
ucuguuaugcauagcuuugc

SEQ ID NO: 11352 - RNA, 20 nt, Artificial Sequence
  targeting sequence with CTCN PAM
gcagcuuucaagcucaucug

SEQ ID NO: 11353 - RNA, 20 nt, Artificial Sequence
  targeting sequence with CTCN PAM
guaucuuauguuucuuccag

SEQ ID NO: 11354 - RNA, 20 nt, Artificial Sequence
  targeting sequence with CTCN PAM
gccucuguaucuuauguuuc

SEQ ID NO: 11355 - RNA, 20 nt, Artificial Sequence
  targeting sequence with CTCN PAM
gacuacguuuguggugacug

SEQ ID NO: 11356 - RNA, 20 nt, Artificial Sequence
  targeting sequence with CTCN PAM
uaguggucucagacuacguu

SEQ ID NO: 11357 - RNA, 20 nt, Artificial Sequence
  targeting sequence with CTCN PAM
ugucaaaaguacaccacuac

SEQ ID NO: 11358 - RNA, 20 nt, Artificial Sequence
  targeting sequence with CTCN PAM
aagccugacgugguuuuccu

SEQ ID NO: 11359 - RNA, 20 nt, Artificial Sequence
  targeting sequence with CTCN PAM
ggcccuguuccugucauucc

SEQ ID NO: 11360 - RNA, 20 nt, Artificial Sequence
  targeting sequence with CTCN PAM
agugguuugucaccucuggc

SEQ ID NO: 11361 - RNA, 20 nt, Artificial Sequence
  targeting sequence with CTCN PAM
ucuccagugguuugucaccu

SEQ ID NO: 11362 - RNA, 20 nt, Artificial Sequence
  targeting sequence with CTCN PAM
gacucaucuccagugguuug

SEQ ID NO: 11363 - RNA, 20 nt, Artificial Sequence
  targeting sequence with CTCN PAM
cauccauaauucagcacauu

SEQ ID NO: 11364 - RNA, 20 nt, Artificial Sequence
  targeting sequence with CTCN PAM
cucccauccauaauucagca

SEQ ID NO: 11365 - RNA, 20 nt, Artificial Sequence
  targeting sequence with CTCN PAM
ccugcuuccacucauugaca

SEQ ID NO: 11366 - RNA, 20 nt, Artificial Sequence
  targeting sequence with CTCN PAM
uugacacaaaaaauucggua

SEQ ID NO: 11367 - RNA, 20 nt, Artificial Sequence
  targeting sequence with CTCN PAM
uaccgaauuuuuugugucaa

SEQ ID NO: 11368 - RNA, 20 nt, Artificial Sequence
  targeting sequence with CTCN PAM
auuggauacuuccacugcuu

SEQ ID NO: 11369 - RNA, 20 nt, Artificial Sequence
  targeting sequence with CTCN PAM
cacugaccuaaacaauaaau

SEQ ID NO: 11370 - RNA, 20 nt, Artificial Sequence
  targeting sequence with CTCN PAM
agcacccaaggcauuuaaaa

SEQ ID NO: 11371 - RNA, 20 nt, Artificial Sequence
  targeting sequence with CTCN PAM
gguauuuuccuauacaccca

SEQ ID NO: 11372 - RNA, 20 nt, Artificial Sequence
  targeting sequence with CTCN PAM
acgaucuucgggcaaaaacc

SEQ ID NO: 11373 - RNA, 20 nt, Artificial Sequence
  targeting sequence with CTCN PAM
uggucucuacgaucuucggg

SEQ ID NO: 11374 - RNA, 20 nt, Artificial Sequence
  targeting sequence with CTCN PAM
ccagucugcgguucuugcua

SEQ ID NO: 11375 - RNA, 20 nt, Artificial Sequence
  targeting sequence with CTCN PAM
agucugcgguucuugcuacc

SEQ ID NO: 11376 - RNA, 20 nt, Artificial Sequence
  targeting sequence with CTCN PAM
gcugaaggauacuucuccag

SEQ ID NO: 11377 - RNA, 20 nt, Artificial Sequence
  targeting sequence with CTCN PAM
agaaacuuccaaagcacagg

SEQ ID NO: 11378 - RNA, 20 nt, Artificial Sequence
  targeting sequence with CTCN PAM
aggugggcugauuucauguu

SEQ ID NO: 11379 - RNA, 20 nt, Artificial Sequence
  targeting sequence with CTCN PAM
uuaucugcugaucugaucau

SEQ ID NO: 11380 - RNA, 20 nt, Artificial Sequence
  targeting sequence with CTCN PAM
cauuaucugcugaucugauc

SEQ ID NO: 11381 - RNA, 20 nt, Artificial Sequence
  targeting sequence with CTCN PAM
uuauucuaaaaggucuguug

SEQ ID NO: 11382 - RNA, 20 nt, Artificial Sequence
  targeting sequence with CTCN PAM
acuaagacaaagaugauaau

SEQ ID NO: 11383 - RNA, 20 nt, Artificial Sequence
  targeting sequence with CTCN PAM
gguuuggggauuauuaucau

SEQ ID NO: 11384 - RNA, 20 nt, Artificial Sequence
  targeting sequence with CTCN PAM
aucggaccucagguuugggg

SEQ ID NO: 11385 - RNA, 20 nt, Artificial Sequence
  targeting sequence with CTCN PAM
ucgcuacuauauuucucaau

SEQ ID NO: 11386 - RNA, 20 nt, Artificial Sequence
  targeting sequence with CTCN PAM
uucaagaaacacuuuuucau

SEQ ID NO: 11387 - RNA, 20 nt, Artificial Sequence
  targeting sequence with CTCN PAM
gucaccuuuuaaucucguuc

SEQ ID NO: 11388 - RNA, 20 nt, Artificial Sequence
  targeting sequence with CTCN PAM
ucggucaccuuuuaaucucg

SEQ ID NO: 11389 - RNA, 20 nt, Artificial Sequence
  targeting sequence with CTCN PAM
uagccccccacgacguaaag

SEQ ID NO: 11390 - RNA, 20 nt, Artificial Sequence
  targeting sequence with CTCN PAM
auaaaguguuuacuuuuccu

SEQ ID NO: 11391 - RNA, 20 nt, Artificial Sequence
  targeting sequence with CTCN PAM
acuuuacagauaaggacauu

SEQ ID NO: 11392 - RNA, 20 nt, Artificial Sequence
  targeting sequence with CTCN PAM
auguccuuaucuguaaagug

SEQ ID NO: 11393 - RNA, 20 nt, Artificial Sequence
  targeting sequence with CTCN PAM
gugccucaauguccuuaucu

SEQ ID NO: 11394 - RNA, 20 nt, Artificial Sequence
  targeting sequence with CTCN PAM
agaucacacagauacuaagu

SEQ ID NO: 11395 - RNA, 20 nt, Artificial Sequence
  targeting sequence with CTCN PAM
uuaaccauacccucgcaauu

SEQ ID NO: 11396 - RNA, 20 nt, Artificial Sequence
  targeting sequence with CTCN PAM
caauuugaauaucaguuaau

SEQ ID NO: 11397 - RNA, 20 nt, Artificial Sequence
  targeting sequence with CTCN PAM
uuuuacaauauuuuugaugu

SEQ ID NO: 11398 - RNA, 20 nt, Artificial Sequence
  targeting sequence with CTCN PAM
auuuuacagaugaagaaagu

SEQ ID NO: 11399 - RNA, 20 nt, Artificial Sequence
  targeting sequence with CTCN PAM
uguugagaacuagacucuua

SEQ ID NO: 11400 - RNA, 20 nt, Artificial Sequence
  targeting sequence with CTCN PAM
acaugagaugaaguacucuu

SEQ ID NO: 11401 - RNA, 20 nt, Artificial Sequence
  targeting sequence with CTCN PAM
uaccacaaaaaaaaguuuuu

SEQ ID NO: 11402 - RNA, 20 nt, Artificial Sequence
  targeting sequence with CTCN PAM
aagcuuucuucaagaagcuc

SEQ ID NO: 11403 - RNA, 20 nt, Artificial Sequence
  targeting sequence with CTCN PAM
aggcuguuuccccacaggag

SEQ ID NO: 11404 - RNA, 20 nt, Artificial Sequence
  targeting sequence with CTCN PAM
uguggggaaacagccuggag

SEQ ID NO: 11405 - RNA, 20 nt, Artificial Sequence
  targeting sequence with CTCN PAM
uuuaaagaauaauaauuuua

SEQ ID NO: 11406 - RNA, 20 nt, Artificial Sequence
  targeting sequence with CTCN PAM
aaaggucucccuuuuaucuc

SEQ ID NO: 11407 - RNA, 20 nt, Artificial Sequence
  targeting sequence with CTCN PAM
cuuuuaucucuuauucacug

SEQ ID NO: 11408 - RNA, 20 nt, Artificial Sequence
  targeting sequence with CTCN PAM
uauucacugagguauuauaa

SEQ ID NO: 11409 - RNA, 20 nt, Artificial Sequence
  targeting sequence with CTCN PAM
gugaauaagagauaaaaggg

SEQ ID NO: 11410 - RNA, 20 nt, Artificial Sequence
  targeting sequence with CTCN PAM
uaauacagaauucagaacuu

SEQ ID NO: 11411 - RNA, 20 nt, Artificial Sequence
  targeting sequence with CTCN PAM
aaauaauucaaaaguauaau

SEQ ID NO: 11412 - RNA, 20 nt, Artificial Sequence
  targeting sequence with CTCN PAM
aaagcauuuuagagaagcau

SEQ ID NO: 11413 - RNA, 20 nt, Artificial Sequence
  targeting sequence with CTCN PAM
aaaaugcuuuagagcucuaa

SEQ ID NO: 11414 - RNA, 20 nt, Artificial Sequence
  targeting sequence with CTCN PAM
ccagugaagucuuuccuggu

SEQ ID NO: 11415 - RNA, 20 nt, Artificial Sequence
  targeting sequence with CTCN PAM
ccaaccaggaaagacuucac

SEQ ID NO: 11416 - RNA, 20 nt, Artificial Sequence
  targeting sequence with CTCN PAM
gaaauggacaacaacugcuc

SEQ ID NO: 11417 - RNA, 20 nt, Artificial Sequence
  targeting sequence with CTCN PAM
uacuucucguuguguucuga

SEQ ID NO: 11418 - RNA, 20 nt, Artificial Sequence
  targeting sequence with CTCN PAM
uuguguucugagucuuuggc

SEQ ID NO: 11419 - RNA, 20 nt, Artificial Sequence
  targeting sequence with CTCN PAM
gaacacaacgagaaguauga

SEQ ID NO: 11420 - RNA, 20 nt, Artificial Sequence
  targeting sequence with CTCN PAM
augaucuuucuuuuuuuuuu

SEQ ID NO: 11421 - RNA, 20 nt, Artificial Sequence
  targeting sequence with CTCN PAM
uccuacauccuuuuuuaguu

SEQ ID NO: 11422 - RNA, 20 nt, Artificial Sequence
  targeting sequence with CTCN PAM
ucuucuuucaaaagcaaaug

SEQ ID NO: 11423 - RNA, 20 nt, Artificial Sequence
  targeting sequence with CTCN PAM
uuugcuuuugaaagaagaug

SEQ ID NO: 11424 - RNA, 20 nt, Artificial Sequence
  targeting sequence with CTCN PAM
aacuuuacuuccacucauuu

SEQ ID NO: 11425 - RNA, 20 nt, Artificial Sequence
  targeting sequence with CTCN PAM
ggacccgaagcaagugcaaa

SEQ ID NO: 11426 - RNA, 20 nt, Artificial Sequence
  targeting sequence with CTCN PAM
uaagccagaagauuuugauu

SEQ ID NO: 11427 - RNA, 20 nt, Artificial Sequence
  targeting sequence with CTCN PAM
ccauuuuugugaagauaauu

SEQ ID NO: 11428 - RNA, 20 nt, Artificial Sequence
  targeting sequence with CTCN PAM
auuuuugugaagauaauuag

SEQ ID NO: 11429 - RNA, 20 nt, Artificial Sequence
  targeting sequence with CTCN PAM
uuuucauuuuuaaaugacag

SEQ ID NO: 11430 - RNA, 20 nt, Artificial Sequence
  targeting sequence with CTCN PAM
uucccauccacaugggacag

SEQ ID NO: 11431 - RNA, 20 nt, Artificial Sequence
  targeting sequence with CTCN PAM
ucuucucccacucuuuccaa

SEQ ID NO: 11432 - RNA, 20 nt, Artificial Sequence
  targeting sequence with CTCN PAM
cacucuuuccaauuccauag

SEQ ID NO: 11433 - RNA, 20 nt, Artificial Sequence
  targeting sequence with CTCN PAM
uuccaauuccauagcaacau

SEQ ID NO: 11434 - RNA, 20 nt, Artificial Sequence
  targeting sequence with CTCN PAM
uuuuaauauggauaaucuau

SEQ ID NO: 11435 - RNA, 20 nt, Artificial Sequence
  targeting sequence with CTCN PAM
cucauuuuaauauggauaau

SEQ ID NO: 11436 - RNA, 20 nt, Artificial Sequence
  targeting sequence with CTCN PAM
cauagcacaagacuggucca

SEQ ID NO: 11437 - RNA, 20 nt, Artificial Sequence
  targeting sequence with CTCN PAM
gcacaacaaaaaagucaagc

SEQ ID NO: 11438 - RNA, 20 nt, Artificial Sequence
  targeting sequence with CTCN PAM
gugauuaauccgaaaaguuu

SEQ ID NO: 11439 - RNA, 20 nt, Artificial Sequence
  targeting sequence with CTCN PAM
aauuuaugguaagugccccc

SEQ ID NO: 11440 - RNA, 20 nt, Artificial Sequence
  targeting sequence with CTCN PAM
uaagcaccagaaaaugcuua

SEQ ID NO: 11441 - RNA, 20 nt, Artificial Sequence
  targeting sequence with CTCN PAM
cugauuuauuuaagcauuuu

SEQ ID NO: 11442 - RNA, 20 nt, Artificial Sequence
  targeting sequence with CTCN PAM
gcaaauaaaugagguaaaag

SEQ ID NO: 11443 - RNA, 20 nt, Artificial Sequence
  targeting sequence with CTCN PAM
uuuauuugcagagaagacag

SEQ ID NO: 11444 - RNA, 20 nt, Artificial Sequence
  targeting sequence with CTCN PAM
cagaaauuuuacauuaugua

SEQ ID NO: 11445 - RNA, 20 nt, Artificial Sequence
  targeting sequence with CTCN PAM
cccagaaauuuuacauuaug

SEQ ID NO: 11446 - RNA, 20 nt, Artificial Sequence
  targeting sequence with CTCN PAM
cucccagaaauuuuacauua

SEQ ID NO: 11447 - RNA, 20 nt, Artificial Sequence
  targeting sequence with CTCN PAM
agaagguaaauaauuugaua

SEQ ID NO: 11448 - RNA, 20 nt, Artificial Sequence
  targeting sequence with CTCN PAM
ugguaaccuuguagguacaa

SEQ ID NO: 11449 - RNA, 20 nt, Artificial Sequence
  targeting sequence with CTCN PAM
caauuuauugauaaaauuga

SEQ ID NO: 11450 - RNA, 20 nt, Artificial Sequence
  targeting sequence with CTCN PAM
auuuauugauaaaauugagu

SEQ ID NO: 11451 - RNA, 20 nt, Artificial Sequence
  targeting sequence with CTCN PAM
auuuuaucaauaaauugaga

SEQ ID NO: 11452 - RNA, 20 nt, Artificial Sequence
  targeting sequence with CTCN PAM
ugucuguucugcaaguaauu

SEQ ID NO: 11453 - RNA, 20 nt, Artificial Sequence
  targeting sequence with CTCN PAM
cccauacuguuauugaaaaa

SEQ ID NO: 11454 - RNA, 20 nt, Artificial Sequence
  targeting sequence with CTCN PAM
uuccuguaaugcuagcacuu

SEQ ID NO: 11455 - RNA, 20 nt, Artificial Sequence
  targeting sequence with CTCN PAM
caaagugcuagcauuacagg

SEQ ID NO: 11456 - RNA, 20 nt, Artificial Sequence
  targeting sequence with CTCN PAM
ucccaaagugcuagcauuac

SEQ ID NO: 11457 - RNA, 20 nt, Artificial Sequence
  targeting sequence with CTCN PAM
ugggaucaggugaucuuccc

SEQ ID NO: 11458 - RNA, 20 nt, Artificial Sequence
  targeting sequence with CTCN PAM
aacucuugggaucaggugau

SEQ ID NO: 11459 - RNA, 20 nt, Artificial Sequence
  targeting sequence with CTCN PAM
aggcuggucucaaacucuug

SEQ ID NO: 11460 - RNA, 20 nt, Artificial Sequence
  targeting sequence with CTCN PAM
ccaggcuggucucaaacucu

SEQ ID NO: 11461 - RNA, 20 nt, Artificial Sequence
  targeting sequence with CTCN PAM
cugugcucuccaggcugguc

SEQ ID NO: 11462 - RNA, 20 nt, Artificial Sequence
  targeting sequence with CTCN PAM
ucuuugcaaaaaaugaaaaa

SEQ ID NO: 11463 - RNA, 20 nt, Artificial Sequence
  targeting sequence with CTCN PAM
accacgcccgguugcuuguu

SEQ ID NO: 11464 - RNA, 20 nt, Artificial Sequence
  targeting sequence with CTCN PAM
uuaguagcugggaccacagg

SEQ ID NO: 11465 - RNA, 20 nt, Artificial Sequence
  targeting sequence with CTCN PAM
uaccccggccuccuuaguag

SEQ ID NO: 11466 - RNA, 20 nt, Artificial Sequence
  targeting sequence with CTCN PAM
cugaagccuugaccugccgg

SEQ ID NO: 11467 - RNA, 20 nt, Artificial Sequence
  targeting sequence with CTCN PAM
agccugggugacagagcgag

SEQ ID NO: 11468 - RNA, 20 nt, Artificial Sequence
  targeting sequence with CTCN PAM
gucacccaggcuggagugca

SEQ ID NO: 11469 - RNA, 20 nt, Artificial Sequence
  targeting sequence with CTCN PAM
cucugucacccaggcuggag

SEQ ID NO: 11470 - RNA, 20 nt, Artificial Sequence
  targeting sequence with CTCN PAM
ucucaaaaaaaaacccacua

SEQ ID NO: 11471 - RNA, 20 nt, Artificial Sequence
  targeting sequence with CTCN PAM
aaaaaaaacccacuaaacua

SEQ ID NO: 11472 - RNA, 20 nt, Artificial Sequence
  targeting sequence with CTCN PAM
agacccauccaccuuuuaca

SEQ ID NO: 11473 - RNA, 20 nt, Artificial Sequence
  targeting sequence with CTCN PAM
cuagacccauccaccuuuua

SEQ ID NO: 11474 - RNA, 20 nt, Artificial Sequence
  targeting sequence with CTCN PAM
aaauuauuuuaccccaaauu

SEQ ID NO: 11475 - RNA, 20 nt, Artificial Sequence
  targeting sequence with CTCN PAM
ucaaaauuauuuuaccccaa

SEQ ID NO: 11476 - RNA, 20 nt, Artificial Sequence
  targeting sequence with CTCN PAM
aaaauuguaaacaauaucau

SEQ ID NO: 11477 - RNA, 20 nt, Artificial Sequence
  targeting sequence with CTCN PAM
uaagagacuggggcucaaau

SEQ ID NO: 11478 - RNA, 20 nt, Artificial Sequence
  targeting sequence with CTCN PAM
uaagaguuugugcugauucc

SEQ ID NO: 11479 - RNA, 20 nt, Artificial Sequence
  targeting sequence with CTCN PAM
aauuccagcucuaccagcug

SEQ ID NO: 11480 - RNA, 20 nt, Artificial Sequence
  targeting sequence with CTCN PAM
accagcuguaaguuuagcag

SEQ ID NO: 11481 - RNA, 20 nt, Artificial Sequence
  targeting sequence with CTCN PAM
aagucucgguaaaagacucu

SEQ ID NO: 11482 - RNA, 20 nt, Artificial Sequence
  targeting sequence with CTCN PAM
guaaaagacucuguaaaaag

SEQ ID NO: 11483 - RNA, 20 nt, Artificial Sequence
  targeting sequence with CTCN PAM
guaaaaagaaggugaugccu

SEQ ID NO: 11484 - RNA, 20 nt, Artificial Sequence
  targeting sequence with CTCN PAM
uucaaaguaguucuuaguau

SEQ ID NO: 11485 - RNA, 20 nt, Artificial Sequence
  targeting sequence with CTCN PAM
uaucacacacguagucuaau

SEQ ID NO: 11486 - RNA, 20 nt, Artificial Sequence
  targeting sequence with CTCN PAM
aaccccaaggggaccucuuu

SEQ ID NO: 11487 - RNA, 20 nt, Artificial Sequence
  targeting sequence with CTCN PAM
uucacaaaaccucccggcuc

SEQ ID NO: 11488 - RNA, 20 nt, Artificial Sequence
  targeting sequence with CTCN PAM
cggcucccccccagucuccc

SEQ ID NO: 11489 - RNA, 20 nt, Artificial Sequence
  targeting sequence with CTCN PAM
cccccagucucccuagucau

SEQ ID NO: 11490 - RNA, 20 nt, Artificial Sequence
  targeting sequence with CTCN PAM
cuagucaucuuagaugagga

SEQ ID NO: 11491 - RNA, 20 nt, Artificial Sequence
  targeting sequence with CTCN PAM
ucuaagaugacuagggagac

SEQ ID NO: 11492 - RNA, 20 nt, Artificial Sequence
  targeting sequence with CTCN PAM
acuuccucaucuaagaugac

SEQ ID NO: 11493 - RNA, 20 nt, Artificial Sequence
  targeting sequence with CTCN PAM
uccugugcgaucagcccugg

SEQ ID NO: 11494 - RNA, 20 nt, Artificial Sequence
  targeting sequence with CTCN PAM
agacccuaguaacuaaaccc

SEQ ID NO: 11495 - RNA, 20 nt, Artificial Sequence
  targeting sequence with CTCN PAM
aagcccacggguuuaguuac

SEQ ID NO: 11496 - RNA, 20 nt, Artificial Sequence
  targeting sequence with CTCN PAM
gucaaagguuagaaaggccc

SEQ ID NO: 11497 - RNA, 20 nt, Artificial Sequence
  targeting sequence with CTCN PAM
cccgauaccauuuuacaggu

SEQ ID NO: 11498 - RNA, 20 nt, Artificial Sequence
  targeting sequence with CTCN PAM
cgauaccauuuuacaggugg

SEQ ID NO: 11499 - RNA, 20 nt, Artificial Sequence
  targeting sequence with CTCN PAM
guuucaccaccuguaaaaug

SEQ ID NO: 11500 - RNA, 20 nt, Artificial Sequence
  targeting sequence with CTCN PAM
gguaaguuacuguccccuuu

SEQ ID NO: 11501 - RNA, 20 nt, Artificial Sequence
  targeting sequence with CTCN PAM
cuagaggugacggugggggc

SEQ ID NO: 11502 - RNA, 20 nt, Artificial Sequence
  targeting sequence with CTCN PAM
agugagcgccuagucccaga

SEQ ID NO: 11503 - RNA, 20 nt, Artificial Sequence
  targeting sequence with CTCN PAM
gcggucccccagacucagac

SEQ ID NO: 11504 - RNA, 20 nt, Artificial Sequence
  targeting sequence with CTCN PAM
gacucuccagcccagucgug

SEQ ID NO: 11505 - RNA, 20 nt, Artificial Sequence
  targeting sequence with CTCN PAM
ccagcccagucgugcccauc

SEQ ID NO: 11506 - RNA, 20 nt, Artificial Sequence
  targeting sequence with CTCN PAM
agcccagucgugcccaucga

SEQ ID NO: 11507 - RNA, 20 nt, Artificial Sequence
  targeting sequence with CTCN PAM
augggcacgacugggcugga

SEQ ID NO: 11508 - RNA, 20 nt, Artificial Sequence
  targeting sequence with CTCN PAM
uugcugcagccggacccugc

SEQ ID NO: 11509 - RNA, 20 nt, Artificial Sequence
  targeting sequence with CTCN PAM
gccccacacccugggcguug

SEQ ID NO: 11510 - RNA, 20 nt, Artificial Sequence
  targeting sequence with CTCN PAM
ucagcucacggcaccgggcu

SEQ ID NO: 11511 - RNA, 20 nt, Artificial Sequence
  targeting sequence with CTCN PAM
cggcaccgggcugcaaccga

SEQ ID NO: 11512 - RNA, 20 nt, Artificial Sequence
  targeting sequence with CTCN PAM
guugcagcccggugccguga

SEQ ID NO: 11513 - RNA, 20 nt, Artificial Sequence
  targeting sequence with CTCN PAM
gcuacagccgccauuuccac

SEQ ID NO: 11514 - RNA, 20 nt, Artificial Sequence
  targeting sequence with CTCN PAM
accaaucaaauccauucucg

SEQ ID NO: 11515 - RNA, 20 nt, Artificial Sequence
  targeting sequence with CTCN PAM
aggaagacgcaccgccccca

SEQ ID NO: 11516 - RNA, 20 nt, Artificial Sequence
  targeting sequence with CTCN PAM
agaauggauuugauuggugg

SEQ ID NO: 11517 - RNA, 20 nt, Artificial Sequence
  targeting sequence with CTCN PAM
cgcucugguugcgcuggcgc

SEQ ID NO: 11518 - RNA, 20 nt, Artificial Sequence
  targeting sequence with CTCN PAM
gguugcgcuggcgccuuagg

SEQ ID NO: 11519 - RNA, 20 nt, Artificial Sequence
  targeting sequence with CTCN PAM
agugccaccauugcuuuugc

SEQ ID NO: 11520 - RNA, 20 nt, Artificial Sequence
  targeting sequence with CTCN PAM
gagcaaggcgcccucgcacu

SEQ ID NO: 11521 - RNA, 20 nt, Artificial Sequence
  targeting sequence with CTCN PAM
gagcgcgcauguccgaaagg

SEQ ID NO: 11522 - RNA, 20 nt, Artificial Sequence
  targeting sequence with CTCN PAM
cacucagcuuaccgcgcaug

SEQ ID NO: 11523 - RNA, 20 nt, Artificial Sequence
  targeting sequence with CTCN PAM
gcuuaccgcgcauguacguu

SEQ ID NO: 11524 - RNA, 20 nt, Artificial Sequence
  targeting sequence with CTCN PAM
acaagccacuuuggcuaccu

SEQ ID NO: 11525 - RNA, 20 nt, Artificial Sequence
  targeting sequence with CTCN PAM
cuaacggucgccacuccaca

SEQ ID NO: 11526 - RNA, 20 nt, Artificial Sequence
  targeting sequence with CTCN PAM
gcaaccgccucacuaacggu

SEQ ID NO: 11527 - RNA, 20 nt, Artificial Sequence
  targeting sequence with CTCN PAM
gcgucugucucagcaaccgc

SEQ ID NO: 11528 - RNA, 20 nt, Artificial Sequence
  targeting sequence with CTCN PAM
uacccgccucagcgucuguc

SEQ ID NO: 11529 - RNA, 20 nt, Artificial Sequence
  targeting sequence with CTCN PAM
uccuacccgccucagcgucu

SEQ ID NO: 11530 - RNA, 20 nt, Artificial Sequence
  targeting sequence with CTCN PAM
ggcuccuccuacccgccuca

SEQ ID NO: 11531 - RNA, 20 nt, Artificial Sequence
  targeting sequence with CTCN PAM
ucacggcuucccuuacggcu

SEQ ID NO: 11532 - RNA, 20 nt, Artificial Sequence
  targeting sequence with CTCN PAM
acgucaacacggcccucauc

SEQ ID NO: 11533 - RNA, 20 nt, Artificial Sequence
  targeting sequence with CTCN PAM
ccacgucaacacggcccuca

SEQ ID NO: 11534 - RNA, 20 nt, Artificial Sequence
  targeting sequence with CTCN PAM
gcuuuaucucuccacgucaa

SEQ ID NO: 11535 - RNA, 20 nt, Artificial Sequence
  targeting sequence with CTCN PAM
ccagugcucggcuuuaucuc

SEQ ID NO: 11536 - RNA, 20 nt, Artificial Sequence
  targeting sequence with CTCN PAM
ucaccagugcucggcuuuau

SEQ ID NO: 11537 - RNA, 20 nt, Artificial Sequence
  targeting sequence with CTCN PAM
ucgcgaaccgccccgcuccu

SEQ ID NO: 11538 - RNA, 20 nt, Artificial Sequence
  targeting sequence with CTCN PAM
ugcucuucgcgaaccgcccc

SEQ ID NO: 11539 - RNA, 20 nt, Artificial Sequence
  targeting sequence with CTCN PAM
accuccugcucuucgcgaac

SEQ ID NO: 11540 - RNA, 20 nt, Artificial Sequence
  targeting sequence with CTCN PAM
cggggagugcgcgagccgcu

SEQ ID NO: 11541 - RNA, 20 nt, Artificial Sequence
  targeting sequence with CTCN PAM
ccgcgaggacucgaccuccu

SEQ ID NO: 11542 - RNA, 20 nt, Artificial Sequence
  targeting sequence with CTCN PAM
cgcacuccccgcgaggacuc

SEQ ID NO: 11543 - RNA, 20 nt, Artificial Sequence
  targeting sequence with CTCN PAM
aacacgcugcagcggcucgc

SEQ ID NO: 11544 - RNA, 20 nt, Artificial Sequence
  targeting sequence with CTCN PAM
gcccaggcagcaagcccgcu

SEQ ID NO: 11545 - RNA, 20 nt, Artificial Sequence
  targeting sequence with CTCN PAM
caggccgggguucagugccc

SEQ ID NO: 11546 - RNA, 20 nt, Artificial Sequence
  targeting sequence with CTCN PAM
cgccccuuggcgguuggaga

SEQ ID NO: 11547 - RNA, 20 nt, Artificial Sequence
  targeting sequence with CTCN PAM
aaccgccaaggggcgggagg

SEQ ID NO: 11548 - RNA, 20 nt, Artificial Sequence
  targeting sequence with CTCN PAM
cgaggguuggagagcggcaa

SEQ ID NO: 11549 - RNA, 20 nt, Artificial Sequence
  targeting sequence with CTCN PAM
ggaguuucuccaaccgccaa

SEQ ID NO: 11550 - RNA, 20 nt, Artificial Sequence
  targeting sequence with CTCN PAM
aacccucgggaguuucucca

SEQ ID NO: 11551 - RNA, 20 nt, Artificial Sequence
  targeting sequence with CTCN PAM
ccaacccucgggaguuucuc

SEQ ID NO: 11552 - RNA, 20 nt, Artificial Sequence
  targeting sequence with CTCN PAM
cuuugccgcucuccaacccu

SEQ ID NO: 11553 - RNA, 20 nt, Artificial Sequence
  targeting sequence with CTCN PAM
ggcgcggcaccucccuuugc

SEQ ID NO: 11554 - RNA, 20 nt, Artificial Sequence
  targeting sequence with CTCN PAM
acccgccaccaccucaggcg

SEQ ID NO: 11555 - RNA, 20 nt, Artificial Sequence
  targeting sequence with CTCN PAM
ucccucacggucuggcccug

SEQ ID NO: 11556 - RNA, 20 nt, Artificial Sequence
  targeting sequence with CTCN PAM
cggucuggcccugucgcugc

SEQ ID NO: 11557 - RNA, 20 nt, Artificial Sequence
  targeting sequence with CTCN PAM
cacccacgagacagcacgaa

SEQ ID NO: 11558 - RNA, 20 nt, Artificial Sequence
  targeting sequence with CTCN PAM
ugggugugagaugaauccaa

SEQ ID NO: 11559 - RNA, 20 nt, Artificial Sequence
  targeting sequence with CTCN PAM
agcuucacaguucuugccac

SEQ ID NO: 11560 - RNA, 20 nt, Artificial Sequence
  targeting sequence with CTCN PAM
uguuuucuugacguuuuucu

SEQ ID NO: 11561 - RNA, 20 nt, Artificial Sequence
  targeting sequence with CTCN PAM
aaauugucucauuuauuuua

SEQ ID NO: 11562 - RNA, 20 nt, Artificial Sequence
  targeting sequence with CTCN PAM
uuuauuuuaauuaugauuuc

SEQ ID NO: 11563 - RNA, 20 nt, Artificial Sequence
  targeting sequence with CTCN PAM
auuuaugaaaaccaguguca

SEQ ID NO: 11564 - RNA, 20 nt, Artificial Sequence
  targeting sequence with CTCN PAM
aaauguuaagauaaaaucag

SEQ ID NO: 11565 - RNA, 20 nt, Artificial Sequence
  targeting sequence with CTCN PAM
aaguguaaaaguaaaacuua

SEQ ID NO: 11566 - RNA, 20 nt, Artificial Sequence
  targeting sequence with CTCN PAM
cuacuuuaaguuuuacuuuu

SEQ ID NO: 11567 - RNA, 20 nt, Artificial Sequence
  targeting sequence with CTCN PAM
cuagcaacaauagcuagcua

SEQ ID NO: 11568 - RNA, 20 nt, Artificial Sequence
  targeting sequence with CTCN PAM
gguuuaaaggcucccuagca

SEQ ID NO: 11569 - RNA, 20 nt, Artificial Sequence
  targeting sequence with CTCN PAM
uuucucuaaaacuggagaug

SEQ ID NO: 11570 - RNA, 20 nt, Artificial Sequence
  targeting sequence with CTCN PAM
aaaacuggagaugggcaggu

SEQ ID NO: 11571 - RNA, 20 nt, Artificial Sequence
  targeting sequence with CTCN PAM
aguuuuagagaaacgagauc

SEQ ID NO: 11572 - RNA, 20 nt, Artificial Sequence
  targeting sequence with CTCN PAM
aaaugagcaccaaacacaag

SEQ ID NO: 11573 - RNA, 20 nt, Artificial Sequence
  targeting sequence with CTCN PAM
uuuugagcaccuuucugauc

SEQ ID NO: 11574 - RNA, 20 nt, Artificial Sequence
  targeting sequence with CTCN PAM
ccuaauugggaagucugaaa

SEQ ID NO: 11575 - RNA, 20 nt, Artificial Sequence
  targeting sequence with CTCN PAM
uaauugggaagucugaaaaa

SEQ ID NO: 11576 - RNA, 20 nt, Artificial Sequence
  targeting sequence with CTCN PAM
guucuggccacuggagcagg

SEQ ID NO: 11577 - RNA, 20 nt, Artificial Sequence
  targeting sequence with CTCN PAM
aguggccagaacagaggcuu

SEQ ID NO: 11578 - RNA, 20 nt, Artificial Sequence
  targeting sequence with CTCN PAM
gaagggacagaaccaaagac

SEQ ID NO: 11579 - RNA, 20 nt, Artificial Sequence
  targeting sequence with CTCN PAM
guguaaagcaugccgucucu

SEQ ID NO: 11580 - RNA, 20 nt, Artificial Sequence
  targeting sequence with CTCN PAM
ccucaucucacacggaaauc

SEQ ID NO: 11581 - RNA, 20 nt, Artificial Sequence
  targeting sequence with CTCN PAM
ucaucucacacggaaauccu

SEQ ID NO: 11582 - RNA, 20 nt, Artificial Sequence
  targeting sequence with CTCN PAM
ucucacacggaaauccugaa

SEQ ID NO: 11583 - RNA, 20 nt, Artificial Sequence
  targeting sequence with CTCN PAM
cacggaaauccugaacaucc

SEQ ID NO: 11584 - RNA, 20 nt, Artificial Sequence
  targeting sequence with CTCN PAM
cguuggagacggguccucuc

SEQ ID NO: 11585 - RNA, 20 nt, Artificial Sequence
  targeting sequence with CTCN PAM
aacgugagccuugaaggaug

SEQ ID NO: 11586 - RNA, 20 nt, Artificial Sequence
  targeting sequence with CTCN PAM
cuuuuguguucggcacuagu

SEQ ID NO: 11587 - RNA, 20 nt, Artificial Sequence
  targeting sequence with CTCN PAM
uuuguguucggcacuagugg

SEQ ID NO: 11588 - RNA, 20 nt, Artificial Sequence
  targeting sequence with CTCN PAM
uugugucuucaccacucucu

SEQ ID NO: 11589 - RNA, 20 nt, Artificial Sequence
  targeting sequence with CTCN PAM
cuaagguagguacuauaauu

SEQ ID NO: 11590 - RNA, 20 nt, Artificial Sequence
  targeting sequence with CTCN PAM
aagguagguacuauaauuuc

SEQ ID NO: 11591 - RNA, 20 nt, Artificial Sequence
  targeting sequence with CTCN PAM
auuuuauguaugaggaaacu

SEQ ID NO: 11592 - RNA, 20 nt, Artificial Sequence
  targeting sequence with CTCN PAM
uacauaaaauagaggaaauu

SEQ ID NO: 11593 - RNA, 20 nt, Artificial Sequence
  targeting sequence with CTCN PAM
gggcuucaguuuccucauac

SEQ ID NO: 11594 - RNA, 20 nt, Artificial Sequence
  targeting sequence with CTCN PAM
cugggcuucaguuuccucau

SEQ ID NO: 11595 - RNA, 20 nt, Artificial Sequence
  targeting sequence with CTCN PAM
cugugugacgcuggcaaauu

SEQ ID NO: 11596 - RNA, 20 nt, Artificial Sequence
  targeting sequence with CTCN PAM
ggucuuccucacuccaacgu

SEQ ID NO: 11597 - RNA, 20 nt, Artificial Sequence
  targeting sequence with CTCN PAM
cuccaacgucaacgcucuca

SEQ ID NO: 11598 - RNA, 20 nt, Artificial Sequence
  targeting sequence with CTCN PAM
aacgucaacgcucucagcca

SEQ ID NO: 11599 - RNA, 20 nt, Artificial Sequence
  targeting sequence with CTCN PAM
cagccacuacauuaauuuuu

SEQ ID NO: 11600 - RNA, 20 nt, Artificial Sequence
  targeting sequence with CTCN PAM
gccacuacauuaauuuuucc

SEQ ID NO: 11601 - RNA, 20 nt, Artificial Sequence
  targeting sequence with CTCN PAM
aaugucugcaggagacaggc

SEQ ID NO: 11602 - RNA, 20 nt, Artificial Sequence
  targeting sequence with CTCN PAM
ugcagacauuugaguuugcc

SEQ ID NO: 11603 - RNA, 20 nt, Artificial Sequence
  targeting sequence with CTCN PAM
cauuuauguuaccugccugu

SEQ ID NO: 11604 - RNA, 20 nt, Artificial Sequence
  targeting sequence with CTCN PAM
auuaaaaguacaaaugaaag

SEQ ID NO: 11605 - RNA, 20 nt, Artificial Sequence
  targeting sequence with CTCN PAM
aaucucuauuaaaaguacaa

SEQ ID NO: 11606 - RNA, 20 nt, Artificial Sequence
  targeting sequence with CTCN PAM
gacauugaagccaaauguuc

SEQ ID NO: 11607 - RNA, 20 nt, Artificial Sequence
  targeting sequence with CTCN PAM
auuacucugacauugaagcc

SEQ ID NO: 11608 - RNA, 20 nt, Artificial Sequence
  targeting sequence with CTCN PAM
gcaguuugccacacucuauu

SEQ ID NO: 11609 - RNA, 20 nt, Artificial Sequence
  targeting sequence with CTCN PAM
ugcucggccuaaaaggggca

SEQ ID NO: 11610 - RNA, 20 nt, Artificial Sequence
  targeting sequence with CTCN PAM
gccuaaaaggggcagcugcu

SEQ ID NO: 11611 - RNA, 20 nt, Artificial Sequence
  targeting sequence with CTCN PAM
gcuccugccaauuaccacca

SEQ ID NO: 11612 - RNA, 20 nt, Artificial Sequence
  targeting sequence with CTCN PAM
ugccaauuaccaccaugcag

SEQ ID NO: 11613 - RNA, 20 nt, Artificial Sequence
  targeting sequence with CTCN PAM
gcucuuccuguuuuuaccag

SEQ ID NO: 11614 - RNA, 20 nt, Artificial Sequence
  targeting sequence with CTCN PAM
uccuguuuuuaccagaagcu

SEQ ID NO: 11615 - RNA, 20 nt, Artificial Sequence
  targeting sequence with CTCN PAM
gaaaaaaaaacaaaacaccg

SEQ ID NO: 11616 - RNA, 20 nt, Artificial Sequence
  targeting sequence with CTCN PAM
guuuucaaccccuggcacag

SEQ ID NO: 11617 - RNA, 20 nt, Artificial Sequence
  targeting sequence with CTCN PAM
cuugugguacuuccagaguc

SEQ ID NO: 11618 - RNA, 20 nt, Artificial Sequence
  targeting sequence with CTCN PAM
ugugguacuuccagagucug

SEQ ID NO: 11619 - RNA, 20 nt, Artificial Sequence
  targeting sequence with CTCN PAM
ggaaguaccacaagagagaa

SEQ ID NO: 11620 - RNA, 20 nt, Artificial Sequence
  targeting sequence with CTCN PAM
acagacucuggaaguaccac

SEQ ID NO: 11621 - RNA, 20 nt, Artificial Sequence
  targeting sequence with CTCN PAM
uaugcucaacagacucugga

SEQ ID NO: 11622 - RNA, 20 nt, Artificial Sequence
  targeting sequence with CTCN PAM
uuuccaaauuauucuagaga

SEQ ID NO: 11623 - RNA, 20 nt, Artificial Sequence
  targeting sequence with CTCN PAM
agaauaauuuggaaacgagu

SEQ ID NO: 11624 - RNA, 20 nt, Artificial Sequence
  targeting sequence with CTCN PAM
aaucuguaaugggccaaaaa

SEQ ID NO: 11625 - RNA, 20 nt, Artificial Sequence
  targeting sequence with CTCN PAM
acauccaaaucagccauugu

SEQ ID NO: 11626 - RNA, 20 nt, Artificial Sequence
  targeting sequence with CTCN PAM
cggucugcuccuuugcuucu

SEQ ID NO: 11627 - RNA, 20 nt, Artificial Sequence
  targeting sequence with CTCN PAM
uuugcuucuauuuuaaccuu

SEQ ID NO: 11628 - RNA, 20 nt, Artificial Sequence
  targeting sequence with CTCN PAM
guuuuuuuaagaccugcugc

SEQ ID NO: 11629 - RNA, 20 nt, Artificial Sequence
  targeting sequence with CTCN PAM
acuucucauaaaccuagagu

SEQ ID NO: 11630 - RNA, 20 nt, Artificial Sequence
  targeting sequence with CTCN PAM
uaaaccuagagugauuccca

SEQ ID NO: 11631 - RNA, 20 nt, Artificial Sequence
  targeting sequence with CTCN PAM
agguuuaugagaaguagagu

SEQ ID NO: 11632 - RNA, 20 nt, Artificial Sequence
  targeting sequence with CTCN PAM
agcaaaaugcacgacuugac

SEQ ID NO: 11633 - RNA, 20 nt, Artificial Sequence
  targeting sequence with CTCN PAM
ugacccuccuccccaucagg

SEQ ID NO: 11634 - RNA, 20 nt, Artificial Sequence
  targeting sequence with CTCN PAM
uccccaucaggcuugcaaca

SEQ ID NO: 11635 - RNA, 20 nt, Artificial Sequence
  targeting sequence with CTCN PAM
ccaucaggcuugcaacauuu

SEQ ID NO: 11636 - RNA, 20 nt, Artificial Sequence
  targeting sequence with CTCN PAM
accuaaaaguauaaauuuaa

SEQ ID NO: 11637 - RNA, 20 nt, Artificial Sequence
  targeting sequence with CTCN PAM
auuuuucuacccgaagaucc

SEQ ID NO: 11638 - RNA, 20 nt, Artificial Sequence
  targeting sequence with CTCN PAM
cuuauucuaugaacucccua

SEQ ID NO: 11639 - RNA, 20 nt, Artificial Sequence
  targeting sequence with CTCN PAM
cuaguuuucuccuuuaaaug

SEQ ID NO: 11640 - RNA, 20 nt, Artificial Sequence
  targeting sequence with CTCN PAM
uuuaaaugcacagcuccagg

SEQ ID NO: 11641 - RNA, 20 nt, Artificial Sequence
  targeting sequence with CTCN PAM
agguucaucucaaccaggau

SEQ ID NO: 11642 - RNA, 20 nt, Artificial Sequence
  targeting sequence with CTCN PAM
accaggaugucuuauuaggc

SEQ ID NO: 11643 - RNA, 20 nt, Artificial Sequence
  targeting sequence with CTCN PAM
cauguuguagagauuaaaca

SEQ ID NO: 11644 - RNA, 20 nt, Artificial Sequence
  targeting sequence with CTCN PAM
uuuaaagaugaagaaauuga

SEQ ID NO: 11645 - RNA, 20 nt, Artificial Sequence
  targeting sequence with CTCN PAM
auuucuucaucuuuaaauga

SEQ ID NO: 11646 - RNA, 20 nt, Artificial Sequence
  targeting sequence with CTCN PAM
uuaaaucucaauuucuucau

SEQ ID NO: 11647 - RNA, 20 nt, Artificial Sequence
  targeting sequence with CTCN PAM
cuguaaaccaaugucccaca

SEQ ID NO: 11648 - RNA, 20 nt, Artificial Sequence
  targeting sequence with CTCN PAM
gacaacccugcacccaccuc

SEQ ID NO: 11649 - RNA, 20 nt, Artificial Sequence
  targeting sequence with CTCN PAM
guaucucugcaauggaaucu

SEQ ID NO: 11650 - RNA, 20 nt, Artificial Sequence
  targeting sequence with CTCN PAM
gcaauggaaucugacagugu

SEQ ID NO: 11651 - RNA, 20 nt, Artificial Sequence
  targeting sequence with CTCN PAM
agaccuugucaugcagucca

SEQ ID NO: 11652 - RNA, 20 nt, Artificial Sequence
  targeting sequence with CTCN PAM
gaauuggaaaggacucuaga

SEQ ID NO: 11653 - RNA, 20 nt, Artificial Sequence
  targeting sequence with CTCN PAM
gaauaucuugaaauuugccu

SEQ ID NO: 11654 - RNA, 20 nt, Artificial Sequence
  targeting sequence with CTCN PAM
uagauauaaaaauucauuuu

SEQ ID NO: 11655 - RNA, 20 nt, Artificial Sequence
  targeting sequence with CTCN PAM
aaugagacauucagaaauga

SEQ ID NO: 11656 - RNA, 20 nt, Artificial Sequence
  targeting sequence with CTCN PAM
uuugagccaagccugaacau

SEQ ID NO: 11657 - RNA, 20 nt, Artificial Sequence
  targeting sequence with CTCN PAM
ucuucauaagggucauuuug

SEQ ID NO: 11658 - RNA, 20 nt, Artificial Sequence
  targeting sequence with CTCN PAM
ucaaagugauuccuguguga

SEQ ID NO: 11659 - RNA, 20 nt, Artificial Sequence
  targeting sequence with CTCN PAM
uauguguacaaggcagaaag

SEQ ID NO: 11660 - RNA, 20 nt, Artificial Sequence
  targeting sequence with CTCN PAM
ucuaaagucauccuugguau

SEQ ID NO: 11661 - RNA, 20 nt, Artificial Sequence
  targeting sequence with CTCN PAM
caucuaaagucauccuuggu

SEQ ID NO: 11662 - RNA, 20 nt, Artificial Sequence
  targeting sequence with CTCN PAM
aacaucuaauaauccaccau

SEQ ID NO: 11663 - RNA, 20 nt, Artificial Sequence
  targeting sequence with CTCN PAM
cggggugcacaagccagucu

SEQ ID NO: 11664 - RNA, 20 nt, Artificial Sequence
  targeting sequence with CTCN PAM
uacucacggggugcacaagc

SEQ ID NO: 11665 - RNA, 20 nt, Artificial Sequence
  targeting sequence with CTCN PAM
cuauccuuguuuuguaggug

SEQ ID NO: 11666 - RNA, 20 nt, Artificial Sequence
  targeting sequence with CTCN PAM
auccuuguuuuguaggugag

SEQ ID NO: 11667 - RNA, 20 nt, Artificial Sequence
  targeting sequence with CTCN PAM
ccuacaaaacaaggauagag

SEQ ID NO: 11668 - RNA, 20 nt, Artificial Sequence
  targeting sequence with CTCN PAM
gauaggagaucagcuuuucu

SEQ ID NO: 11669 - RNA, 20 nt, Artificial Sequence
  targeting sequence with CTCN PAM
uaucugagcuuucauucuca

SEQ ID NO: 11670 - RNA, 20 nt, Artificial Sequence
  targeting sequence with CTCN PAM
aaaugugaaaugugccaagg

SEQ ID NO: 11671 - RNA, 20 nt, Artificial Sequence
  targeting sequence with CTCN PAM
gaggaagaaagcguaagaaa

SEQ ID NO: 11672 - RNA, 20 nt, Artificial Sequence
  targeting sequence with CTCN PAM
gagccuuggcacauuucaca

SEQ ID NO: 11673 - RNA, 20 nt, Artificial Sequence
  targeting sequence with CTCN PAM
ccauuaugugguaacagacc

SEQ ID NO: 11674 - RNA, 20 nt, Artificial Sequence
  targeting sequence with CTCN PAM
gggcuucaguuugcccagcu

SEQ ID NO: 11675 - RNA, 20 nt, Artificial Sequence
  targeting sequence with CTCN PAM
uuccagcugggcaaacugaa

SEQ ID NO: 11676 - RNA, 20 nt, Artificial Sequence
  targeting sequence with CTCN PAM
gugacuaggagcaaacaacu

SEQ ID NO: 11677 - RNA, 20 nt, Artificial Sequence
  targeting sequence with CTCN PAM
uagucacagagcuggcugau

SEQ ID NO: 11678 - RNA, 20 nt, Artificial Sequence
  targeting sequence with CTCN PAM
cuguacuuuaguuuccucau

SEQ ID NO: 11679 - RNA, 20 nt, Artificial Sequence
  targeting sequence with CTCN PAM
guacuuuaguuuccucauug

SEQ ID NO: 11680 - RNA, 20 nt, Artificial Sequence
  targeting sequence with CTCN PAM
uugguaaaaucggggcagug

SEQ ID NO: 11681 - RNA, 20 nt, Artificial Sequence
  targeting sequence with CTCN PAM
uuuuuuuuuuugagacagag

SEQ ID NO: 11682 - RNA, 20 nt, Artificial Sequence
  targeting sequence with CTCN PAM
aaaaaaaaaaagaguguaaa

SEQ ID NO: 11683 - RNA, 20 nt, Artificial Sequence
  targeting sequence with CTCN PAM
gucucaaaaaaaaaaaagag

SEQ ID NO: 11684 - RNA, 20 nt, Artificial Sequence
  targeting sequence with CTCN PAM
gccucccagguucaagccau

SEQ ID NO: 11685 - RNA, 20 nt, Artificial Sequence
  targeting sequence with CTCN PAM
cagguucaagccauucuccu

SEQ ID NO: 11686 - RNA, 20 nt, Artificial Sequence
  targeting sequence with CTCN PAM
ugccucagccucccgaguag

SEQ ID NO: 11687 - RNA, 20 nt, Artificial Sequence
  targeting sequence with CTCN PAM
gccucccgaguaggugggac

SEQ ID NO: 11688 - RNA, 20 nt, Artificial Sequence
  targeting sequence with CTCN PAM
cgaguaggugggacuacagg

SEQ ID NO: 11689 - RNA, 20 nt, Artificial Sequence
  targeting sequence with CTCN PAM
ggaggcugaggcaggagaau

SEQ ID NO: 11690 - RNA, 20 nt, Artificial Sequence
  targeting sequence with CTCN PAM
uuaacaauucuuaaauauug

SEQ ID NO: 11691 - RNA, 20 nt, Artificial Sequence
  targeting sequence with CTCN PAM
ucacaguuauucaauauuua

SEQ ID NO: 11692 - RNA, 20 nt, Artificial Sequence
  targeting sequence with CTCN PAM
guugaccugacgcuuccuuu

SEQ ID NO: 11693 - RNA, 20 nt, Artificial Sequence
  targeting sequence with CTCN PAM
guaccauaguuuucucaucu

SEQ ID NO: 11694 - RNA, 20 nt, Artificial Sequence
  targeting sequence with CTCN PAM
ucugugaaacagguauacag

SEQ ID NO: 11695 - RNA, 20 nt, Artificial Sequence
  targeting sequence with CTCN PAM
cuugaauuacugccaaguau

SEQ ID NO: 11696 - RNA, 20 nt, Artificial Sequence
  targeting sequence with CTCN PAM
agagucagaccugaguugaa

SEQ ID NO: 11697 - RNA, 20 nt, Artificial Sequence
  targeting sequence with CTCN PAM
agagucugugcuuguaauua

SEQ ID NO: 11698 - RNA, 20 nt, Artificial Sequence
  targeting sequence with CTCN PAM
uaaaaugcauuauuuuauuu

SEQ ID NO: 11699 - RNA, 20 nt, Artificial Sequence
  targeting sequence with CTCN PAM
gcaggugcugucuggaauaa

SEQ ID NO: 11700 - RNA, 20 nt, Artificial Sequence
  targeting sequence with CTCN PAM
uauuccagacagcaccugcu

SEQ ID NO: 11701 - RNA, 20 nt, Artificial Sequence
  targeting sequence with CTCN PAM
augacaguacuucgaacucu

SEQ ID NO: 11702 - RNA, 20 nt, Artificial Sequence
  targeting sequence with CTCN PAM
caaugacaguacuucgaacu

SEQ ID NO: 11703 - RNA, 20 nt, Artificial Sequence
  targeting sequence with CTCN PAM
gaauuuuauuuuugguuuau

SEQ ID NO: 11704 - RNA, 20 nt, Artificial Sequence
  targeting sequence with CTCN PAM
accagggcucuuuuaaaauu

SEQ ID NO: 11705 - RNA, 20 nt, Artificial Sequence
  targeting sequence with CTCN PAM
uuuaaaauuuaaccugagag

SEQ ID NO: 11706 - RNA, 20 nt, Artificial Sequence
  targeting sequence with CTCN PAM
gguuaaauuuuaaaagagcc

SEQ ID NO: 11707 - RNA, 20 nt, Artificial Sequence
  targeting sequence with CTCN PAM
cagguuaaauuuuaaaagag

SEQ ID NO: 11708 - RNA, 20 nt, Artificial Sequence
  targeting sequence with CTCN PAM
guauaccucucuggcauuaa

SEQ ID NO: 11709 - RNA, 20 nt, Artificial Sequence
  targeting sequence with CTCN PAM
cuggcauuaacaucaacaca

SEQ ID NO: 11710 - RNA, 20 nt, Artificial Sequence
  targeting sequence with CTCN PAM
ggcauuaacaucaacacaga

SEQ ID NO: 11711 - RNA, 20 nt, Artificial Sequence
  targeting sequence with CTCN PAM
ccucucuaaagccuaguacc

SEQ ID NO: 11712 - RNA, 20 nt, Artificial Sequence
  targeting sequence with CTCN PAM
ucucuaaagccuaguaccuc

SEQ ID NO: 11713 - RNA, 20 nt, Artificial Sequence
  targeting sequence with CTCN PAM
cuaaagccuaguaccucaag

SEQ ID NO: 11714 - RNA, 20 nt, Artificial Sequence
  targeting sequence with CTCN PAM
aaagccuaguaccucaaggc

SEQ ID NO: 11715 - RNA, 20 nt, Artificial Sequence
  targeting sequence with CTCN PAM
aggcuuccucugcaaacagu

SEQ ID NO: 11716 - RNA, 20 nt, Artificial Sequence
  targeting sequence with CTCN PAM
gcaaacaguaacuuggguug

SEQ ID NO: 11717 - RNA, 20 nt, Artificial Sequence
  targeting sequence with CTCN PAM
gaaaaaaaaaaaacaaaaaa

SEQ ID NO: 11718 - RNA, 20 nt, Artificial Sequence
  targeting sequence with CTCN PAM
gucucagaaaaaaaaaaaac

SEQ ID NO: 11719 - RNA, 20 nt, Artificial Sequence
  targeting sequence with CTCN PAM
cucugucgcccaggcuggag

SEQ ID NO: 11720 - RNA, 20 nt, Artificial Sequence
  targeting sequence with CTCN PAM
gucgcccaggcuggagugua

SEQ ID NO: 11721 - RNA, 20 nt, Artificial Sequence
  targeting sequence with CTCN PAM
agccugggcgacagagugag

SEQ ID NO: 11722 - RNA, 20 nt, Artificial Sequence
  targeting sequence with CTCN PAM
gcucacugcaagcuccaccu

SEQ ID NO: 11723 - RNA, 20 nt, Artificial Sequence
  targeting sequence with CTCN PAM
cugcaagcuccaccuuccgg

SEQ ID NO: 11724 - RNA, 20 nt, Artificial Sequence
  targeting sequence with CTCN PAM
accuuccggguucacgccau

SEQ ID NO: 11725 - RNA, 20 nt, Artificial Sequence
  targeting sequence with CTCN PAM
ugccucauccucccguguag

SEQ ID NO: 11726 - RNA, 20 nt, Artificial Sequence
  targeting sequence with CTCN PAM
uccucccguguagcugggac

SEQ ID NO: 11727 - RNA, 20 nt, Artificial Sequence
  targeting sequence with CTCN PAM
cguguagcugggacuauagg

SEQ ID NO: 11728 - RNA, 20 nt, Artificial Sequence
  targeting sequence with CTCN PAM
acaaaaaauuagccaagcau

SEQ ID NO: 11729 - RNA, 20 nt, Artificial Sequence
  targeting sequence with CTCN PAM
gucuccugaccucaugaucc

SEQ ID NO: 11730 - RNA, 20 nt, Artificial Sequence
  targeting sequence with CTCN PAM
ugaccucaugauccacccac

SEQ ID NO: 11731 - RNA, 20 nt, Artificial Sequence
  targeting sequence with CTCN PAM
ugauccacccaccucggccu

SEQ ID NO: 11732 - RNA, 20 nt, Artificial Sequence
  targeting sequence with CTCN PAM
gccucccaaagugcugggau

SEQ ID NO: 11733 - RNA, 20 nt, Artificial Sequence
  targeting sequence with CTCN PAM
caaagugcugggauuacagg

SEQ ID NO: 11734 - RNA, 20 nt, Artificial Sequence
  targeting sequence with CTCN PAM
ugccuguaaucccagcacuu

SEQ ID NO: 11735 - RNA, 20 nt, Artificial Sequence
  targeting sequence with CTCN PAM
accaauugucagaaaaauuu

SEQ ID NO: 11736 - RNA, 20 nt, Artificial Sequence
  targeting sequence with CTCN PAM
uguuucacuaaaauguguca

SEQ ID NO: 11737 - RNA, 20 nt, Artificial Sequence
  targeting sequence with CTCN PAM
guuugacacauuuuagugaa

SEQ ID NO: 11738 - RNA, 20 nt, Artificial Sequence
  targeting sequence with CTCN PAM
ggaccaccugagggcugugu

SEQ ID NO: 11739 - RNA, 20 nt, Artificial Sequence
  targeting sequence with CTCN PAM
ggugguccugagaacaugug

SEQ ID NO: 11740 - RNA, 20 nt, Artificial Sequence
  targeting sequence with CTCN PAM
uauuuggcucagaauaaauc

SEQ ID NO: 11741 - RNA, 20 nt, Artificial Sequence
  targeting sequence with CTCN PAM
gaauaaaucucuucagauau

SEQ ID NO: 11742 - RNA, 20 nt, Artificial Sequence
  targeting sequence with CTCN PAM
ucagauauuuuacagaguuu

SEQ ID NO: 11743 - RNA, 20 nt, Artificial Sequence
  targeting sequence with CTCN PAM
guaaaauaucugaagagauu

SEQ ID NO: 11744 - RNA, 20 nt, Artificial Sequence
  targeting sequence with CTCN PAM
ucuugccaacacaaguaauc

SEQ ID NO: 11745 - RNA, 20 nt, Artificial Sequence
  targeting sequence with CTCN PAM
uaaaauauuuugcaguuuga

SEQ ID NO: 11746 - RNA, 20 nt, Artificial Sequence
  targeting sequence with CTCN PAM
gaauaaaucucuuaaaauau

SEQ ID NO: 11747 - RNA, 20 nt, Artificial Sequence
  targeting sequence with CTCN PAM
uauuaggcucagaauaaauc

SEQ ID NO: 11748 - RNA, 20 nt, Artificial Sequence
  targeting sequence with CTCN PAM
ggagguccacagaacaugug

SEQ ID NO: 11749 - RNA, 20 nt, Artificial Sequence
  targeting sequence with CTCN PAM
ugagggcugugucacuggcu

SEQ ID NO: 11750 - RNA, 20 nt, Artificial Sequence
  targeting sequence with CTCN PAM
ccaaacugcaccccaaccac

SEQ ID NO: 11751 - RNA, 20 nt, Artificial Sequence
  targeting sequence with CTCN PAM
ugccuccccaaacugcaccc

SEQ ID NO: 11752 - RNA, 20 nt, Artificial Sequence
  targeting sequence with CTCN PAM
aagugagggcuuccaggcua

SEQ ID NO: 11753 - RNA, 20 nt, Artificial Sequence
  targeting sequence with CTCN PAM
cuuugaguuguccugccuuu

SEQ ID NO: 11754 - RNA, 20 nt, Artificial Sequence
  targeting sequence with CTCN PAM
gccaauugucagccagaaaa

SEQ ID NO: 11755 - RNA, 20 nt, Artificial Sequence
  targeting sequence with CTCN PAM
acaauccuuuaucuuaaccc

SEQ ID NO: 11756 - RNA, 20 nt, Artificial Sequence
  targeting sequence with CTCN PAM
gcaaauaagaacaugggucu

SEQ ID NO: 11757 - RNA, 20 nt, Artificial Sequence
  targeting sequence with CTCN PAM
cccugcaaaacagagucuug

SEQ ID NO: 11758 - RNA, 20 nt, Artificial Sequence
  targeting sequence with CTCN PAM
guuuugcagggugagaagaa

SEQ ID NO: 11759 - RNA, 20 nt, Artificial Sequence
  targeting sequence with CTCN PAM
agccugggugacagcaagac

SEQ ID NO: 11760 - RNA, 20 nt, Artificial Sequence
  targeting sequence with CTCN PAM
gcucacugcaaccucugucu

SEQ ID NO: 11761 - RNA, 20 nt, Artificial Sequence
  targeting sequence with CTCN PAM
cugcaaccucugucucccgg

SEQ ID NO: 11762 - RNA, 20 nt, Artificial Sequence
  targeting sequence with CTCN PAM
gucucccggguucaagcaau

SEQ ID NO: 11763 - RNA, 20 nt, Artificial Sequence
  targeting sequence with CTCN PAM
cggguucaagcaauucuccu

SEQ ID NO: 11764 - RNA, 20 nt, Artificial Sequence
  targeting sequence with CTCN PAM
ugccucagccucccuaguag

SEQ ID NO: 11765 - RNA, 20 nt, Artificial Sequence
  targeting sequence with CTCN PAM
gccucccuaguagcugggau

SEQ ID NO: 11766 - RNA, 20 nt, Artificial Sequence
  targeting sequence with CTCN PAM
cuaguagcugggauuacagg

SEQ ID NO: 11767 - RNA, 20 nt, Artificial Sequence
  targeting sequence with CTCN PAM
acuaaaaauacaaaaauuag

SEQ ID NO: 11768 - RNA, 20 nt, Artificial Sequence
  targeting sequence with CTCN PAM
aacuccugaccucgugaucc

SEQ ID NO: 11769 - RNA, 20 nt, Artificial Sequence
  targeting sequence with CTCN PAM
ugaccucgugauccgcccgc

SEQ ID NO: 11770 - RNA, 20 nt, Artificial Sequence
  targeting sequence with CTCN PAM
ugauccgcccgccucggccu

SEQ ID NO: 11771 - RNA, 20 nt, Artificial Sequence
  targeting sequence with CTCN PAM
gccucccaaaacgcugggau

SEQ ID NO: 11772 - RNA, 20 nt, Artificial Sequence
  targeting sequence with CTCN PAM
caaaacgcugggauuacagg

SEQ ID NO: 11773 - RNA, 20 nt, Artificial Sequence
  targeting sequence with CTCN PAM
ugccuguaaucccagcguuu

SEQ ID NO: 11774 - RNA, 20 nt, Artificial Sequence
  targeting sequence with CTCN PAM
ggcauuaauaucaacacaga

SEQ ID NO: 11775 - RNA, 20 nt, Artificial Sequence
  targeting sequence with CTCN PAM
ccggcauuaauaucaacaca

SEQ ID NO: 11776 - RNA, 20 nt, Artificial Sequence
  targeting sequence with CTCN PAM
uuguaccucuccggcauuaa

SEQ ID NO: 11777 - RNA, 20 nt, Artificial Sequence
  targeting sequence with CTCN PAM
gacaugccucauuguaccuc

SEQ ID NO: 11778 - RNA, 20 nt, Artificial Sequence
  targeting sequence with CTCN PAM
cagguuaaauuuuaaaagag

SEQ ID NO: 11779 - RNA, 20 nt, Artificial Sequence
  targeting sequence with CTCN PAM
gguuaaauuuuaaaagagcc

SEQ ID NO: 11780 - RNA, 20 nt, Artificial Sequence
  targeting sequence with CTCN PAM
uuuaaaauuuaaccugagag

SEQ ID NO: 11781 - RNA, 20 nt, Artificial Sequence
  targeting sequence with CTCN PAM
accagggcucuuuuaaaauu

SEQ ID NO: 11782 - RNA, 20 nt, Artificial Sequence
  targeting sequence with CTCN PAM
ucaaccagggcucuuuuaaa

SEQ ID NO: 11783 - RNA, 20 nt, Artificial Sequence
  targeting sequence with CTCN PAM
cuuucaugucuuugcuuguu

SEQ ID NO: 11784 - RNA, 20 nt, Artificial Sequence
  targeting sequence with CTCN PAM
uccauguuucaaaagcccua

SEQ ID NO: 11785 - RNA, 20 nt, Artificial Sequence
  targeting sequence with CTCN PAM
auguuucaaaagcccuaccu

SEQ ID NO: 11786 - RNA, 20 nt, Artificial Sequence
  targeting sequence with CTCN PAM
ccuugaauuaaaaugcuguu

SEQ ID NO: 11787 - RNA, 20 nt, Artificial Sequence
  targeting sequence with CTCN PAM
uugaauuaaaaugcuguuga

SEQ ID NO: 11788 - RNA, 20 nt, Artificial Sequence
  targeting sequence with CTCN PAM
gauauuuaccccagacaaug

SEQ ID NO: 11789 - RNA, 20 nt, Artificial Sequence
  targeting sequence with CTCN PAM
acagcaauggaaaacuagga

SEQ ID NO: 11790 - RNA, 20 nt, Artificial Sequence
  targeting sequence with CTCN PAM
gguguguccguauccuaguu

SEQ ID NO: 11791 - RNA, 20 nt, Artificial Sequence
  targeting sequence with CTCN PAM
cucugguguguccguauccu

SEQ ID NO: 11792 - RNA, 20 nt, Artificial Sequence
  targeting sequence with CTCN PAM
uaaccucacucugguguguc

SEQ ID NO: 11793 - RNA, 20 nt, Artificial Sequence
  targeting sequence with CTCN PAM
uucuuucgccuguuaaacuu

SEQ ID NO: 11794 - RNA, 20 nt, Artificial Sequence
  targeting sequence with CTCN PAM
ucucuuucuuucgccuguua

SEQ ID NO: 11795 - RNA, 20 nt, Artificial Sequence
  targeting sequence with CTCN PAM
cugcagcugacagcguucuc

SEQ ID NO: 11796 - RNA, 20 nt, Artificial Sequence
  targeting sequence with CTCN PAM
aaaaaaugaguugccaccuc

SEQ ID NO: 11797 - RNA, 20 nt, Artificial Sequence
  targeting sequence with CTCN PAM
uuuuuucgagaacgcuguca

SEQ ID NO: 11798 - RNA, 20 nt, Artificial Sequence
  targeting sequence with CTCN PAM
guggugaaaugcagguuuua

SEQ ID NO: 11799 - RNA, 20 nt, Artificial Sequence
  targeting sequence with CTCN PAM
agcuuaucuauaaaaccugc

SEQ ID NO: 11800 - RNA, 20 nt, Artificial Sequence
  targeting sequence with CTCN PAM
ucaagcuuaucuauaaaacc

SEQ ID NO: 11801 - RNA, 20 nt, Artificial Sequence
  targeting sequence with CTCN PAM
cuuuaauuugucaccacgug

SEQ ID NO: 11802 - RNA, 20 nt, Artificial Sequence
  targeting sequence with CTCN PAM
auguugaacauacuuggccc

SEQ ID NO: 11803 - RNA, 20 nt, Artificial Sequence
  targeting sequence with CTCN PAM
aaaaaaaaaaauaaauaaau

SEQ ID NO: 11804 - RNA, 20 nt, Artificial Sequence
  targeting sequence with CTCN PAM
gucucaaaaaaaaaaaauaa

SEQ ID NO: 11805 - RNA, 20 nt, Artificial Sequence
  targeting sequence with CTCN PAM
gucgcccagacuggagugca

SEQ ID NO: 11806 - RNA, 20 nt, Artificial Sequence
  targeting sequence with CTCN PAM
agucugggcgacggaggaag

SEQ ID NO: 11807 - RNA, 20 nt, Artificial Sequence
  targeting sequence with CTCN PAM
cugcaaccucugccucccag

SEQ ID NO: 11808 - RNA, 20 nt, Artificial Sequence
  targeting sequence with CTCN PAM
gccucccagguucuagugau

SEQ ID NO: 11809 - RNA, 20 nt, Artificial Sequence
  targeting sequence with CTCN PAM
cagguucuagugauucuccu

SEQ ID NO: 11810 - RNA, 20 nt, Artificial Sequence
  targeting sequence with CTCN PAM
ugccucagccucucgaguag

SEQ ID NO: 11811 - RNA, 20 nt, Artificial Sequence
  targeting sequence with CTCN PAM
gccucucgaguagcugggau

SEQ ID NO: 11812 - RNA, 20 nt, Artificial Sequence
  targeting sequence with CTCN PAM
cgaguagcugggauuacagg

SEQ ID NO: 11813 - RNA, 20 nt, Artificial Sequence
  targeting sequence with CTCN PAM
aguagcugggauuacaggcg

SEQ ID NO: 11814 - RNA, 20 nt, Artificial Sequence
  targeting sequence with CTCN PAM
agaggcugaggcaggagaau

SEQ ID NO: 11815 - RNA, 20 nt, Artificial Sequence
  targeting sequence with CTCN PAM
ccacccaccaccaugcccag

SEQ ID NO: 11816 - RNA, 20 nt, Artificial Sequence
  targeting sequence with CTCN PAM
accaaaaauacaaaaauuag

SEQ ID NO: 11817 - RNA, 20 nt, Artificial Sequence
  targeting sequence with CTCN PAM
aacuccugaccucaagucuu

SEQ ID NO: 11818 - RNA, 20 nt, Artificial Sequence
  targeting sequence with CTCN PAM
ugaccucaagucuuccuccu

SEQ ID NO: 11819 - RNA, 20 nt, Artificial Sequence
  targeting sequence with CTCN PAM
agucuuccuccugccuuggc

SEQ ID NO: 11820 - RNA, 20 nt, Artificial Sequence
  targeting sequence with CTCN PAM
ugccuuggccucccagagug

SEQ ID NO: 11821 - RNA, 20 nt, Artificial Sequence
  targeting sequence with CTCN PAM
cagagugcugggauuacagg

SEQ ID NO: 11822 - RNA, 20 nt, Artificial Sequence
  targeting sequence with CTCN PAM
gggaggccaaggcaggagga

SEQ ID NO: 11823 - RNA, 20 nt, Artificial Sequence
  targeting sequence with CTCN PAM
ugccuguaaucccagcacuc

SEQ ID NO: 11824 - RNA, 20 nt, Artificial Sequence
  targeting sequence with CTCN PAM
gcuugccuaucuauguuugc

SEQ ID NO: 11825 - RNA, 20 nt, Artificial Sequence
  targeting sequence with CTCN PAM
auuuuucaggcugcucuuug

SEQ ID NO: 11826 - RNA, 20 nt, Artificial Sequence
  targeting sequence with CTCN PAM
uuguuagaaaaaaauaauuu

SEQ ID NO: 11827 - RNA, 20 nt, Artificial Sequence
  targeting sequence with CTCN PAM
uuuaccuucacuaucuggcu

SEQ ID NO: 11828 - RNA, 20 nt, Artificial Sequence
  targeting sequence with CTCN PAM
uguaucacugcgucuuccuc

SEQ ID NO: 11829 - RNA, 20 nt, Artificial Sequence
  targeting sequence with CTCN PAM
uucgaauccuguuuucaugu

SEQ ID NO: 11830 - RNA, 20 nt, Artificial Sequence
  targeting sequence with CTCN PAM
uaaagccuuuaucagaguac

SEQ ID NO: 11831 - RNA, 20 nt, Artificial Sequence
  targeting sequence with CTCN PAM
gauaaaggcuuuaagagaca

SEQ ID NO: 11832 - RNA, 20 nt, Artificial Sequence
  targeting sequence with CTCN PAM
aagguugugucuuauaauug

SEQ ID NO: 11833 - RNA, 20 nt, Artificial Sequence
  targeting sequence with CTCN PAM
ccucuaagguugugucuuau

SEQ ID NO: 11834 - RNA, 20 nt, Artificial Sequence
  targeting sequence with CTCN PAM
cuggauaguaauuucccuga

SEQ ID NO: 11835 - RNA, 20 nt, Artificial Sequence
  targeting sequence with CTCN PAM
gggaaauuacuauccaguga

SEQ ID NO: 11836 - RNA, 20 nt, Artificial Sequence
  targeting sequence with CTCN PAM
ccucagggaaauuacuaucc

SEQ ID NO: 11837 - RNA, 20 nt, Artificial Sequence
  targeting sequence with CTCN PAM
cuccccucagggaaauuacu

SEQ ID NO: 11838 - RNA, 20 nt, Artificial Sequence
  targeting sequence with CTCN PAM
uaggugccaggcaccaacag

SEQ ID NO: 11839 - RNA, 20 nt, Artificial Sequence
  targeting sequence with CTCN PAM
guaaguaucuguggauuuac

SEQ ID NO: 11840 - RNA, 20 nt, Artificial Sequence
  targeting sequence with CTCN PAM
cauguugucuagccuuuaug

SEQ ID NO: 11841 - RNA, 20 nt, Artificial Sequence
  targeting sequence with CTCN PAM
uguugucuagccuuuaugau

SEQ ID NO: 11842 - RNA, 20 nt, Artificial Sequence
  targeting sequence with CTCN PAM
ucuaauaauaucauaaaggc

SEQ ID NO: 11843 - RNA, 20 nt, Artificial Sequence
  targeting sequence with CTCN PAM
acaguugacccuuugaauaa

SEQ ID NO: 11844 - RNA, 20 nt, Artificial Sequence
  targeting sequence with CTCN PAM
uguccagaagccagacacaa

SEQ ID NO: 11845 - RNA, 20 nt, Artificial Sequence
  targeting sequence with CTCN PAM
uuguccugauuuccucuugu

SEQ ID NO: 11846 - RNA, 20 nt, Artificial Sequence
  targeting sequence with CTCN PAM
guaguuagcucuuuguccug

SEQ ID NO: 11847 - RNA, 20 nt, Artificial Sequence
  targeting sequence with CTCN PAM
ucaguacacacacaguguuu

SEQ ID NO: 11848 - RNA, 20 nt, Artificial Sequence
  targeting sequence with CTCN PAM
guacacacacaguguuucuu

SEQ ID NO: 11849 - RNA, 20 nt, Artificial Sequence
  targeting sequence with CTCN PAM
acugauuuuggcugccggaa

SEQ ID NO: 11850 - RNA, 20 nt, Artificial Sequence
  targeting sequence with CTCN PAM
uaaagugcuucccuaaccuc

SEQ ID NO: 11851 - RNA, 20 nt, Artificial Sequence
  targeting sequence with CTCN PAM
cucuugugaguacucugaaa

SEQ ID NO: 11852 - RNA, 20 nt, Artificial Sequence
  targeting sequence with CTCN PAM
ugugaguacucugaaauuug

SEQ ID NO: 11853 - RNA, 20 nt, Artificial Sequence
  targeting sequence with CTCN PAM
caagagggagguuagggaag

SEQ ID NO: 11854 - RNA, 20 nt, Artificial Sequence
  targeting sequence with CTCN PAM
gaaauuugacccuuuuuuuu

SEQ ID NO: 11855 - RNA, 20 nt, Artificial Sequence
  targeting sequence with CTCN PAM
aaaaaaaaaaaaaaggguca

SEQ ID NO: 11856 - RNA, 20 nt, Artificial Sequence
  targeting sequence with CTCN PAM
aaguaaaaagggaaagauga

SEQ ID NO: 11857 - RNA, 20 nt, Artificial Sequence
  targeting sequence with CTCN PAM
uucaugggugucucaaagua

SEQ ID NO: 11858 - RNA, 20 nt, Artificial Sequence
  targeting sequence with CTCN PAM
cucuggaaccuauccaggua

SEQ ID NO: 11859 - RNA, 20 nt, Artificial Sequence
  targeting sequence with CTCN PAM
ggaaccuauccagguauaua

SEQ ID NO: 11860 - RNA, 20 nt, Artificial Sequence
  targeting sequence with CTCN PAM
gaaaauuacuuuuauauacc

SEQ ID NO: 11861 - RNA, 20 nt, Artificial Sequence
  targeting sequence with CTCN PAM
cuuucugucuaagucuacuu

SEQ ID NO: 11862 - RNA, 20 nt, Artificial Sequence
  targeting sequence with CTCN PAM
uucugucuaagucuacuucc

SEQ ID NO: 11863 - RNA, 20 nt, Artificial Sequence
  targeting sequence with CTCN PAM
ucucuguugucucuagauac

SEQ ID NO: 11864 - RNA, 20 nt, Artificial Sequence
  targeting sequence with CTCN PAM
guugucucuagauacgcaga

SEQ ID NO: 11865 - RNA, 20 nt, Artificial Sequence
  targeting sequence with CTCN PAM
agauacgcagacugauuaau

SEQ ID NO: 11866 - RNA, 20 nt, Artificial Sequence
  targeting sequence with CTCN PAM
auucuuuguaugguuaacua

SEQ ID NO: 11867 - RNA, 20 nt, Artificial Sequence
  targeting sequence with CTCN PAM
ccaguguaaacaauccaaac

SEQ ID NO: 11868 - RNA, 20 nt, Artificial Sequence
  targeting sequence with CTCN PAM
aguguaaacaauccaaacuc

SEQ ID NO: 11869 - RNA, 20 nt, Artificial Sequence
  targeting sequence with CTCN PAM
auuaguuuuucuacauaggu

SEQ ID NO: 11870 - RNA, 20 nt, Artificial Sequence
  targeting sequence with CTCN PAM
aaccauuucagaaaguuucc

SEQ ID NO: 11871 - RNA, 20 nt, Artificial Sequence
  targeting sequence with CTCN PAM
gauggugugugugugugugu

SEQ ID NO: 11872 - RNA, 20 nt, Artificial Sequence
  targeting sequence with CTCN PAM
aaaaaaaaaaaaaaaaaaaa

SEQ ID NO: 11873 - RNA, 20 nt, Artificial Sequence
  targeting sequence with CTCN PAM
gucuccaaaaaaaaaaaaaa

SEQ ID NO: 11874 - RNA, 20 nt, Artificial Sequence
  targeting sequence with CTCN PAM
gucgcccaggcuggagugca

SEQ ID NO: 11875 - RNA, 20 nt, Artificial Sequence
  targeting sequence with CTCN PAM
agccugggcgacagagccag

SEQ ID NO: 11876 - RNA, 20 nt, Artificial Sequence
  targeting sequence with CTCN PAM
gcuuacugcaagcuccaccu

SEQ ID NO: 11877 - RNA, 20 nt, Artificial Sequence
  targeting sequence with CTCN PAM
accucccggguucacaccau

SEQ ID NO: 11878 - RNA, 20 nt, Artificial Sequence
  targeting sequence with CTCN PAM
cggguucacaccauucuccu

SEQ ID NO: 11879 - RNA, 20 nt, Artificial Sequence
  targeting sequence with CTCN PAM
ugccucagccuccugaguag

SEQ ID NO: 11880 - RNA, 20 nt, Artificial Sequence
  targeting sequence with CTCN PAM
gccuccugaguagcugggac

SEQ ID NO: 11881 - RNA, 20 nt, Artificial Sequence
  targeting sequence with CTCN PAM
ugaguagcugggacuacagg

SEQ ID NO: 11882 - RNA, 20 nt, Artificial Sequence
  targeting sequence with CTCN PAM
ggaggcugaggcaggagaau

SEQ ID NO: 11883 - RNA, 20 nt, Artificial Sequence
  targeting sequence with CTCN PAM
gcuaauuuuuuguauuuuua

SEQ ID NO: 11884 - RNA, 20 nt, Artificial Sequence
  targeting sequence with CTCN PAM
acuaaaaauacaaaaaauua

SEQ ID NO: 11885 - RNA, 20 nt, Artificial Sequence
  targeting sequence with CTCN PAM
guguuagccaggauggucuc

SEQ ID NO: 11886 - RNA, 20 nt, Artificial Sequence
  targeting sequence with CTCN PAM
aucuccugaccucguaaucc

SEQ ID NO: 11887 - RNA, 20 nt, Artificial Sequence
  targeting sequence with CTCN PAM
ugaccucguaauccacccac

SEQ ID NO: 11888 - RNA, 20 nt, Artificial Sequence
  targeting sequence with CTCN PAM
uaauccacccaccucggccu

SEQ ID NO: 11889 - RNA, 20 nt, Artificial Sequence
  targeting sequence with CTCN PAM
gccucccaaagugcugggau

SEQ ID NO: 11890 - RNA, 20 nt, Artificial Sequence
  targeting sequence with CTCN PAM
caaagugcugggauuacaga

SEQ ID NO: 11891 - RNA, 20 nt, Artificial Sequence
  targeting sequence with CTCN PAM
guaaucccagcacuuuggga

SEQ ID NO: 11892 - RNA, 20 nt, Artificial Sequence
  targeting sequence with CTCN PAM
ccucuguaaucccagcacuu

SEQ ID NO: 11893 - RNA, 20 nt, Artificial Sequence
  targeting sequence with CTCN PAM
ccacauagugauagauguca

SEQ ID NO: 11894 - RNA, 20 nt, Artificial Sequence
  targeting sequence with CTCN PAM
acauagugauagaugucaca

SEQ ID NO: 11895 - RNA, 20 nt, Artificial Sequence
  targeting sequence with CTCN PAM
aagaaauaaaauaaaaccca

SEQ ID NO: 11896 - RNA, 20 nt, Artificial Sequence
  targeting sequence with CTCN PAM
guugcccaagcuggugugca

SEQ ID NO: 11897 - RNA, 20 nt, Artificial Sequence
  targeting sequence with CTCN PAM
aacuccugggcuuaagggau

SEQ ID NO: 11898 - RNA, 20 nt, Artificial Sequence
  targeting sequence with CTCN PAM
ugggcuuaagggaucuuccc

SEQ ID NO: 11899 - RNA, 20 nt, Artificial Sequence
  targeting sequence with CTCN PAM
gccucccgaguagcuaggac

SEQ ID NO: 11900 - RNA, 20 nt, Artificial Sequence
  targeting sequence with CTCN PAM
cgaguagcuaggacugugga

SEQ ID NO: 11901 - RNA, 20 nt, Artificial Sequence
  targeting sequence with CTCN PAM
ggaggcugaggugggaagau

SEQ ID NO: 11902 - RNA, 20 nt, Artificial Sequence
  targeting sequence with CTCN PAM
uccaccuaauuuuuauuuuu

SEQ ID NO: 11903 - RNA, 20 nt, Artificial Sequence
  targeting sequence with CTCN PAM
acuucuugguuacccaacuu

SEQ ID NO: 11904 - RNA, 20 nt, Artificial Sequence
  targeting sequence with CTCN PAM
uuugccagguuuaugacacc

SEQ ID NO: 11905 - RNA, 20 nt, Artificial Sequence
  targeting sequence with CTCN PAM
gauggcaccuuacuucagcc

SEQ ID NO: 11906 - RNA, 20 nt, Artificial Sequence
  targeting sequence with CTCN PAM
agggacacaaagacacugug

SEQ ID NO: 11907 - RNA, 20 nt, Artificial Sequence
  targeting sequence with CTCN PAM
ggguuuccauucucuauaau

SEQ ID NO: 11908 - RNA, 20 nt, Artificial Sequence
  targeting sequence with CTCN PAM
auaauagccucaucauuguu

SEQ ID NO: 11909 - RNA, 20 nt, Artificial Sequence
  targeting sequence with CTCN PAM
cuagucuaauucaauacugu

SEQ ID NO: 11910 - RNA, 20 nt, Artificial Sequence
  targeting sequence with CTCN PAM
uugagaugaggacaggugag

SEQ ID NO: 11911 - RNA, 20 nt, Artificial Sequence
  targeting sequence with CTCN PAM
augagcccacccucacuagu

SEQ ID NO: 11912 - RNA, 20 nt, Artificial Sequence
  targeting sequence with CTCN PAM
ucucaaugagcccacccuca

SEQ ID NO: 11913 - RNA, 20 nt, Artificial Sequence
  targeting sequence with CTCN PAM
ccuguccucaucucaaugag

SEQ ID NO: 11914 - RNA, 20 nt, Artificial Sequence
  targeting sequence with CTCN PAM
ugacuucaaagucuuuuucc

SEQ ID NO: 11915 - RNA, 20 nt, Artificial Sequence
  targeting sequence with CTCN PAM
uugccuccugacuucaaagu

SEQ ID NO: 11916 - RNA, 20 nt, Artificial Sequence
  targeting sequence with CTCN PAM
gucaaaauggaacuacugaa

SEQ ID NO: 11917 - RNA, 20 nt, Artificial Sequence
  targeting sequence with CTCN PAM
gcagaggagggaucugauuu

SEQ ID NO: 11918 - RNA, 20 nt, Artificial Sequence
  targeting sequence with CTCN PAM
gcugaggaccuuucaguagu

SEQ ID NO: 11919 - RNA, 20 nt, Artificial Sequence
  targeting sequence with CTCN PAM
ucugcugaggaccuuucagu

SEQ ID NO: 11920 - RNA, 20 nt, Artificial Sequence
  targeting sequence with CTCN PAM
guugcuguugcuuccuauuu

SEQ ID NO: 11921 - RNA, 20 nt, Artificial Sequence
  targeting sequence with CTCN PAM
caguugcuguugcuuccuau

SEQ ID NO: 11922 - RNA, 20 nt, Artificial Sequence
  targeting sequence with CTCN PAM
cuuccccauugccacucuca

SEQ ID NO: 11923 - RNA, 20 nt, Artificial Sequence
  targeting sequence with CTCN PAM
gaaaccucccuuccccauug

SEQ ID NO: 11924 - RNA, 20 nt, Artificial Sequence
  targeting sequence with CTCN PAM
cugaaaccucccuuccccau

SEQ ID NO: 11925 - RNA, 20 nt, Artificial Sequence
  targeting sequence with CTCN PAM
ucaacucucugaaaccuccc

SEQ ID NO: 11926 - RNA, 20 nt, Artificial Sequence
  targeting sequence with CTCN PAM
gagaaugggacagcgagugg

SEQ ID NO: 11927 - RNA, 20 nt, Artificial Sequence
  targeting sequence with CTCN PAM
gaggcagugacuuuacacuu

SEQ ID NO: 11928 - RNA, 20 nt, Artificial Sequence
  targeting sequence with CTCN PAM
aaaucgcuggagaaaaagac

SEQ ID NO: 11929 - RNA, 20 nt, Artificial Sequence
  targeting sequence with CTCN PAM
acaacuaugcagcucaaaau

SEQ ID NO: 11930 - RNA, 20 nt, Artificial Sequence
  targeting sequence with CTCN PAM
ucugccucuacaacuaugca

SEQ ID NO: 11931 - RNA, 20 nt, Artificial Sequence
  targeting sequence with CTCN PAM
gguuaaauucaccucuucug

SEQ ID NO: 11932 - RNA, 20 nt, Artificial Sequence
  targeting sequence with CTCN PAM
uacuucaucuucaaaugugc

SEQ ID NO: 11933 - RNA, 20 nt, Artificial Sequence
  targeting sequence with CTCN PAM
guuucaugcaccacuucccu

SEQ ID NO: 11934 - RNA, 20 nt, Artificial Sequence
  targeting sequence with CTCN PAM
gguguuggguugggguugga

SEQ ID NO: 11935 - RNA, 20 nt, Artificial Sequence
  targeting sequence with CTCN PAM
cagaacucugguguuggguu

SEQ ID NO: 11936 - RNA, 20 nt, Artificial Sequence
  targeting sequence with CTCN PAM
gacucacagaacucuggugu

SEQ ID NO: 11937 - RNA, 20 nt, Artificial Sequence
  targeting sequence with CTCN PAM
auaaccagcucagacucaca

SEQ ID NO: 11938 - RNA, 20 nt, Artificial Sequence
  targeting sequence with CTCN PAM
gacucaauaaccagcucaga

SEQ ID NO: 11939 - RNA, 20 nt, Artificial Sequence
  targeting sequence with CTCN PAM
auguuauccauuugauacau

SEQ ID NO: 11940 - RNA, 20 nt, Artificial Sequence
  targeting sequence with CTCN PAM
uugauaaucagauggaagcu

SEQ ID NO: 11941 - RNA, 20 nt, Artificial Sequence
  targeting sequence with CTCN PAM
ucacuuuaguccugcauaaa

SEQ ID NO: 11942 - RNA, 20 nt, Artificial Sequence
  targeting sequence with CTCN PAM
ugccuauaauccuacugaaa

SEQ ID NO: 11943 - RNA, 20 nt, Artificial Sequence
  targeting sequence with CTCN PAM
gggagccugaguugggaaga

SEQ ID NO: 11944 - RNA, 20 nt, Artificial Sequence
  targeting sequence with CTCN PAM
cagagcuuuaggauuucagu

SEQ ID NO: 11945 - RNA, 20 nt, Artificial Sequence
  targeting sequence with CTCN PAM
ggcucccagagcuuuaggau

SEQ ID NO: 11946 - RNA, 20 nt, Artificial Sequence
  targeting sequence with CTCN PAM
ugccuuaagcaaucuuccca

SEQ ID NO: 11947 - RNA, 20 nt, Artificial Sequence
  targeting sequence with CTCN PAM
aacuccugccuuaagcaauc

SEQ ID NO: 11948 - RNA, 20 nt, Artificial Sequence
  targeting sequence with CTCN PAM
cuauguugcccaggcugguc

SEQ ID NO: 11949 - RNA, 20 nt, Artificial Sequence
  targeting sequence with CTCN PAM
cuaaaaucuggccuggguga

SEQ ID NO: 11950 - RNA, 20 nt, Artificial Sequence
  targeting sequence with CTCN PAM
gucacccaggccagauuuua

SEQ ID NO: 11951 - RNA, 20 nt, Artificial Sequence
  targeting sequence with CTCN PAM
gucucuuaaaaaaaaaaaaa

SEQ ID NO: 11952 - RNA, 20 nt, Artificial Sequence
  targeting sequence with CTCN PAM
uaaaaaaaaaaaaaaaagac

SEQ ID NO: 11953 - RNA, 20 nt, Artificial Sequence
  targeting sequence with CTCN PAM
aacaugcacacacacacaca

SEQ ID NO: 11954 - RNA, 20 nt, Artificial Sequence
  targeting sequence with CTCN PAM
cuaaaacauuauucugaacu

SEQ ID NO: 11955 - RNA, 20 nt, Artificial Sequence
  targeting sequence with CTCN PAM
caggucucccuaaaacauua

SEQ ID NO: 11956 - RNA, 20 nt, Artificial Sequence
  targeting sequence with CTCN PAM
ucacaggucucccuaaaaca

SEQ ID NO: 11957 - RNA, 20 nt, Artificial Sequence
  targeting sequence with CTCN PAM
cuccucacaggucucccuaa

SEQ ID NO: 11958 - RNA, 20 nt, Artificial Sequence
  targeting sequence with CTCN PAM
aggcucccuccucacagguc

SEQ ID NO: 11959 - RNA, 20 nt, Artificial Sequence
  targeting sequence with CTCN PAM
ccaggcucccuccucacagg

SEQ ID NO: 11960 - RNA, 20 nt, Artificial Sequence
  targeting sequence with CTCN PAM
uccuaguggcuguugaggaa

SEQ ID NO: 11961 - RNA, 20 nt, Artificial Sequence
  targeting sequence with CTCN PAM
acagccacuaggaugagaca

SEQ ID NO: 11962 - RNA, 20 nt, Artificial Sequence
  targeting sequence with CTCN PAM
ucuguaccuacugggccuua

SEQ ID NO: 11963 - RNA, 20 nt, Artificial Sequence
  targeting sequence with CTCN PAM
ggugccucugguguuuauaa

SEQ ID NO: 11964 - RNA, 20 nt, Artificial Sequence
  targeting sequence with CTCN PAM
gguguuuauaagcauagcag

SEQ ID NO: 11965 - RNA, 20 nt, Artificial Sequence
  targeting sequence with CTCN PAM
uugaccugcaacaccauuag

SEQ ID NO: 11966 - RNA, 20 nt, Artificial Sequence
  targeting sequence with CTCN PAM
agugcccuaaugguguugca

SEQ ID NO: 11967 - RNA, 20 nt, Artificial Sequence
  targeting sequence with CTCN PAM
gacauccucaagugcccuaa

SEQ ID NO: 11968 - RNA, 20 nt, Artificial Sequence
  targeting sequence with CTCN PAM
gcaaagugcugugcaaaugc

SEQ ID NO: 11969 - RNA, 20 nt, Artificial Sequence
  targeting sequence with CTCN PAM
cuugaugcuuccaacaacuc

SEQ ID NO: 11970 - RNA, 20 nt, Artificial Sequence
  targeting sequence with CTCN PAM
cugaagcaggcagcaagggg

SEQ ID NO: 11971 - RNA, 20 nt, Artificial Sequence
  targeting sequence with CTCN PAM
gaagcaggcagcaaggggac

SEQ ID NO: 11972 - RNA, 20 nt, Artificial Sequence
  targeting sequence with CTCN PAM
uaucuccgcucaaagaugag

SEQ ID NO: 11973 - RNA, 20 nt, Artificial Sequence
  targeting sequence with CTCN PAM
gcucaaagaugagaaaacag

SEQ ID NO: 11974 - RNA, 20 nt, Artificial Sequence
  targeting sequence with CTCN PAM
aagaugagaaaacagacuug

SEQ ID NO: 11975 - RNA, 20 nt, Artificial Sequence
  targeting sequence with CTCN PAM
ucuuugagcggagauaagag

SEQ ID NO: 11976 - RNA, 20 nt, Artificial Sequence
  targeting sequence with CTCN PAM
aagucuguuuucucaucuuu

SEQ ID NO: 11977 - RNA, 20 nt, Artificial Sequence
  targeting sequence with CTCN PAM
gccaccaucaccuguaauug

SEQ ID NO: 11978 - RNA, 20 nt, Artificial Sequence
  targeting sequence with CTCN PAM
gacugcagagucuuuguucu

SEQ ID NO: 11979 - RNA, 20 nt, Artificial Sequence
  targeting sequence with CTCN PAM
gcagucagagaaccuggguu

SEQ ID NO: 11980 - RNA, 20 nt, Artificial Sequence
  targeting sequence with CTCN PAM
auuaacauuuuaucuagcuu

SEQ ID NO: 11981 - RNA, 20 nt, Artificial Sequence
  targeting sequence with CTCN PAM
ucauuaaauggaaguggauc

SEQ ID NO: 11982 - RNA, 20 nt, Artificial Sequence
  targeting sequence with CTCN PAM
gccuauucaaccugaagaca

SEQ ID NO: 11983 - RNA, 20 nt, Artificial Sequence
  targeting sequence with CTCN PAM
uccuccuccucagccuauuc

SEQ ID NO: 11984 - RNA, 20 nt, Artificial Sequence
  targeting sequence with CTCN PAM
uccuccuccuccucagccua

SEQ ID NO: 11985 - RNA, 20 nt, Artificial Sequence
  targeting sequence with CTCN PAM
uccuccuccuccuccucagc

SEQ ID NO: 11986 - RNA, 20 nt, Artificial Sequence
  targeting sequence with CTCN PAM
uccuccuccuccuccuccuc

SEQ ID NO: 11987 - RNA, 20 nt, Artificial Sequence
  targeting sequence with CTCN PAM
uccuccuccuccuccuccuc

SEQ ID NO: 11988 - RNA, 20 nt, Artificial Sequence
  targeting sequence with CTCN PAM
uccuccuccuccuccuccuc

SEQ ID NO: 11989 - RNA, 20 nt, Artificial Sequence
  targeting sequence with CTCN PAM
cuggcacagcaucaccaauc

SEQ ID NO: 11990 - RNA, 20 nt, Artificial Sequence
  targeting sequence with CTCN PAM
gucucccuggcacagcauca

SEQ ID NO: 11991 - RNA, 20 nt, Artificial Sequence
  targeting sequence with CTCN PAM
uguaguuaaaacucauguug

SEQ ID NO: 11992 - RNA, 20 nt, Artificial Sequence
  targeting sequence with CTCN PAM
uguuguucaggggucaacug

SEQ ID NO: 11993 - RNA, 20 nt, Artificial Sequence
  targeting sequence with CTCN PAM
uuuaaucuucacaccaacca

SEQ ID NO: 11994 - RNA, 20 nt, Artificial Sequence
  targeting sequence with CTCN PAM
ugguuggugugaagauuaaa

SEQ ID NO: 11995 - RNA, 20 nt, Artificial Sequence
  targeting sequence with CTCN PAM
ucaguagcuuguuuggguca

SEQ ID NO: 11996 - RNA, 20 nt, Artificial Sequence
  targeting sequence with CTCN PAM
gggucagaauuccuagagau

SEQ ID NO: 11997 - RNA, 20 nt, Artificial Sequence
  targeting sequence with CTCN PAM
gagcccaaagcuuaugcuuu

SEQ ID NO: 11998 - RNA, 20 nt, Artificial Sequence
  targeting sequence with CTCN PAM
gagucucugggucagaauuc

SEQ ID NO: 11999 - RNA, 20 nt, Artificial Sequence
  targeting sequence with CTCN PAM
uccugguagguagcagguga

SEQ ID NO: 12000 - RNA, 20 nt, Artificial Sequence
  targeting sequence with CTCN PAM
cucauccugguagguagcag

SEQ ID NO: 12001 - RNA, 20 nt, Artificial Sequence
  targeting sequence with CTCN PAM
ucccucauccugguagguag

SEQ ID NO: 12002 - RNA, 20 nt, Artificial Sequence
  targeting sequence with CTCN PAM
uacuauuuccaucacuccuc

SEQ ID NO: 12003 - RNA, 20 nt, Artificial Sequence
  targeting sequence with CTCN PAM
cccuaauaucuacuauuuca

SEQ ID NO: 12004 - RNA, 20 nt, Artificial Sequence
  targeting sequence with CTCN PAM
ugcuugugaucucagcacuu

SEQ ID NO: 12005 - RNA, 20 nt, Artificial Sequence
  targeting sequence with CTCN PAM
gcacuuugggaagccaaggc

SEQ ID NO: 12006 - RNA, 20 nt, Artificial Sequence
  targeting sequence with CTCN PAM
ugauccacccgccuuggcuu

SEQ ID NO: 12007 - RNA, 20 nt, Artificial Sequence
  targeting sequence with CTCN PAM
guugcccaggcuauagugca

SEQ ID NO: 12008 - RNA, 20 nt, Artificial Sequence
  targeting sequence with CTCN PAM
cucuguugcccaggcuauag

SEQ ID NO: 12009 - RNA, 20 nt, Artificial Sequence
  targeting sequence with CTCN PAM
aaaaaaagguacuuuacaga

SEQ ID NO: 12010 - RNA, 20 nt, Artificial Sequence
  targeting sequence with CTCN PAM
cauaaaaagacucugaggaa

SEQ ID NO: 12011 - RNA, 20 nt, Artificial Sequence
  targeting sequence with CTCN PAM
gaggaagauacuguuccucu

SEQ ID NO: 12012 - RNA, 20 nt, Artificial Sequence
  targeting sequence with CTCN PAM
gagucuuuuuaugggaguca

SEQ ID NO: 12013 - RNA, 20 nt, Artificial Sequence
  targeting sequence with CTCN PAM
guguuucagaugaaggcauu

SEQ ID NO: 12014 - RNA, 20 nt, Artificial Sequence
  targeting sequence with CTCN PAM
augccuucaucugaaacaca

SEQ ID NO: 12015 - RNA, 20 nt, Artificial Sequence
  targeting sequence with CTCN PAM
gagaacagugacuugcccaa

SEQ ID NO: 12016 - RNA, 20 nt, Artificial Sequence
  targeting sequence with CTCN PAM
gagccucaaugccuucaucu

SEQ ID NO: 12017 - RNA, 20 nt, Artificial Sequence
  targeting sequence with CTCN PAM
cuccagucuguuccuucaua

SEQ ID NO: 12018 - RNA, 20 nt, Artificial Sequence
  targeting sequence with CTCN PAM
ccagucuguuccuucauaaa

SEQ ID NO: 12019 - RNA, 20 nt, Artificial Sequence
  targeting sequence with CTCN PAM
agucuguuccuucauaaagc

SEQ ID NO: 12020 - RNA, 20 nt, Artificial Sequence
  targeting sequence with CTCN PAM
uugcuuaaaaccuuucuuug

SEQ ID NO: 12021 - RNA, 20 nt, Artificial Sequence
  targeting sequence with CTCN PAM
uuauccuaaagcaaugggaa

SEQ ID NO: 12022 - RNA, 20 nt, Artificial Sequence
  targeting sequence with CTCN PAM
gcugugucccugagguccca

SEQ ID NO: 12023 - RNA, 20 nt, Artificial Sequence
  targeting sequence with CTCN PAM
gacaugccaggcuuuuccug

SEQ ID NO: 12024 - RNA, 20 nt, Artificial Sequence
  targeting sequence with CTCN PAM
ucucuacaucuggcuaagcu

SEQ ID NO: 12025 - RNA, 20 nt, Artificial Sequence
  targeting sequence with CTCN PAM
cuacaucuggcuaagcucug

SEQ ID NO: 12026 - RNA, 20 nt, Artificial Sequence
  targeting sequence with CTCN PAM
acaucuggcuaagcucugcu

SEQ ID NO: 12027 - RNA, 20 nt, Artificial Sequence
  targeting sequence with CTCN PAM
gcucauccuuuaggucucca

SEQ ID NO: 12028 - RNA, 20 nt, Artificial Sequence
  targeting sequence with CTCN PAM
uccuuuaggucuccacugaa

SEQ ID NO: 12029 - RNA, 20 nt, Artificial Sequence
  targeting sequence with CTCN PAM
acugaaggaucucauccuua

SEQ ID NO: 12030 - RNA, 20 nt, Artificial Sequence
  targeting sequence with CTCN PAM
uccuuagagaaauguucccu

SEQ ID NO: 12031 - RNA, 20 nt, Artificial Sequence
  targeting sequence with CTCN PAM
aaggaugagauccuucagug

SEQ ID NO: 12032 - RNA, 20 nt, Artificial Sequence
  targeting sequence with CTCN PAM
ucuaaauuaggucccccagg

SEQ ID NO: 12033 - RNA, 20 nt, Artificial Sequence
  targeting sequence with CTCN PAM
ugggggaccuaauuuagaug

SEQ ID NO: 12034 - RNA, 20 nt, Artificial Sequence
  targeting sequence with CTCN PAM
uuuugucugacugaaacuac

SEQ ID NO: 12035 - RNA, 20 nt, Artificial Sequence
  targeting sequence with CTCN PAM
aaaauguacuccuuuugucu

SEQ ID NO: 12036 - RNA, 20 nt, Artificial Sequence
  targeting sequence with CTCN PAM
caccuguaaucccagcacuu

SEQ ID NO: 12037 - RNA, 20 nt, Artificial Sequence
  targeting sequence with CTCN PAM
cuauaaaaaaauaaguaucu

SEQ ID NO: 12038 - RNA, 20 nt, Artificial Sequence
  targeting sequence with CTCN PAM
uucauaggauccgugucuua

SEQ ID NO: 12039 - RNA, 20 nt, Artificial Sequence
  targeting sequence with CTCN PAM
cugggaaaugcugguuuaag

SEQ ID NO: 12040 - RNA, 20 nt, Artificial Sequence
  targeting sequence with CTCN PAM
gggaaaugcugguuuaagau

SEQ ID NO: 12041 - RNA, 20 nt, Artificial Sequence
  targeting sequence with CTCN PAM
uaauacuguacaccuaaguu

SEQ ID NO: 12042 - RNA, 20 nt, Artificial Sequence
  targeting sequence with CTCN PAM
accuuccuauaccaaccaca

SEQ ID NO: 12043 - RNA, 20 nt, Artificial Sequence
  targeting sequence with CTCN PAM
ucucaguucaucugacauug

SEQ ID NO: 12044 - RNA, 20 nt, Artificial Sequence
  targeting sequence with CTCN PAM
guucaucugacauuguagac

SEQ ID NO: 12045 - RNA, 20 nt, Artificial Sequence
  targeting sequence with CTCN PAM
gagaauggccuuauauccac

SEQ ID NO: 12046 - RNA, 20 nt, Artificial Sequence
  targeting sequence with CTCN PAM
gagacagggacacuggaaga

SEQ ID NO: 12047 - RNA, 20 nt, Artificial Sequence
  targeting sequence with CTCN PAM
aaacaaaacaaaacaaaaca

SEQ ID NO: 12048 - RNA, 20 nt, Artificial Sequence
  targeting sequence with CTCN PAM
gucucaaaacaaaacaaaac

SEQ ID NO: 12049 - RNA, 20 nt, Artificial Sequence
  targeting sequence with CTCN PAM
gucucccaggcuacagugca

SEQ ID NO: 12050 - RNA, 20 nt, Artificial Sequence
  targeting sequence with CTCN PAM
caggcuacagugcaguggua

SEQ ID NO: 12051 - RNA, 20 nt, Artificial Sequence
  targeting sequence with CTCN PAM
cugcaacuacaaccuuccag

SEQ ID NO: 12052 - RNA, 20 nt, Artificial Sequence
  targeting sequence with CTCN PAM
aauaauccucuuacuucagc

SEQ ID NO: 12053 - RNA, 20 nt, Artificial Sequence
  targeting sequence with CTCN PAM
uacuucagcuucccaaauag

SEQ ID NO: 12054 - RNA, 20 nt, Artificial Sequence
  targeting sequence with CTCN PAM
accaagaaaaaaaaaaauuu

SEQ ID NO: 12055 - RNA, 20 nt, Artificial Sequence
  targeting sequence with CTCN PAM
ugggcucaagcaguccucuc

SEQ ID NO: 12056 - RNA, 20 nt, Artificial Sequence
  targeting sequence with CTCN PAM
agcaguccucucaaaguacu

SEQ ID NO: 12057 - RNA, 20 nt, Artificial Sequence
  targeting sequence with CTCN PAM
caaaguacugggauuacaga

SEQ ID NO: 12058 - RNA, 20 nt, Artificial Sequence
  targeting sequence with CTCN PAM
aaguacugggauuacagaua

SEQ ID NO: 12059 - RNA, 20 nt, Artificial Sequence
  targeting sequence with CTCN PAM
ucuucauaaaaaaaaauaau

SEQ ID NO: 12060 - RNA, 20 nt, Artificial Sequence
  targeting sequence with CTCN PAM
cuaugacuccugagcucaag

SEQ ID NO: 12061 - RNA, 20 nt, Artificial Sequence
  targeting sequence with CTCN PAM
ugagcucaagcaauccuucu

SEQ ID NO: 12062 - RNA, 20 nt, Artificial Sequence
  targeting sequence with CTCN PAM
ggagucauagugagaccucg

SEQ ID NO: 12063 - RNA, 20 nt, Artificial Sequence
  targeting sequence with CTCN PAM
agcaauccuucucccuuggc

SEQ ID NO: 12064 - RNA, 20 nt, Artificial Sequence
  targeting sequence with CTCN PAM
cuuggccgcccaaacugcug

SEQ ID NO: 12065 - RNA, 20 nt, Artificial Sequence
  targeting sequence with CTCN PAM
caccuguaaucccagcaguu

SEQ ID NO: 12066 - RNA, 20 nt, Artificial Sequence
  targeting sequence with CTCN PAM
gcuuccuuccuuuuuaaguc

SEQ ID NO: 12067 - RNA, 20 nt, Artificial Sequence
  targeting sequence with CTCN PAM
uucauucauuccuucaaaaa

SEQ ID NO: 12068 - RNA, 20 nt, Artificial Sequence
  targeting sequence with CTCN PAM
acccguuuuaguccuucacu

SEQ ID NO: 12069 - RNA, 20 nt, Artificial Sequence
  targeting sequence with CTCN PAM
gcuuucauuguugucuaagg

SEQ ID NO: 12070 - RNA, 20 nt, Artificial Sequence
  targeting sequence with CTCN PAM
aucuuccauuucugggccuc

SEQ ID NO: 12071 - RNA, 20 nt, Artificial Sequence
  targeting sequence with CTCN PAM
acaaaacaguaagaguaaca

SEQ ID NO: 12072 - RNA, 20 nt, Artificial Sequence
  targeting sequence with CTCN PAM
uacuguuuuguggaggccca

SEQ ID NO: 12073 - RNA, 20 nt, Artificial Sequence
  targeting sequence with CTCN PAM
caccuuggccuuuaggugcu

SEQ ID NO: 12074 - RNA, 20 nt, Artificial Sequence
  targeting sequence with CTCN PAM
agcaaucaauccucccaccu

SEQ ID NO: 12075 - RNA, 20 nt, Artificial Sequence
  targeting sequence with CTCN PAM
cuuuuggccagguugguuuu

SEQ ID NO: 12076 - RNA, 20 nt, Artificial Sequence
  targeting sequence with CTCN PAM
acaaauaagaaaacaguggg

SEQ ID NO: 12077 - RNA, 20 nt, Artificial Sequence
  targeting sequence with CTCN PAM
cccacuguuuucuuauuugu

SEQ ID NO: 12078 - RNA, 20 nt, Artificial Sequence
  targeting sequence with CTCN PAM
ucacccacuguuuucuuauu

SEQ ID NO: 12079 - RNA, 20 nt, Artificial Sequence
  targeting sequence with CTCN PAM
uucuccucacccacuguuuu

SEQ ID NO: 12080 - RNA, 20 nt, Artificial Sequence
  targeting sequence with CTCN PAM
uaaagaauuaauucuccuuc

SEQ ID NO: 12081 - RNA, 20 nt, Artificial Sequence
  targeting sequence with CTCN PAM
uacuccuaaagaauuaauuc

SEQ ID NO: 12082 - RNA, 20 nt, Artificial Sequence
  targeting sequence with CTCN PAM
ucugcaagugaccaacaaaa

SEQ ID NO: 12083 - RNA, 20 nt, Artificial Sequence
  targeting sequence with CTCN PAM
gacuuuagaccacaugcucu

SEQ ID NO: 12084 - RNA, 20 nt, Artificial Sequence
  targeting sequence with CTCN PAM
uuauuaaaaucuucaguugu

SEQ ID NO: 12085 - RNA, 20 nt, Artificial Sequence
  targeting sequence with CTCN PAM
uacaauccuauuacucauca

SEQ ID NO: 12086 - RNA, 20 nt, Artificial Sequence
  targeting sequence with CTCN PAM
ucaacuggcaucuuguuccu

SEQ ID NO: 12087 - RNA, 20 nt, Artificial Sequence
  targeting sequence with CTCN PAM
agugacuuugguacguucug

SEQ ID NO: 12088 - RNA, 20 nt, Artificial Sequence
  targeting sequence with CTCN PAM
ggauaaaaucaccauauucu

SEQ ID NO: 12089 - RNA, 20 nt, Artificial Sequence
  targeting sequence with CTCN PAM
caggauaaaaucaccauauu

SEQ ID NO: 12090 - RNA, 20 nt, Artificial Sequence
  targeting sequence with CTCN PAM
cucaggauaaaaucaccaua

SEQ ID NO: 12091 - RNA, 20 nt, Artificial Sequence
  targeting sequence with CTCN PAM
accuucaauggcugagggga

SEQ ID NO: 12092 - RNA, 20 nt, Artificial Sequence
  targeting sequence with CTCN PAM
gccauugaagguagagaagu

SEQ ID NO: 12093 - RNA, 20 nt, Artificial Sequence
  targeting sequence with CTCN PAM
ccucagccauugaagguaga

SEQ ID NO: 12094 - RNA, 20 nt, Artificial Sequence
  targeting sequence with CTCN PAM
gguaagacaucagagacuac

SEQ ID NO: 12095 - RNA, 20 nt, Artificial Sequence
  targeting sequence with CTCN PAM
gaugucuuaccagaguaaag

SEQ ID NO: 12096 - RNA, 20 nt, Artificial Sequence
  targeting sequence with CTCN PAM
caaucuuguuaccauuuccu

SEQ ID NO: 12097 - RNA, 20 nt, Artificial Sequence
  targeting sequence with CTCN PAM
gggaagccuucccugacuca

SEQ ID NO: 12098 - RNA, 20 nt, Artificial Sequence
  targeting sequence with CTCN PAM
cccuggcagagacagugcag

SEQ ID NO: 12099 - RNA, 20 nt, Artificial Sequence
  targeting sequence with CTCN PAM
gccagggugagucagggaag

SEQ ID NO: 12100 - RNA, 20 nt, Artificial Sequence
  targeting sequence with CTCN PAM
ccuuuguauugacccacauc

SEQ ID NO: 12101 - RNA, 20 nt, Artificial Sequence
  targeting sequence with CTCN PAM
cugaggggcugaacaccuug

SEQ ID NO: 12102 - RNA, 20 nt, Artificial Sequence
  targeting sequence with CTCN PAM
gggaggacagcuacagccac

SEQ ID NO: 12103 - RNA, 20 nt, Artificial Sequence
  targeting sequence with CTCN PAM
agguguucagccccucaggg

SEQ ID NO: 12104 - RNA, 20 nt, Artificial Sequence
  targeting sequence with CTCN PAM
ucaagguguucagccccuca

SEQ ID NO: 12105 - RNA, 20 nt, Artificial Sequence
  targeting sequence with CTCN PAM
uuugugccaguacuacacca

SEQ ID NO: 12106 - RNA, 20 nt, Artificial Sequence
  targeting sequence with CTCN PAM
acagacauuuuacugacacc

SEQ ID NO: 12107 - RNA, 20 nt, Artificial Sequence
  targeting sequence with CTCN PAM
cuccacagacauuuuacuga

SEQ ID NO: 12108 - RNA, 20 nt, Artificial Sequence
  targeting sequence with CTCN PAM
cuuccucccuccacagacau

SEQ ID NO: 12109 - RNA, 20 nt, Artificial Sequence
  targeting sequence with CTCN PAM
gcccaauuucacucccuucc

SEQ ID NO: 12110 - RNA, 20 nt, Artificial Sequence
  targeting sequence with CTCN PAM
aucagucuguguucguugcu

SEQ ID NO: 12111 - RNA, 20 nt, Artificial Sequence
  targeting sequence with CTCN PAM
ucuagugacuucauuguauc

SEQ ID NO: 12112 - RNA, 20 nt, Artificial Sequence
  targeting sequence with CTCN PAM
ucaucuagugacuucauugu

SEQ ID NO: 12113 - RNA, 20 nt, Artificial Sequence
  targeting sequence with CTCN PAM
gacuccucaucuagugacuu

SEQ ID NO: 12114 - RNA, 20 nt, Artificial Sequence
  targeting sequence with CTCN PAM
caguguuccaguucccuuau

SEQ ID NO: 12115 - RNA, 20 nt, Artificial Sequence
  targeting sequence with CTCN PAM
guguuccaguucccuuaucu

SEQ ID NO: 12116 - RNA, 20 nt, Artificial Sequence
  targeting sequence with CTCN PAM
uuuuagauaagggaacugga

SEQ ID NO: 12117 - RNA, 20 nt, Artificial Sequence
  targeting sequence with CTCN PAM
cugugucucacugauacggu

SEQ ID NO: 12118 - RNA, 20 nt, Artificial Sequence
  targeting sequence with CTCN PAM
cugauacgguucugguucug

SEQ ID NO: 12119 - RNA, 20 nt, Artificial Sequence
  targeting sequence with CTCN PAM
gaaccagaaccguaucagug

SEQ ID NO: 12120 - RNA, 20 nt, Artificial Sequence
  targeting sequence with CTCN PAM
uuugaaccucagaaccagaa

SEQ ID NO: 12121 - RNA, 20 nt, Artificial Sequence
  targeting sequence with CTCN PAM
cuuuugaaccucagaaccag

SEQ ID NO: 12122 - RNA, 20 nt, Artificial Sequence
  targeting sequence with CTCN PAM
auguauuuauacaauuggcu

SEQ ID NO: 12123 - RNA, 20 nt, Artificial Sequence
  targeting sequence with CTCN PAM
aggagcuuguggucuuagga

SEQ ID NO: 12124 - RNA, 20 nt, Artificial Sequence
  targeting sequence with CTCN PAM
uugaggguagggauucuauu

SEQ ID NO: 12125 - RNA, 20 nt, Artificial Sequence
  targeting sequence with CTCN PAM
uaagaccacaagcuccuuga

SEQ ID NO: 12126 - RNA, 20 nt, Artificial Sequence
  targeting sequence with CTCN PAM
aauagaaauucauuucuaau

SEQ ID NO: 12127 - RNA, 20 nt, Artificial Sequence
  targeting sequence with CTCN PAM
ggggcugucauaaagcucaa

SEQ ID NO: 12128 - RNA, 20 nt, Artificial Sequence
  targeting sequence with CTCN PAM
uucccacccuacugaugaaa

SEQ ID NO: 12129 - RNA, 20 nt, Artificial Sequence
  targeting sequence with CTCN PAM
uuuucaucaguaggguggga

SEQ ID NO: 12130 - RNA, 20 nt, Artificial Sequence
  targeting sequence with CTCN PAM
accucuuuuucaucaguagg

SEQ ID NO: 12131 - RNA, 20 nt, Artificial Sequence
  targeting sequence with CTCN PAM
acuuacuagcuaagggaccu

SEQ ID NO: 12132 - RNA, 20 nt, Artificial Sequence
  targeting sequence with CTCN PAM
guaugcaaucaccuggucua

SEQ ID NO: 12133 - RNA, 20 nt, Artificial Sequence
  targeting sequence with CTCN PAM
gcuaagcacugcugaaggag

SEQ ID NO: 12134 - RNA, 20 nt, Artificial Sequence
  targeting sequence with CTCN PAM
uucagcagugcuuagcagag

SEQ ID NO: 12135 - RNA, 20 nt, Artificial Sequence
  targeting sequence with CTCN PAM
ugggccuccuucagcagugc

SEQ ID NO: 12136 - RNA, 20 nt, Artificial Sequence
  targeting sequence with CTCN PAM
uuccuccugggccuccuuca

SEQ ID NO: 12137 - RNA, 20 nt, Artificial Sequence
  targeting sequence with CTCN PAM
aggcaggcuuaguggaacac

SEQ ID NO: 12138 - RNA, 20 nt, Artificial Sequence
  targeting sequence with CTCN PAM
aaacauuuugacgugugcac

SEQ ID NO: 12139 - RNA, 20 nt, Artificial Sequence
  targeting sequence with CTCN PAM
agugcacaaauacauggcca

SEQ ID NO: 12140 - RNA, 20 nt, Artificial Sequence
  targeting sequence with CTCN PAM
uagcaaguguaugucuagac

SEQ ID NO: 12141 - RNA, 20 nt, Artificial Sequence
  targeting sequence with CTCN PAM
gugccucauagcaaguguau

SEQ ID NO: 12142 - RNA, 20 nt, Artificial Sequence
  targeting sequence with CTCN PAM
ccccugucccagaugcccug

SEQ ID NO: 12143 - RNA, 20 nt, Artificial Sequence
  targeting sequence with CTCN PAM
cauggcacacuggucaccua

SEQ ID NO: 12144 - RNA, 20 nt, Artificial Sequence
  targeting sequence with CTCN PAM
cccauggcacacuggucacc

SEQ ID NO: 12145 - RNA, 20 nt, Artificial Sequence
  targeting sequence with CTCN PAM
gauagagucauguguuguga

SEQ ID NO: 12146 - RNA, 20 nt, Artificial Sequence
  targeting sequence with CTCN PAM
aucugagcugugccucuccc

SEQ ID NO: 12147 - RNA, 20 nt, Artificial Sequence
  targeting sequence with CTCN PAM
aucacaacacaugacucuau

SEQ ID NO: 12148 - RNA, 20 nt, Artificial Sequence
  targeting sequence with CTCN PAM
gguugcagugucaaaguuau

SEQ ID NO: 12149 - RNA, 20 nt, Artificial Sequence
  targeting sequence with CTCN PAM
aagaaaugacaguuucauug

SEQ ID NO: 12150 - RNA, 20 nt, Artificial Sequence
  targeting sequence with CTCN PAM
caaagaaaugacaguuucau

SEQ ID NO: 12151 - RNA, 20 nt, Artificial Sequence
  targeting sequence with CTCN PAM
guuuccuggucuugauauug

SEQ ID NO: 12152 - RNA, 20 nt, Artificial Sequence
  targeting sequence with CTCN PAM
ccuuaccuccaguuaucucc

SEQ ID NO: 12153 - RNA, 20 nt, Artificial Sequence
  targeting sequence with CTCN PAM
aguuaucuccaaacccuggu

SEQ ID NO: 12154 - RNA, 20 nt, Artificial Sequence
  targeting sequence with CTCN PAM
aaacccugguaaccacaaau

SEQ ID NO: 12155 - RNA, 20 nt, Artificial Sequence
  targeting sequence with CTCN PAM
auuucuauaauuuugucauu

SEQ ID NO: 12156 - RNA, 20 nt, Artificial Sequence
  targeting sequence with CTCN PAM
aaaggucauauacuguacga

SEQ ID NO: 12157 - RNA, 20 nt, Artificial Sequence
  targeting sequence with CTCN PAM
aggauuuuaugcugaaugaa

SEQ ID NO: 12158 - RNA, 20 nt, Artificial Sequence
  targeting sequence with CTCN PAM
ugaacagaagucugucucca

SEQ ID NO: 12159 - RNA, 20 nt, Artificial Sequence
  targeting sequence with CTCN PAM
aaacacaaaucaagcagcaa

SEQ ID NO: 12160 - RNA, 20 nt, Artificial Sequence
  targeting sequence with CTCN PAM
gacgauaagauuuauguucc

SEQ ID NO: 12161 - RNA, 20 nt, Artificial Sequence
  targeting sequence with CTCN PAM
caaaauccaauuauuucaug

SEQ ID NO: 12162 - RNA, 20 nt, Artificial Sequence
  targeting sequence with CTCN PAM
aaauccaauuauuucaugca

SEQ ID NO: 12163 - RNA, 20 nt, Artificial Sequence
  targeting sequence with CTCN PAM
gcugcaugaaauaauuggau

SEQ ID NO: 12164 - RNA, 20 nt, Artificial Sequence
  targeting sequence with CTCN PAM
ucgaugggaaagacuugugc

SEQ ID NO: 12165 - RNA, 20 nt, Artificial Sequence
  targeting sequence with CTCN PAM
augggaaagacuugugccuu

SEQ ID NO: 12166 - RNA, 20 nt, Artificial Sequence
  targeting sequence with CTCN PAM
uuugcuucaugaucaaaggc

SEQ ID NO: 12167 - RNA, 20 nt, Artificial Sequence
  targeting sequence with CTCN PAM
acauccagcuauacugagug

SEQ ID NO: 12168 - RNA, 20 nt, Artificial Sequence
  targeting sequence with CTCN PAM
guauagcuggauguugaggc

SEQ ID NO: 12169 - RNA, 20 nt, Artificial Sequence
  targeting sequence with CTCN PAM
acucaguauagcuggauguu

SEQ ID NO: 12170 - RNA, 20 nt, Artificial Sequence
  targeting sequence with CTCN PAM
cauuuucaacaagccuccac

SEQ ID NO: 12171 - RNA, 20 nt, Artificial Sequence
  targeting sequence with CTCN PAM
cacacuuugaugcuagaccu

SEQ ID NO: 12172 - RNA, 20 nt, Artificial Sequence
  targeting sequence with CTCN PAM
cauugacaggccaugugacc

SEQ ID NO: 12173 - RNA, 20 nt, Artificial Sequence
  targeting sequence with CTCN PAM
uugacaggccaugugaccuc

SEQ ID NO: 12174 - RNA, 20 nt, Artificial Sequence
  targeting sequence with CTCN PAM
ggaaaguuacuaaaucuuuc

SEQ ID NO: 12175 - RNA, 20 nt, Artificial Sequence
  targeting sequence with CTCN PAM
gaaagauuuaguaacuuucc

SEQ ID NO: 12176 - RNA, 20 nt, Artificial Sequence
  targeting sequence with CTCN PAM
agcucagaaagauuuaguaa

SEQ ID NO: 12177 - RNA, 20 nt, Artificial Sequence
  targeting sequence with CTCN PAM
ucugacagauagggauaaaa

SEQ ID NO: 12178 - RNA, 20 nt, Artificial Sequence
  targeting sequence with CTCN PAM
ucaagucaguauuuuuaucc

SEQ ID NO: 12179 - RNA, 20 nt, Artificial Sequence
  targeting sequence with CTCN PAM
ugaguguaaagcgugcagga

SEQ ID NO: 12180 - RNA, 20 nt, Artificial Sequence
  targeting sequence with CTCN PAM
ugaguuugugugcauuucac

SEQ ID NO: 12181 - RNA, 20 nt, Artificial Sequence
  targeting sequence with CTCN PAM
aaaugguagcuauucuugcu

SEQ ID NO: 12182 - RNA, 20 nt, Artificial Sequence
  targeting sequence with CTCN PAM
uagaagcugaacagcaagaa

SEQ ID NO: 12183 - RNA, 20 nt, Artificial Sequence
  targeting sequence with CTCN PAM
acagaugcugaacggaaggg

SEQ ID NO: 12184 - RNA, 20 nt, Artificial Sequence
  targeting sequence with CTCN PAM
uuaagugggaggggauugag

SEQ ID NO: 12185 - RNA, 20 nt, Artificial Sequence
  targeting sequence with CTCN PAM
cacuuaaagagcaccuuaag

SEQ ID NO: 12186 - RNA, 20 nt, Artificial Sequence
  targeting sequence with CTCN PAM
auccccucccacuuaaagag

SEQ ID NO: 12187 - RNA, 20 nt, Artificial Sequence
  targeting sequence with CTCN PAM
aucucaauccccucccacuu

SEQ ID NO: 12188 - RNA, 20 nt, Artificial Sequence
  targeting sequence with CTCN PAM
ccaucucaauccccucccac

SEQ ID NO: 12189 - RNA, 20 nt, Artificial Sequence
  targeting sequence with CTCN PAM
gggccagccaccacuuccca

SEQ ID NO: 12190 - RNA, 20 nt, Artificial Sequence
  targeting sequence with CTCN PAM
augacagcccuuagcuugug

SEQ ID NO: 12191 - RNA, 20 nt, Artificial Sequence
  targeting sequence with CTCN PAM
guacauaccucuaugacagc

SEQ ID NO: 12192 - RNA, 20 nt, Artificial Sequence
  targeting sequence with CTCN PAM
cccagcccucuguacauacc

SEQ ID NO: 12193 - RNA, 20 nt, Artificial Sequence
  targeting sequence with CTCN PAM
gaaaaaggcaccaaauggug

SEQ ID NO: 12194 - RNA, 20 nt, Artificial Sequence
  targeting sequence with CTCN PAM
ccauuuuuguuccguaugcu

SEQ ID NO: 12195 - RNA, 20 nt, Artificial Sequence
  targeting sequence with CTCN PAM
ucgccauuuuuguuccguau

SEQ ID NO: 12196 - RNA, 20 nt, Artificial Sequence
  targeting sequence with CTCN PAM
aucuuuacuuucuccucgcc

SEQ ID NO: 12197 - RNA, 20 nt, Artificial Sequence
  targeting sequence with CTCN PAM
cucucgccaauaugguccau

SEQ ID NO: 12198 - RNA, 20 nt, Artificial Sequence
  targeting sequence with CTCN PAM
cgccaauaugguccaucugc

SEQ ID NO: 12199 - RNA, 20 nt, Artificial Sequence
  targeting sequence with CTCN PAM
ccaauaugguccaucugcug

SEQ ID NO: 12200 - RNA, 20 nt, Artificial Sequence
  targeting sequence with CTCN PAM
uaaaguuguccuccuucuag

SEQ ID NO: 12201 - RNA, 20 nt, Artificial Sequence
  targeting sequence with CTCN PAM
uucuagaacaaacaccauca

SEQ ID NO: 12202 - RNA, 20 nt, Artificial Sequence
  targeting sequence with CTCN PAM
gguagcgggacuauuaaaaa

SEQ ID NO: 12203 - RNA, 20 nt, Artificial Sequence
  targeting sequence with CTCN PAM
uaauaaauuccauacauucu

SEQ ID NO: 12204 - RNA, 20 nt, Artificial Sequence
  targeting sequence with CTCN PAM
ucaaaaguugaguuuaggaa

SEQ ID NO: 12205 - RNA, 20 nt, Artificial Sequence
  targeting sequence with CTCN PAM
aaaguugaguuuaggaauga

SEQ ID NO: 12206 - RNA, 20 nt, Artificial Sequence
  targeting sequence with CTCN PAM
acuuuugaggaggcucuuaa

SEQ ID NO: 12207 - RNA, 20 nt, Artificial Sequence
  targeting sequence with CTCN PAM
ucugcuuugcuaaaaugucc

SEQ ID NO: 12208 - RNA, 20 nt, Artificial Sequence
  targeting sequence with CTCN PAM
acuauugauucauaaggaaa

SEQ ID NO: 12209 - RNA, 20 nt, Artificial Sequence
  targeting sequence with CTCN PAM
uugcuguggcuuuauuuuug

SEQ ID NO: 12210 - RNA, 20 nt, Artificial Sequence
  targeting sequence with CTCN PAM
aaguuugggcagaauaugug

SEQ ID NO: 12211 - RNA, 20 nt, Artificial Sequence
  targeting sequence with CTCN PAM
ugaaaaagcuauuuauuaac

SEQ ID NO: 12212 - RNA, 20 nt, Artificial Sequence
  targeting sequence with CTCN PAM
aggcuuuagggacgucugua

SEQ ID NO: 12213 - RNA, 20 nt, Artificial Sequence
  targeting sequence with CTCN PAM
aagucacauggacauagaaa

SEQ ID NO: 12214 - RNA, 20 nt, Artificial Sequence
  targeting sequence with CTCN PAM
caaagucacauggacauaga

SEQ ID NO: 12215 - RNA, 20 nt, Artificial Sequence
  targeting sequence with CTCN PAM
uuuuuuuuuuuuuuuuuuuu

SEQ ID NO: 12216 - RNA, 20 nt, Artificial Sequence
  targeting sequence with CTCN PAM
guaaaggauacugaugguuu

SEQ ID NO: 12217 - RNA, 20 nt, Artificial Sequence
  targeting sequence with CTCN PAM
gaggguaaacgaaagguccu

SEQ ID NO: 12218 - RNA, 20 nt, Artificial Sequence
  targeting sequence with CTCN PAM
gaggacucuguaaaggauac

SEQ ID NO: 12219 - RNA, 20 nt, Artificial Sequence
  targeting sequence with CTCN PAM
augucauuuuacagaugguu

SEQ ID NO: 12220 - RNA, 20 nt, Artificial Sequence
  targeting sequence with CTCN PAM
ggggcaggcuaauggccuuu

SEQ ID NO: 12221 - RNA, 20 nt, Artificial Sequence
  targeting sequence with CTCN PAM
gcagccacaaaucaaacagc

SEQ ID NO: 12222 - RNA, 20 nt, Artificial Sequence
  targeting sequence with CTCN PAM
aggcuaccauuuuuaauuca

SEQ ID NO: 12223 - RNA, 20 nt, Artificial Sequence
  targeting sequence with CTCN PAM
ugaauuaaaaaugguagccu

SEQ ID NO: 12224 - RNA, 20 nt, Artificial Sequence
  targeting sequence with CTCN PAM
ugcuucucaugaauuaaaaa

SEQ ID NO: 12225 - RNA, 20 nt, Artificial Sequence
  targeting sequence with CTCN PAM
uccagguaggguucagaggc

SEQ ID NO: 12226 - RNA, 20 nt, Artificial Sequence
  targeting sequence with CTCN PAM
agguaggguucagaggcucc

SEQ ID NO: 12227 - RNA, 20 nt, Artificial Sequence
  targeting sequence with CTCN PAM
gaacccuaccuggaggagga

SEQ ID NO: 12228 - RNA, 20 nt, Artificial Sequence
  targeting sequence with CTCN PAM
uuuuauuuuuuauuuuuauu

SEQ ID NO: 12229 - RNA, 20 nt, Artificial Sequence
  targeting sequence with CTCN PAM
caccucagccucccaaguag

SEQ ID NO: 12230 - RNA, 20 nt, Artificial Sequence
  targeting sequence with CTCN PAM
ccucagccucccaaguagcu

SEQ ID NO: 12231 - RNA, 20 nt, Artificial Sequence
  targeting sequence with CTCN PAM
gccucccaaguagcuuggau

SEQ ID NO: 12232 - RNA, 20 nt, Artificial Sequence
  targeting sequence with CTCN PAM
caaguagcuuggaucacagg

SEQ ID NO: 12233 - RNA, 20 nt, Artificial Sequence
  targeting sequence with CTCN PAM
accaaaaauacaaaaaauua

SEQ ID NO: 12234 - RNA, 20 nt, Artificial Sequence
  targeting sequence with CTCN PAM
ugaucucgagcgauucacuu

SEQ ID NO: 12235 - RNA, 20 nt, Artificial Sequence
  targeting sequence with CTCN PAM
agcgauucacuugccucggc

SEQ ID NO: 12236 - RNA, 20 nt, Artificial Sequence
  targeting sequence with CTCN PAM
agaucaggaguucaagacca

SEQ ID NO: 12237 - RNA, 20 nt, Artificial Sequence
  targeting sequence with CTCN PAM
gccuccugaagugcugggau

SEQ ID NO: 12238 - RNA, 20 nt, Artificial Sequence
  targeting sequence with CTCN PAM
ugaagugcugggauuacagg

SEQ ID NO: 12239 - RNA, 20 nt, Artificial Sequence
  targeting sequence with CTCN PAM
cgccuguaaucccagcacuu

SEQ ID NO: 12240 - RNA, 20 nt, Artificial Sequence
  targeting sequence with CTCN PAM
uugccaggauuuuaaauuau

SEQ ID NO: 12241 - RNA, 20 nt, Artificial Sequence
  targeting sequence with CTCN PAM
caucggcuguagacaguaag

SEQ ID NO: 12242 - RNA, 20 nt, Artificial Sequence
  targeting sequence with CTCN PAM
cccaucggcuguagacagua

SEQ ID NO: 12243 - RNA, 20 nt, Artificial Sequence
  targeting sequence with CTCN PAM
guucauccagaaacucuccc

SEQ ID NO: 12244 - RNA, 20 nt, Artificial Sequence
  targeting sequence with CTCN PAM
cuguucauccagaaacucuc

SEQ ID NO: 12245 - RNA, 20 nt, Artificial Sequence
  targeting sequence with CTCN PAM
uucucucuguucauccagaa

SEQ ID NO: 12246 - RNA, 20 nt, Artificial Sequence
  targeting sequence with CTCN PAM
gcauccucauucucucuguu

SEQ ID NO: 12247 - RNA, 20 nt, Artificial Sequence
  targeting sequence with CTCN PAM
gaagucagcaguguacagua

SEQ ID NO: 12248 - RNA, 20 nt, Artificial Sequence
  targeting sequence with CTCN PAM
cuacccugacuacuguacac

SEQ ID NO: 12249 - RNA, 20 nt, Artificial Sequence
  targeting sequence with CTCN PAM
gccucacuacccugacuacu

SEQ ID NO: 12250 - RNA, 20 nt, Artificial Sequence
  targeting sequence with CTCN PAM
ucugccucacuacccugacu

SEQ ID NO: 12251 - RNA, 20 nt, Artificial Sequence
  targeting sequence with CTCN PAM
gguucuuccuccucugccuc

SEQ ID NO: 12252 - RNA, 20 nt, Artificial Sequence
  targeting sequence with CTCN PAM
uccucugguucuuccuccuc

SEQ ID NO: 12253 - RNA, 20 nt, Artificial Sequence
  targeting sequence with CTCN PAM
caaguugucgucccugggac

SEQ ID NO: 12254 - RNA, 20 nt, Artificial Sequence
  targeting sequence with CTCN PAM
cugggacacacucacaaguu

SEQ ID NO: 12255 - RNA, 20 nt, Artificial Sequence
  targeting sequence with CTCN PAM
caggaucacuuuauacccac

SEQ ID NO: 12256 - RNA, 20 nt, Artificial Sequence
  targeting sequence with CTCN PAM
uuuagucuuuucaguauuuc

SEQ ID NO: 12257 - RNA, 20 nt, Artificial Sequence
  targeting sequence with CTCN PAM
ucaguugagauugccuguag

SEQ ID NO: 12258 - RNA, 20 nt, Artificial Sequence
  targeting sequence with CTCN PAM
acugaagagaagaaugacua

SEQ ID NO: 12259 - RNA, 20 nt, Artificial Sequence
  targeting sequence with CTCN PAM
ggccugcccauguuuucccu

SEQ ID NO: 12260 - RNA, 20 nt, Artificial Sequence
  targeting sequence with CTCN PAM
guuuggcaguagagaucuag

SEQ ID NO: 12261 - RNA, 20 nt, Artificial Sequence
  targeting sequence with CTCN PAM
acugccaaacugagauaucc

SEQ ID NO: 12262 - RNA, 20 nt, Artificial Sequence
  targeting sequence with CTCN PAM
agcuagaucucuacugccaa

SEQ ID NO: 12263 - RNA, 20 nt, Artificial Sequence
  targeting sequence with CTCN PAM
gguacuauguaaaacaguuu

SEQ ID NO: 12264 - RNA, 20 nt, Artificial Sequence
  targeting sequence with CTCN PAM
gggugggauucuuccaagga

SEQ ID NO: 12265 - RNA, 20 nt, Artificial Sequence
  targeting sequence with CTCN PAM
uuuacugguccccacuuccc

SEQ ID NO: 12266 - RNA, 20 nt, Artificial Sequence
  targeting sequence with CTCN PAM
gugccuuugauuguuucaac

SEQ ID NO: 12267 - RNA, 20 nt, Artificial Sequence
  targeting sequence with CTCN PAM
uguugaaacaaucaaaggca

SEQ ID NO: 12268 - RNA, 20 nt, Artificial Sequence
  targeting sequence with CTCN PAM
uggggcaguaggauucuuua

SEQ ID NO: 12269 - RNA, 20 nt, Artificial Sequence
  targeting sequence with CTCN PAM
cagggacugagcccagccca

SEQ ID NO: 12270 - RNA, 20 nt, Artificial Sequence
  targeting sequence with CTCN PAM
gucccugugagauggaucag

SEQ ID NO: 12271 - RNA, 20 nt, Artificial Sequence
  targeting sequence with CTCN PAM
gggcugggcucagucccugu

SEQ ID NO: 12272 - RNA, 20 nt, Artificial Sequence
  targeting sequence with CTCN PAM
ccaagagggcucacuggugg

SEQ ID NO: 12273 - RNA, 20 nt, Artificial Sequence
  targeting sequence with CTCN PAM
uggggaggccacauauggcu

SEQ ID NO: 12274 - RNA, 20 nt, Artificial Sequence
  targeting sequence with CTCN PAM
cuggugggcugggcuccugg

SEQ ID NO: 12275 - RNA, 20 nt, Artificial Sequence
  targeting sequence with CTCN PAM
uggauuguguuuggacuuug

SEQ ID NO: 12276 - RNA, 20 nt, Artificial Sequence
  targeting sequence with CTCN PAM
cucauuaacaucccucucgg

SEQ ID NO: 12277 - RNA, 20 nt, Artificial Sequence
  targeting sequence with CTCN PAM
uuaacaucccucucggucuu

SEQ ID NO: 12278 - RNA, 20 nt, Artificial Sequence
  targeting sequence with CTCN PAM
cggucuuugucucuuuuccc

SEQ ID NO: 12279 - RNA, 20 nt, Artificial Sequence
  targeting sequence with CTCN PAM
gucuuugucucuuuucccuu

SEQ ID NO: 12280 - RNA, 20 nt, Artificial Sequence
  targeting sequence with CTCN PAM
uuucccuuaguuuuggguua

SEQ ID NO: 12281 - RNA, 20 nt, Artificial Sequence
  targeting sequence with CTCN PAM
uggcuggguuuuacaaacaa

SEQ ID NO: 12282 - RNA, 20 nt, Artificial Sequence
  targeting sequence with CTCN PAM
uuguuuauuaauuccagcuu

SEQ ID NO: 12283 - RNA, 20 nt, Artificial Sequence
  targeting sequence with CTCN PAM
agggcuaggaaugcuuuucu

SEQ ID NO: 12284 - RNA, 20 nt, Artificial Sequence
  targeting sequence with CTCN PAM
gucacaaaaaaaaaaaagaa

SEQ ID NO: 12285 - RNA, 20 nt, Artificial Sequence
  targeting sequence with CTCN PAM
gucaccugggcuggagugca

SEQ ID NO: 12286 - RNA, 20 nt, Artificial Sequence
  targeting sequence with CTCN PAM
agcccaggugacagagccag

SEQ ID NO: 12287 - RNA, 20 nt, Artificial Sequence
  targeting sequence with CTCN PAM
gcucacugcaacuuccgccu

SEQ ID NO: 12288 - RNA, 20 nt, Artificial Sequence
  targeting sequence with CTCN PAM
cugcaacuuccgccucccgg

SEQ ID NO: 12289 - RNA, 20 nt, Artificial Sequence
  targeting sequence with CTCN PAM
cggguucuaagcgauucuug

SEQ ID NO: 12290 - RNA, 20 nt, Artificial Sequence
  targeting sequence with CTCN PAM
gccucuggaauagcugggau

SEQ ID NO: 12291 - RNA, 20 nt, Artificial Sequence
  targeting sequence with CTCN PAM
ggaauagcugggauuacaga

SEQ ID NO: 12292 - RNA, 20 nt, Artificial Sequence
  targeting sequence with CTCN PAM
ugaccucaggugauccaccu

SEQ ID NO: 12293 - RNA, 20 nt, Artificial Sequence
  targeting sequence with CTCN PAM
ggugauccaccugccucaac

SEQ ID NO: 12294 - RNA, 20 nt, Artificial Sequence
  targeting sequence with CTCN PAM
accucccaaagugcuggaau

SEQ ID NO: 12295 - RNA, 20 nt, Artificial Sequence
  targeting sequence with CTCN PAM
caaagugcuggaauuacaag

SEQ ID NO: 12296 - RNA, 20 nt, Artificial Sequence
  targeting sequence with CTCN PAM
cgcuuguaauuccagcacuu

SEQ ID NO: 12297 - RNA, 20 nt, Artificial Sequence
  targeting sequence with CTCN PAM
ugaacuagauucccagguag

SEQ ID NO: 12298 - RNA, 20 nt, Artificial Sequence
  targeting sequence with CTCN PAM
ccagccucaggcaagggagu

SEQ ID NO: 12299 - RNA, 20 nt, Artificial Sequence
  targeting sequence with CTCN PAM
agccucaggcaagggaguuu

SEQ ID NO: 12300 - RNA, 20 nt, Artificial Sequence
  targeting sequence with CTCN PAM
ggcaagggaguuucuccugu

SEQ ID NO: 12301 - RNA, 20 nt, Artificial Sequence
  targeting sequence with CTCN PAM
cuugccugaggcuggagagc

SEQ ID NO: 12302 - RNA, 20 nt, Artificial Sequence
  targeting sequence with CTCN PAM
ugugugcugguccuacaguc

SEQ ID NO: 12303 - RNA, 20 nt, Artificial Sequence
  targeting sequence with CTCN PAM
guuucaaagacaguuguuug

SEQ ID NO: 12304 - RNA, 20 nt, Artificial Sequence
  targeting sequence with CTCN PAM
gaaaacaaacaacugucuuu

SEQ ID NO: 12305 - RNA, 20 nt, Artificial Sequence
  targeting sequence with CTCN PAM
uuuuugaaaauuagauucag

SEQ ID NO: 12306 - RNA, 20 nt, Artificial Sequence
  targeting sequence with CTCN PAM
ugcaggcggggguccuugca

SEQ ID NO: 12307 - RNA, 20 nt, Artificial Sequence
  targeting sequence with CTCN PAM
uccugaagaaagaaaauuaa

SEQ ID NO: 12308 - RNA, 20 nt, Artificial Sequence
  targeting sequence with CTCN PAM
ugcagcacaaagacauuuuu

SEQ ID NO: 12309 - RNA, 20 nt, Artificial Sequence
  targeting sequence with CTCN PAM
gccaucuccccacauuuucu

SEQ ID NO: 12310 - RNA, 20 nt, Artificial Sequence
  targeting sequence with CTCN PAM
ccacauuuucuaguauguaa

SEQ ID NO: 12311 - RNA, 20 nt, Artificial Sequence
  targeting sequence with CTCN PAM
uacauacuagaaaauguggg

SEQ ID NO: 12312 - RNA, 20 nt, Artificial Sequence
  targeting sequence with CTCN PAM
auauugcagccuugccuauc

SEQ ID NO: 12313 - RNA, 20 nt, Artificial Sequence
  targeting sequence with CTCN PAM
ccaguaagcucugaaaugag

SEQ ID NO: 12314 - RNA, 20 nt, Artificial Sequence
  targeting sequence with CTCN PAM
gaaaugagagguuuaucuuc

SEQ ID NO: 12315 - RNA, 20 nt, Artificial Sequence
  targeting sequence with CTCN PAM
uuucagagcuuacuggggag

SEQ ID NO: 12316 - RNA, 20 nt, Artificial Sequence
  targeting sequence with CTCN PAM
cauuucagagcuuacugggg

SEQ ID NO: 12317 - RNA, 20 nt, Artificial Sequence
  targeting sequence with CTCN PAM
gugaaacagcagaucccagg

SEQ ID NO: 12318 - RNA, 20 nt, Artificial Sequence
  targeting sequence with CTCN PAM
acucugcuucaucccguaag

SEQ ID NO: 12319 - RNA, 20 nt, Artificial Sequence
  targeting sequence with CTCN PAM
gcuucaucccguaagacuga

SEQ ID NO: 12320 - RNA, 20 nt, Artificial Sequence
  targeting sequence with CTCN PAM
gguugccaaauguuguacag

SEQ ID NO: 12321 - RNA, 20 nt, Artificial Sequence
  targeting sequence with CTCN PAM
aagggcuuaaacaacaggaa

SEQ ID NO: 12322 - RNA, 20 nt, Artificial Sequence
  targeting sequence with CTCN PAM
ucagcaggcuguggcccuuc

SEQ ID NO: 12323 - RNA, 20 nt, Artificial Sequence
  targeting sequence with CTCN PAM
uuuaucuucuguugauuaga

SEQ ID NO: 12324 - RNA, 20 nt, Artificial Sequence
  targeting sequence with CTCN PAM
aaucaacagaagauaaaaga

SEQ ID NO: 12325 - RNA, 20 nt, Artificial Sequence
  targeting sequence with CTCN PAM
cuaaucaacagaagauaaaa

SEQ ID NO: 12326 - RNA, 20 nt, Artificial Sequence
  targeting sequence with CTCN PAM
gcugguagaaggaaacuuuc

SEQ ID NO: 12327 - RNA, 20 nt, Artificial Sequence
  targeting sequence with CTCN PAM
gaaaaugaaaauauaacagg

SEQ ID NO: 12328 - RNA, 20 nt, Artificial Sequence
  targeting sequence with CTCN PAM
aacaagaccucccaucucua

SEQ ID NO: 12329 - RNA, 20 nt, Artificial Sequence
  targeting sequence with CTCN PAM
aagauaaccucuaacaagac

SEQ ID NO: 12330 - RNA, 20 nt, Artificial Sequence
  targeting sequence with CTCN PAM
aagauggccugcucaaagau

SEQ ID NO: 12331 - RNA, 20 nt, Artificial Sequence
  targeting sequence with CTCN PAM
gaacugucauauauuuucau

SEQ ID NO: 12332 - RNA, 20 nt, Artificial Sequence
  targeting sequence with CTCN PAM
ccauucucugaacugucaua

SEQ ID NO: 12333 - RNA, 20 nt, Artificial Sequence
  targeting sequence with CTCN PAM
gaguuugugaccugaaaaca

SEQ ID NO: 12334 - RNA, 20 nt, Artificial Sequence
  targeting sequence with CTCN PAM
gagaugcagucacccuguac

SEQ ID NO: 12335 - RNA, 20 nt, Artificial Sequence
  targeting sequence with CTCN PAM
guuuucaggucacaaacucu

SEQ ID NO: 12336 - RNA, 20 nt, Artificial Sequence
  targeting sequence with CTCN PAM
ucagcucuguuuucagguca

SEQ ID NO: 12337 - RNA, 20 nt, Artificial Sequence
  targeting sequence with CTCN PAM
ugccuguaaucccagcacuu

SEQ ID NO: 12338 - RNA, 20 nt, Artificial Sequence
  targeting sequence with CTCN PAM
agccaggcgugguggcagcu

SEQ ID NO: 12339 - RNA, 20 nt, Artificial Sequence
  targeting sequence with CTCN PAM
gguccuuuauaaucacaucu

SEQ ID NO: 12340 - RNA, 20 nt, Artificial Sequence
  targeting sequence with CTCN PAM
auggaaacaaguuauucuuc

SEQ ID NO: 12341 - RNA, 20 nt, Artificial Sequence
  targeting sequence with CTCN PAM
auauuuuaauccacccucca

SEQ ID NO: 12342 - RNA, 20 nt, Artificial Sequence
  targeting sequence with CTCN PAM
cuauauuuuaauccacccuc

SEQ ID NO: 12343 - RNA, 20 nt, Artificial Sequence
  targeting sequence with CTCN PAM
ucccucuuacaugacauguu

SEQ ID NO: 12344 - RNA, 20 nt, Artificial Sequence
  targeting sequence with CTCN PAM
cuuuaucuuuucuuuacucg

SEQ ID NO: 12345 - RNA, 20 nt, Artificial Sequence
  targeting sequence with CTCN PAM
guuucccauggcugauuucc

SEQ ID NO: 12346 - RNA, 20 nt, Artificial Sequence
  targeting sequence with CTCN PAM
cauuuuaauuaacuaucauc

SEQ ID NO: 12347 - RNA, 20 nt, Artificial Sequence
  targeting sequence with CTCN PAM
uuuuaauuaacuaucaucua

SEQ ID NO: 12348 - RNA, 20 nt, Artificial Sequence
  targeting sequence with CTCN PAM
cuauucaucugcuuaaugug

SEQ ID NO: 12349 - RNA, 20 nt, Artificial Sequence
  targeting sequence with CTCN PAM
auucaucugcuuaaugugug

SEQ ID NO: 12350 - RNA, 20 nt, Artificial Sequence
  targeting sequence with CTCN PAM
gacuaacacaaaaguauggg

SEQ ID NO: 12351 - RNA, 20 nt, Artificial Sequence
  targeting sequence with CTCN PAM
gugaacaccaagaagaaaaa

SEQ ID NO: 12352 - RNA, 20 nt, Artificial Sequence
  targeting sequence with CTCN PAM
auucuuuccuuuccucugga

SEQ ID NO: 12353 - RNA, 20 nt, Artificial Sequence
  targeting sequence with CTCN PAM
ggaacucuaauuacacuuac

SEQ ID NO: 12354 - RNA, 20 nt, Artificial Sequence
  targeting sequence with CTCN PAM
acugaauaucuggaaacccu

SEQ ID NO: 12355 - RNA, 20 nt, Artificial Sequence
  targeting sequence with CTCN PAM
uacuuugcuucucuuuucug

SEQ ID NO: 12356 - RNA, 20 nt, Artificial Sequence
  targeting sequence with CTCN PAM
uuaaguucuuaaguucaauu

SEQ ID NO: 12357 - RNA, 20 nt, Artificial Sequence
  targeting sequence with CTCN PAM
agugguaauaaggaacuugg

SEQ ID NO: 12358 - RNA, 20 nt, Artificial Sequence
  targeting sequence with CTCN PAM
aaaaaaauauauuuuuaauu

SEQ ID NO: 12359 - RNA, 20 nt, Artificial Sequence
  targeting sequence with CTCN PAM
gcuaauuaaaaauauauuuu

SEQ ID NO: 12360 - RNA, 20 nt, Artificial Sequence
  targeting sequence with CTCN PAM
agucccagcuacugggggug

SEQ ID NO: 12361 - RNA, 20 nt, Artificial Sequence
  targeting sequence with CTCN PAM
ccacccccaguagcugggac

SEQ ID NO: 12362 - RNA, 20 nt, Artificial Sequence
  targeting sequence with CTCN PAM
gccccucaccacccccagua

SEQ ID NO: 12363 - RNA, 20 nt, Artificial Sequence
  targeting sequence with CTCN PAM
gccucagccccucaccaccc

SEQ ID NO: 12364 - RNA, 20 nt, Artificial Sequence
  targeting sequence with CTCN PAM
auuccucugccucagccccu

SEQ ID NO: 12365 - RNA, 20 nt, Artificial Sequence
  targeting sequence with CTCN PAM
augcaaccuugaacuucugg

SEQ ID NO: 12366 - RNA, 20 nt, Artificial Sequence
  targeting sequence with CTCN PAM
guggcuuaggcuggaaugca

SEQ ID NO: 12367 - RNA, 20 nt, Artificial Sequence
  targeting sequence with CTCN PAM
guggccaauaagcacaugaa

SEQ ID NO: 12368 - RNA, 20 nt, Artificial Sequence
  targeting sequence with CTCN PAM
auaucauuagccaucaggaa

SEQ ID NO: 12369 - RNA, 20 nt, Artificial Sequence
  targeting sequence with CTCN PAM
uugugguuucaauuugcauu

SEQ ID NO: 12370 - RNA, 20 nt, Artificial Sequence
  targeting sequence with CTCN PAM
cuaaaauggagaaauuggaa

SEQ ID NO: 12371 - RNA, 20 nt, Artificial Sequence
  targeting sequence with CTCN PAM
auuuuagugagugcgaauua

SEQ ID NO: 12372 - RNA, 20 nt, Artificial Sequence
  targeting sequence with CTCN PAM
uacacugcuaaugcaaauau

SEQ ID NO: 12373 - RNA, 20 nt, Artificial Sequence
  targeting sequence with CTCN PAM
acguugaaccuuuuuuagga

SEQ ID NO: 12374 - RNA, 20 nt, Artificial Sequence
  targeting sequence with CTCN PAM
uggccuauauuuuuuuauuu

SEQ ID NO: 12375 - RNA, 20 nt, Artificial Sequence
  targeting sequence with CTCN PAM
cuccuguaaucccagcacuu

SEQ ID NO: 12376 - RNA, 20 nt, Artificial Sequence
  targeting sequence with CTCN PAM
uguaaucccagcacuuuggg

SEQ ID NO: 12377 - RNA, 20 nt, Artificial Sequence
  targeting sequence with CTCN PAM
caaagugcugggauuacagg

SEQ ID NO: 12378 - RNA, 20 nt, Artificial Sequence
  targeting sequence with CTCN PAM
gaugauccacccaccuuggc

SEQ ID NO: 12379 - RNA, 20 nt, Artificial Sequence
  targeting sequence with CTCN PAM
ggaguuugagacuagccggg

SEQ ID NO: 12380 - RNA, 20 nt, Artificial Sequence
  targeting sequence with CTCN PAM
ugagcucagaugauccaccc

SEQ ID NO: 12381 - RNA, 20 nt, Artificial Sequence
  targeting sequence with CTCN PAM
aacuccugagcucagaugau

SEQ ID NO: 12382 - RNA, 20 nt, Artificial Sequence
  targeting sequence with CTCN PAM
uuguugucccggcuagucuc

SEQ ID NO: 12383 - RNA, 20 nt, Artificial Sequence
  targeting sequence with CTCN PAM
gcaaaaaauacaaaaauuag

SEQ ID NO: 12384 - RNA, 20 nt, Artificial Sequence
  targeting sequence with CTCN PAM
cacaucuguagucccagcua

SEQ ID NO: 12385 - RNA, 20 nt, Artificial Sequence
  targeting sequence with CTCN PAM
caaguagcugggacuacaga

SEQ ID NO: 12386 - RNA, 20 nt, Artificial Sequence
  targeting sequence with CTCN PAM
gccucccaaguagcugggac

SEQ ID NO: 12387 - RNA, 20 nt, Artificial Sequence
  targeting sequence with CTCN PAM
uaccucagccucccaaguag

SEQ ID NO: 12388 - RNA, 20 nt, Artificial Sequence
  targeting sequence with CTCN PAM
acuucccagcuucacgugau

SEQ ID NO: 12389 - RNA, 20 nt, Artificial Sequence
  targeting sequence with CTCN PAM
agccugggcaacagagucag

SEQ ID NO: 12390 - RNA, 20 nt, Artificial Sequence
  targeting sequence with CTCN PAM
agcgaucuuccugccucagc

SEQ ID NO: 12391 - RNA, 20 nt, Artificial Sequence
  targeting sequence with CTCN PAM
uggacucaagcgaucuuccu

SEQ ID NO: 12392 - RNA, 20 nt, Artificial Sequence
  targeting sequence with CTCN PAM
cugcagccuucaacuccugg

SEQ ID NO: 12393 - RNA, 20 nt, Artificial Sequence
  targeting sequence with CTCN PAM
agccugggugacagagugag

SEQ ID NO: 12394 - RNA, 20 nt, Artificial Sequence
  targeting sequence with CTCN PAM
gucacccaggcuggagugca

SEQ ID NO: 12395 - RNA, 20 nt, Artificial Sequence
  targeting sequence with CTCN PAM
cucugucacccaggcuggag

SEQ ID NO: 12396 - RNA, 20 nt, Artificial Sequence
  targeting sequence with CTCN PAM
ucauuuuuuaauucuuguuu

SEQ ID NO: 12397 - RNA, 20 nt, Artificial Sequence
  targeting sequence with CTCN PAM
gcuuuauaaaauacuuuuuu

SEQ ID NO: 12398 - RNA, 20 nt, Artificial Sequence
  targeting sequence with CTCN PAM
ccaacuuuagagggaguugg

SEQ ID NO: 12399 - RNA, 20 nt, Artificial Sequence
  targeting sequence with CTCN PAM
gauuggaaaggaucgggcac

SEQ ID NO: 12400 - RNA, 20 nt, Artificial Sequence
  targeting sequence with CTCN PAM
ccuuuaguaaaguagcugau

SEQ ID NO: 12401 - RNA, 20 nt, Artificial Sequence
  targeting sequence with CTCN PAM
uuucaccaaggauggagugc

SEQ ID NO: 12402 - RNA, 20 nt, Artificial Sequence
  targeting sequence with CTCN PAM
auccuuggugaaaagagaua

SEQ ID NO: 12403 - RNA, 20 nt, Artificial Sequence
  targeting sequence with CTCN PAM
ccaacagucccaagccgcac

SEQ ID NO: 12404 - RNA, 20 nt, Artificial Sequence
  targeting sequence with CTCN PAM
uggguguggacgugucaagc

SEQ ID NO: 12405 - RNA, 20 nt, Artificial Sequence
  targeting sequence with CTCN PAM
ucuuaccacauaguuggaau

SEQ ID NO: 12406 - RNA, 20 nt, Artificial Sequence
  targeting sequence with CTCN PAM
ggagaaagucugcauucccc

SEQ ID NO: 12407 - RNA, 20 nt, Artificial Sequence
  targeting sequence with CTCN PAM
cuggagaaagucugcauucc

SEQ ID NO: 12408 - RNA, 20 nt, Artificial Sequence
  targeting sequence with CTCN PAM
caccccgcagguggucggcu

SEQ ID NO: 12409 - RNA, 20 nt, Artificial Sequence
  targeting sequence with CTCN PAM
ccccgcagguggucggcugc

SEQ ID NO: 12410 - RNA, 20 nt, Artificial Sequence
  targeting sequence with CTCN PAM
gugaucaggugcugcacaau

SEQ ID NO: 12411 - RNA, 20 nt, Artificial Sequence
  targeting sequence with CTCN PAM
uaccuuucugcucagugauc

SEQ ID NO: 12412 - RNA, 20 nt, Artificial Sequence
  targeting sequence with CTCN PAM
ucccaaggucuggaccugcc

SEQ ID NO: 12413 - RNA, 20 nt, Artificial Sequence
  targeting sequence with CTCN PAM
cccucuguccacuuaaguug

SEQ ID NO: 12414 - RNA, 20 nt, Artificial Sequence
  targeting sequence with CTCN PAM
cucuguccacuuaaguugcu

SEQ ID NO: 12415 - RNA, 20 nt, Artificial Sequence
  targeting sequence with CTCN PAM
guccacuuaaguugcugugc

SEQ ID NO: 12416 - RNA, 20 nt, Artificial Sequence
  targeting sequence with CTCN PAM
auccacuuacuucaggugua

SEQ ID NO: 12417 - RNA, 20 nt, Artificial Sequence
  targeting sequence with CTCN PAM
gcacagcacuaguggccccc

SEQ ID NO: 12418 - RNA, 20 nt, Artificial Sequence
  targeting sequence with CTCN PAM
ucugcacagcacuaguggcc

SEQ ID NO: 12419 - RNA, 20 nt, Artificial Sequence
  targeting sequence with CTCN PAM
gcugaacccugggauccaaa

SEQ ID NO: 12420 - RNA, 20 nt, Artificial Sequence
  targeting sequence with CTCN PAM
aaagauuuuucaaugagagu

SEQ ID NO: 12421 - RNA, 20 nt, Artificial Sequence
  targeting sequence with CTCN PAM
uugaaaaaucuuuagaguau

SEQ ID NO: 12422 - RNA, 20 nt, Artificial Sequence
  targeting sequence with CTCN PAM
cauugaaaaaucuuuagagu

SEQ ID NO: 12423 - RNA, 20 nt, Artificial Sequence
  targeting sequence with CTCN PAM
cuuuaauugccaguagcgcu

SEQ ID NO: 12424 - RNA, 20 nt, Artificial Sequence
  targeting sequence with CTCN PAM
gccuugcaccuuacauaaca

SEQ ID NO: 12425 - RNA, 20 nt, Artificial Sequence
  targeting sequence with CTCN PAM
ugcuagaacuagauauuuuu

SEQ ID NO: 12426 - RNA, 20 nt, Artificial Sequence
  targeting sequence with CTCN PAM
uugcauuuaauccgaacugu

SEQ ID NO: 12427 - RNA, 20 nt, Artificial Sequence
  targeting sequence with CTCN PAM
ggcaguuggauagccaaucg

SEQ ID NO: 12428 - RNA, 20 nt, Artificial Sequence
  targeting sequence with CTCN PAM
ucuaugaguuguauucagag

SEQ ID NO: 12429 - RNA, 20 nt, Artificial Sequence
  targeting sequence with CTCN PAM
uagaugaggauuuucucugg

SEQ ID NO: 12430 - RNA, 20 nt, Artificial Sequence
  targeting sequence with CTCN PAM
gaauacaacucauagaugag

SEQ ID NO: 12431 - RNA, 20 nt, Artificial Sequence
  targeting sequence with CTCN PAM
uuuacccgguaaugcauguc

SEQ ID NO: 12432 - RNA, 20 nt, Artificial Sequence
  targeting sequence with CTCN PAM
aacuucuugauaaucuucuc

SEQ ID NO: 12433 - RNA, 20 nt, Artificial Sequence
  targeting sequence with CTCN PAM
ugguggugugugccaaucac

SEQ ID NO: 12434 - RNA, 20 nt, Artificial Sequence
  targeting sequence with CTCN PAM
uucaacaugcugcugcccac

SEQ ID NO: 12435 - RNA, 20 nt, Artificial Sequence
  targeting sequence with CTCN PAM
ugacuugcugauagagucug

SEQ ID NO: 12436 - RNA, 20 nt, Artificial Sequence
  targeting sequence with CTCN PAM
aguuuauggcucaugacuug

SEQ ID NO: 12437 - RNA, 20 nt, Artificial Sequence
  targeting sequence with CTCN PAM
uggguucaagcauuccuccc

SEQ ID NO: 12438 - RNA, 20 nt, Artificial Sequence
  targeting sequence with CTCN PAM
aacuccuggguucaagcauu

SEQ ID NO: 12439 - RNA, 20 nt, Artificial Sequence
  targeting sequence with CTCN PAM
caccuauaaucccaguacuu

SEQ ID NO: 12440 - RNA, 20 nt, Artificial Sequence
  targeting sequence with CTCN PAM
guaauugucaaggaaguuuu

SEQ ID NO: 12441 - RNA, 20 nt, Artificial Sequence
  targeting sequence with CTCN PAM
agauucuuagagagugucua

SEQ ID NO: 12442 - RNA, 20 nt, Artificial Sequence
  targeting sequence with CTCN PAM
aagaaucuugagaaauauuu

SEQ ID NO: 12443 - RNA, 20 nt, Artificial Sequence
  targeting sequence with CTCN PAM
cuaagaaucuugagaaauau

SEQ ID NO: 12444 - RNA, 20 nt, Artificial Sequence
  targeting sequence with CTCN PAM
uggcauugacuuagacacuc

SEQ ID NO: 12445 - RNA, 20 nt, Artificial Sequence
  targeting sequence with CTCN PAM
aagucuuuccaaacuucucu

SEQ ID NO: 12446 - RNA, 20 nt, Artificial Sequence
  targeting sequence with CTCN PAM
caaagucuuuccaaacuucu

SEQ ID NO: 12447 - RNA, 20 nt, Artificial Sequence
  targeting sequence with CTCN PAM
acuuccaagaugcugggcua

SEQ ID NO: 12448 - RNA, 20 nt, Artificial Sequence
  targeting sequence with CTCN PAM
aacagaacuauguaaaacua

SEQ ID NO: 12449 - RNA, 20 nt, Artificial Sequence
  targeting sequence with CTCN PAM
aagcgguuuaggguugcuac

SEQ ID NO: 12450 - RNA, 20 nt, Artificial Sequence
  targeting sequence with CTCN PAM
aaaguacacauacuugccac

SEQ ID NO: 12451 - RNA, 20 nt, Artificial Sequence
  targeting sequence with CTCN PAM
ggccuaggcugccugggugg

SEQ ID NO: 12452 - RNA, 20 nt, Artificial Sequence
  targeting sequence with CTCN PAM
gaucuucaaugcaaaccccc

SEQ ID NO: 12453 - RNA, 20 nt, Artificial Sequence
  targeting sequence with CTCN PAM
guggggaagccuugcaugga

SEQ ID NO: 12454 - RNA, 20 nt, Artificial Sequence
  targeting sequence with CTCN PAM
augcaaggcuuccccacgga

SEQ ID NO: 12455 - RNA, 20 nt, Artificial Sequence
  targeting sequence with CTCN PAM
ccuuagggacagaaagaucu

SEQ ID NO: 12456 - RNA, 20 nt, Artificial Sequence
  targeting sequence with CTCN PAM
uuggggaggucugggggcac

SEQ ID NO: 12457 - RNA, 20 nt, Artificial Sequence
  targeting sequence with CTCN PAM
ccaaggagaucuuucugucc

SEQ ID NO: 12458 - RNA, 20 nt, Artificial Sequence
  targeting sequence with CTCN PAM
gcauggaaauucaacagaau

SEQ ID NO: 12459 - RNA, 20 nt, Artificial Sequence
  targeting sequence with CTCN PAM
uaggaagcaaacccagcucu

SEQ ID NO: 12460 - RNA, 20 nt, Artificial Sequence
  targeting sequence with CTCN PAM
gcugaaggacaggcacugca

SEQ ID NO: 12461 - RNA, 20 nt, Artificial Sequence
  targeting sequence with CTCN PAM
uucacuccgcugaaggacag

SEQ ID NO: 12462 - RNA, 20 nt, Artificial Sequence
  targeting sequence with CTCN PAM
cgcuccuucacuccgcugaa

SEQ ID NO: 12463 - RNA, 20 nt, Artificial Sequence
  targeting sequence with CTCN PAM
aucugccacucccgcuccuu

SEQ ID NO: 12464 - RNA, 20 nt, Artificial Sequence
  targeting sequence with CTCN PAM
cauucguuacaucaagguga

SEQ ID NO: 12465 - RNA, 20 nt, Artificial Sequence
  targeting sequence with CTCN PAM
uucguuacaucaaggugauc

SEQ ID NO: 12466 - RNA, 20 nt, Artificial Sequence
  targeting sequence with CTCN PAM
uggaagagaaggccucuuag

SEQ ID NO: 12467 - RNA, 20 nt, Artificial Sequence
  targeting sequence with CTCN PAM
uccaggagggccaccgauca

SEQ ID NO: 12468 - RNA, 20 nt, Artificial Sequence
  targeting sequence with CTCN PAM
uaguggggcugaagaaugga

SEQ ID NO: 12469 - RNA, 20 nt, Artificial Sequence
  targeting sequence with CTCN PAM
ccuguccauucuucagcccc

SEQ ID NO: 12470 - RNA, 20 nt, Artificial Sequence
  targeting sequence with CTCN PAM
cucacgucuccugucaggcu

SEQ ID NO: 12471 - RNA, 20 nt, Artificial Sequence
  targeting sequence with CTCN PAM
cgucuccugucaggcugaua

SEQ ID NO: 12472 - RNA, 20 nt, Artificial Sequence
  targeting sequence with CTCN PAM
ugucaggcugauaaucugca

SEQ ID NO: 12473 - RNA, 20 nt, Artificial Sequence
  targeting sequence with CTCN PAM
gagcuggguucucagggcag

SEQ ID NO: 12474 - RNA, 20 nt, Artificial Sequence
  targeting sequence with CTCN PAM
gagucauugcuagacggguc

SEQ ID NO: 12475 - RNA, 20 nt, Artificial Sequence
  targeting sequence with CTCN PAM
gggcaggaaaagggcuucuc

SEQ ID NO: 12476 - RNA, 20 nt, Artificial Sequence
  targeting sequence with CTCN PAM
ccuccaugggugaauugugg

SEQ ID NO: 12477 - RNA, 20 nt, Artificial Sequence
  targeting sequence with CTCN PAM
uccaugggugaauugugggg

SEQ ID NO: 12478 - RNA, 20 nt, Artificial Sequence
  targeting sequence with CTCN PAM
augggugaauuguggggcag

SEQ ID NO: 12479 - RNA, 20 nt, Artificial Sequence
  targeting sequence with CTCN PAM
ggcugccccacaauucaccc

SEQ ID NO: 12480 - RNA, 20 nt, Artificial Sequence
  targeting sequence with CTCN PAM
aaaaacugaacucaggcugc

SEQ ID NO: 12481 - RNA, 20 nt, Artificial Sequence
  targeting sequence with CTCN PAM
ggccaaaggugcuguggccc

SEQ ID NO: 12482 - RNA, 20 nt, Artificial Sequence
  targeting sequence with CTCN PAM
cacuccuagcaggcccacgu

SEQ ID NO: 12483 - RNA, 20 nt, Artificial Sequence
  targeting sequence with CTCN PAM
uagcaggcccacguuuuggc

SEQ ID NO: 12484 - RNA, 20 nt, Artificial Sequence
  targeting sequence with CTCN PAM
gccaaaacgugggccugcua

SEQ ID NO: 12485 - RNA, 20 nt, Artificial Sequence
  targeting sequence with CTCN PAM
acucugccaaaacgugggcc

SEQ ID NO: 12486 - RNA, 20 nt, Artificial Sequence
  targeting sequence with CTCN PAM
acauguagccaaagguuaua

SEQ ID NO: 12487 - RNA, 20 nt, Artificial Sequence
  targeting sequence with CTCN PAM
agaaggugggagauuuguua

SEQ ID NO: 12488 - RNA, 20 nt, Artificial Sequence
  targeting sequence with CTCN PAM
caccuucuggagaccuuaag

SEQ ID NO: 12489 - RNA, 20 nt, Artificial Sequence
  targeting sequence with CTCN PAM
aacaaaucucccaccuucug

SEQ ID NO: 12490 - RNA, 20 nt, Artificial Sequence
  targeting sequence with CTCN PAM
agaaauccacagaagcaaca

SEQ ID NO: 12491 - RNA, 20 nt, Artificial Sequence
  targeting sequence with CTCN PAM
cucuagaaauccacagaagc

SEQ ID NO: 12492 - RNA, 20 nt, Artificial Sequence
  targeting sequence with CTCN PAM
gccucccucuagaaauccac

SEQ ID NO: 12493 - RNA, 20 nt, Artificial Sequence
  targeting sequence with CTCN PAM
ugauuagggcagcgagugga

SEQ ID NO: 12494 - RNA, 20 nt, Artificial Sequence
  targeting sequence with CTCN PAM
cugcccuaaucaggagcuga

SEQ ID NO: 12495 - RNA, 20 nt, Artificial Sequence
  targeting sequence with CTCN PAM
agauacugauagaugucaua

SEQ ID NO: 12496 - RNA, 20 nt, Artificial Sequence
  targeting sequence with CTCN PAM
gcauaagaaaaguucuaagu

SEQ ID NO: 12497 - RNA, 20 nt, Artificial Sequence
  targeting sequence with CTCN PAM
gccauaagccaucugcugca

SEQ ID NO: 12498 - RNA, 20 nt, Artificial Sequence
  targeting sequence with CTCN PAM
ugcccugugacuuccauccc

SEQ ID NO: 12499 - RNA, 20 nt, Artificial Sequence
  targeting sequence with CTCN PAM
caugcccugugacuuccauc

SEQ ID NO: 12500 - RNA, 20 nt, Artificial Sequence
  targeting sequence with CTCN PAM
gugaggcugguuuuacauga

SEQ ID NO: 12501 - RNA, 20 nt, Artificial Sequence
  targeting sequence with CTCN PAM
cagagguaaagugaccugcc

SEQ ID NO: 12502 - RNA, 20 nt, Artificial Sequence
  targeting sequence with CTCN PAM
uguaaaaccagccucacaga

SEQ ID NO: 12503 - RNA, 20 nt, Artificial Sequence
  targeting sequence with CTCN PAM
aaaaaaaauuuuuuuuaaac

SEQ ID NO: 12504 - RNA, 20 nt, Artificial Sequence
  targeting sequence with CTCN PAM
gaucucugcuagguggcauc

SEQ ID NO: 12505 - RNA, 20 nt, Artificial Sequence
  targeting sequence with CTCN PAM
gcuagguggcaucuccuaaa

SEQ ID NO: 12506 - RNA, 20 nt, Artificial Sequence
  targeting sequence with CTCN PAM
uaaagcugcaguuuggguaa

SEQ ID NO: 12507 - RNA, 20 nt, Artificial Sequence
  targeting sequence with CTCN PAM
cuucagugucuguucggacu

SEQ ID NO: 12508 - RNA, 20 nt, Artificial Sequence
  targeting sequence with CTCN PAM
gccugucucagggcugucau

SEQ ID NO: 12509 - RNA, 20 nt, Artificial Sequence
  targeting sequence with CTCN PAM
gggcugucauuacuucugca

SEQ ID NO: 12510 - RNA, 20 nt, Artificial Sequence
  targeting sequence with CTCN PAM
gaugaaccucgcuucuggcc

SEQ ID NO: 12511 - RNA, 20 nt, Artificial Sequence
  targeting sequence with CTCN PAM
cuucuggccuccuaaggaua

SEQ ID NO: 12512 - RNA, 20 nt, Artificial Sequence
  targeting sequence with CTCN PAM
uaaggauaagccauugcccc

SEQ ID NO: 12513 - RNA, 20 nt, Artificial Sequence
  targeting sequence with CTCN PAM
uucuuuugaugaguccuuuu

SEQ ID NO: 12514 - RNA, 20 nt, Artificial Sequence
  targeting sequence with CTCN PAM
ucaaaagaaagaggggggug

SEQ ID NO: 12515 - RNA, 20 nt, Artificial Sequence
  targeting sequence with CTCN PAM
gugcagggaaaaggacucau

SEQ ID NO: 12516 - RNA, 20 nt, Artificial Sequence
  targeting sequence with CTCN PAM
caccaccuucaccagaagcu

SEQ ID NO: 12517 - RNA, 20 nt, Artificial Sequence
  targeting sequence with CTCN PAM
gcaagaacaacucccaccac

SEQ ID NO: 12518 - RNA, 20 nt, Artificial Sequence
  targeting sequence with CTCN PAM
uugcuaucguccugcugaag

SEQ ID NO: 12519 - RNA, 20 nt, Artificial Sequence
  targeting sequence with CTCN PAM
uguccaagcagcgcacagcu

SEQ ID NO: 12520 - RNA, 20 nt, Artificial Sequence
  targeting sequence with CTCN PAM
cguaagaagcuggccguggu

SEQ ID NO: 12521 - RNA, 20 nt, Artificial Sequence
  targeting sequence with CTCN PAM
uuggugucgaugucauacac

SEQ ID NO: 12522 - RNA, 20 nt, Artificial Sequence
  targeting sequence with CTCN PAM
gggacuucaccugaaaaagc

SEQ ID NO: 12523 - RNA, 20 nt, Artificial Sequence
  targeting sequence with CTCN PAM
aaucaaaggaugaugucccu

SEQ ID NO: 12524 - RNA, 20 nt, Artificial Sequence
  targeting sequence with CTCN PAM
ccucuagcuucccagucccu

SEQ ID NO: 12525 - RNA, 20 nt, Artificial Sequence
  targeting sequence with CTCN PAM
ucuagcuucccagucccugc

SEQ ID NO: 12526 - RNA, 20 nt, Artificial Sequence
  targeting sequence with CTCN PAM
agcuucccagucccugcagg

SEQ ID NO: 12527 - RNA, 20 nt, Artificial Sequence
  targeting sequence with CTCN PAM
ugcagggacugggaagcuag

SEQ ID NO: 12528 - RNA, 20 nt, Artificial Sequence
  targeting sequence with CTCN PAM
ccugcucuggcccaggcagg

SEQ ID NO: 12529 - RNA, 20 nt, Artificial Sequence
  targeting sequence with CTCN PAM
ugcucuggcccaggcagguc

SEQ ID NO: 12530 - RNA, 20 nt, Artificial Sequence
  targeting sequence with CTCN PAM
ggcccaggcaggucucuggg

SEQ ID NO: 12531 - RNA, 20 nt, Artificial Sequence
  targeting sequence with CTCN PAM
gggaggggcaggggccaagc

SEQ ID NO: 12532 - RNA, 20 nt, Artificial Sequence
  targeting sequence with CTCN PAM
cagagaccugccugggccag

SEQ ID NO: 12533 - RNA, 20 nt, Artificial Sequence
  targeting sequence with CTCN PAM
gugcaugugcuuggccccug

SEQ ID NO: 12534 - RNA, 20 nt, Artificial Sequence
  targeting sequence with CTCN PAM
gggacucugugcaugugcuu

SEQ ID NO: 12535 - RNA, 20 nt, Artificial Sequence
  targeting sequence with CTCN PAM
ucccacacaggcacaagccg

SEQ ID NO: 12536 - RNA, 20 nt, Artificial Sequence
  targeting sequence with CTCN PAM
cacacaggcacaagccgcag

SEQ ID NO: 12537 - RNA, 20 nt, Artificial Sequence
  targeting sequence with CTCN PAM
uuaacuuugguuuccuugcc

SEQ ID NO: 12538 - RNA, 20 nt, Artificial Sequence
  targeting sequence with CTCN PAM
gagccagcagagccuuucuu

SEQ ID NO: 12539 - RNA, 20 nt, Artificial Sequence
  targeting sequence with CTCN PAM
gagccuucgguuuccauugg

SEQ ID NO: 12540 - RNA, 20 nt, Artificial Sequence
  targeting sequence with CTCN PAM
gcuggcucagagccuucggu

SEQ ID NO: 12541 - RNA, 20 nt, Artificial Sequence
  targeting sequence with CTCN PAM
gagaggggugugacguuggc

SEQ ID NO: 12542 - RNA, 20 nt, Artificial Sequence
  targeting sequence with CTCN PAM
gagucauugccccauuucuu

SEQ ID NO: 12543 - RNA, 20 nt, Artificial Sequence
  targeting sequence with CTCN PAM
cagagucauugccccauuuc

SEQ ID NO: 12544 - RNA, 20 nt, Artificial Sequence
  targeting sequence with CTCN PAM
gugaauggggcgauggaugc

SEQ ID NO: 12545 - RNA, 20 nt, Artificial Sequence
  targeting sequence with CTCN PAM
ccugcugcaggccugccugu

SEQ ID NO: 12546 - RNA, 20 nt, Artificial Sequence
  targeting sequence with CTCN PAM
ucuagcauucuugugaauua

SEQ ID NO: 12547 - RNA, 20 nt, Artificial Sequence
  targeting sequence with CTCN PAM
acugaacaacgccuacaacc

SEQ ID NO: 12548 - RNA, 20 nt, Artificial Sequence
  targeting sequence with CTCN PAM
ggccacagggcuggaugacu

SEQ ID NO: 12549 - RNA, 20 nt, Artificial Sequence
  targeting sequence with CTCN PAM
ggugacacacuuccucaggc

SEQ ID NO: 12550 - RNA, 20 nt, Artificial Sequence
  targeting sequence with CTCN PAM
gugccccgggccugguuggc

SEQ ID NO: 12551 - RNA, 20 nt, Artificial Sequence
  targeting sequence with CTCN PAM
cgccauucuuucucucuuua

SEQ ID NO: 12552 - RNA, 20 nt, Artificial Sequence
  targeting sequence with CTCN PAM
cuuuaggucuuuguaggugg

SEQ ID NO: 12553 - RNA, 20 nt, Artificial Sequence
  targeting sequence with CTCN PAM
uuaggucuuuguaggugguc

SEQ ID NO: 12554 - RNA, 20 nt, Artificial Sequence
  targeting sequence with CTCN PAM
ggaaaaccaguccugaccac

SEQ ID NO: 12555 - RNA, 20 nt, Artificial Sequence
  targeting sequence with CTCN PAM
agcuuuggggggaacuucac

SEQ ID NO: 12556 - RNA, 20 nt, Artificial Sequence
  targeting sequence with CTCN PAM
ugacugguuuccucggccac

SEQ ID NO: 12557 - RNA, 20 nt, Artificial Sequence
  targeting sequence with CTCN PAM
gccacugcaggguuuccuga

SEQ ID NO: 12558 - RNA, 20 nt, Artificial Sequence
  targeting sequence with CTCN PAM
uccuuguucucagcagcaga

SEQ ID NO: 12559 - RNA, 20 nt, Artificial Sequence
  targeting sequence with CTCN PAM
uuguucucagcagcagaauc

SEQ ID NO: 12560 - RNA, 20 nt, Artificial Sequence
  targeting sequence with CTCN PAM
gcagcagaaucgauggggga

SEQ ID NO: 12561 - RNA, 20 nt, Artificial Sequence
  targeting sequence with CTCN PAM
cccaucgauucugcugcuga

SEQ ID NO: 12562 - RNA, 20 nt, Artificial Sequence
  targeting sequence with CTCN PAM
agaccccucccccaucgauu

SEQ ID NO: 12563 - RNA, 20 nt, Artificial Sequence
  targeting sequence with CTCN PAM
ccacuccagaccccuccccc

SEQ ID NO: 12564 - RNA, 20 nt, Artificial Sequence
  targeting sequence with CTCN PAM
gucaauuagaaggaguuacc

SEQ ID NO: 12565 - RNA, 20 nt, Artificial Sequence
  targeting sequence with CTCN PAM
uucuaauugacugaggcugc

SEQ ID NO: 12566 - RNA, 20 nt, Artificial Sequence
  targeting sequence with CTCN PAM
agcccagagguaacuccaug

SEQ ID NO: 12567 - RNA, 20 nt, Artificial Sequence
  targeting sequence with CTCN PAM
gggcuagagguggccaggua

SEQ ID NO: 12568 - RNA, 20 nt, Artificial Sequence
  targeting sequence with CTCN PAM
augucagucucaacucacuc

SEQ ID NO: 12569 - RNA, 20 nt, Artificial Sequence
  targeting sequence with CTCN PAM
acucacucauguccuugaga

SEQ ID NO: 12570 - RNA, 20 nt, Artificial Sequence
  targeting sequence with CTCN PAM
cucauguccuugagagagua

SEQ ID NO: 12571 - RNA, 20 nt, Artificial Sequence
  targeting sequence with CTCN PAM
uguccuugagagaguagaau

SEQ ID NO: 12572 - RNA, 20 nt, Artificial Sequence
  targeting sequence with CTCN PAM
aggacaugagugaguugaga

SEQ ID NO: 12573 - RNA, 20 nt, Artificial Sequence
  targeting sequence with CTCN PAM
caaggacaugagugaguuga

SEQ ID NO: 12574 - RNA, 20 nt, Artificial Sequence
  targeting sequence with CTCN PAM
cucaaggacaugagugaguu

SEQ ID NO: 12575 - RNA, 20 nt, Artificial Sequence
  targeting sequence with CTCN PAM
uuccccgaaaccauucuacu

SEQ ID NO: 12576 - RNA, 20 nt, Artificial Sequence
  targeting sequence with CTCN PAM
cuuuccccgaaaccauucua

SEQ ID NO: 12577 - RNA, 20 nt, Artificial Sequence
  targeting sequence with CTCN PAM
cuaacuuaagaucacacagu

SEQ ID NO: 12578 - RNA, 20 nt, Artificial Sequence
  targeting sequence with CTCN PAM
cugagccuuaauuacuuuuc

SEQ ID NO: 12579 - RNA, 20 nt, Artificial Sequence
  targeting sequence with CTCN PAM
gagccuuaauuacuuuucuc

SEQ ID NO: 12580 - RNA, 20 nt, Artificial Sequence
  targeting sequence with CTCN PAM
gagaggcucacuaacuuaag

SEQ ID NO: 12581 - RNA, 20 nt, Artificial Sequence
  targeting sequence with CTCN PAM
aaaaugaaauuaguaauugc

SEQ ID NO: 12582 - RNA, 20 nt, Artificial Sequence
  targeting sequence with CTCN PAM
guguugagcacaaaaugggg

SEQ ID NO: 12583 - RNA, 20 nt, Artificial Sequence
  targeting sequence with CTCN PAM
acacugagcuaggcacugua

SEQ ID NO: 12584 - RNA, 20 nt, Artificial Sequence
  targeting sequence with CTCN PAM
ccagccucaccucccaccua

SEQ ID NO: 12585 - RNA, 20 nt, Artificial Sequence
  targeting sequence with CTCN PAM
ccucccaccuauagggggca

SEQ ID NO: 12586 - RNA, 20 nt, Artificial Sequence
  targeting sequence with CTCN PAM
caccuauagggggcauagcu

SEQ ID NO: 12587 - RNA, 20 nt, Artificial Sequence
  targeting sequence with CTCN PAM
ccuagccugccauagagcca

SEQ ID NO: 12588 - RNA, 20 nt, Artificial Sequence
  targeting sequence with CTCN PAM
gcccugccaggagacaucag

SEQ ID NO: 12589 - RNA, 20 nt, Artificial Sequence
  targeting sequence with CTCN PAM
uggcagggcugagaaucacc

SEQ ID NO: 12590 - RNA, 20 nt, Artificial Sequence
  targeting sequence with CTCN PAM
uaccuuucugccuaggaucu

SEQ ID NO: 12591 - RNA, 20 nt, Artificial Sequence
  targeting sequence with CTCN PAM
ugaaauaugcucauaccuuu

SEQ ID NO: 12592 - RNA, 20 nt, Artificial Sequence
  targeting sequence with CTCN PAM
aaaauuccaacaacacgcag

SEQ ID NO: 12593 - RNA, 20 nt, Artificial Sequence
  targeting sequence with CTCN PAM
caggauccccacugucccug

SEQ ID NO: 12594 - RNA, 20 nt, Artificial Sequence
  targeting sequence with CTCN PAM
cacuggguguuccaagcuac

SEQ ID NO: 12595 - RNA, 20 nt, Artificial Sequence
  targeting sequence with CTCN PAM
gcuucucgggaggaggcuac

SEQ ID NO: 12596 - RNA, 20 nt, Artificial Sequence
  targeting sequence with CTCN PAM
ggaggaggcuaccucaacau

SEQ ID NO: 12597 - RNA, 20 nt, Artificial Sequence
  targeting sequence with CTCN PAM
cgagaagcagagcauguccu

SEQ ID NO: 12598 - RNA, 20 nt, Artificial Sequence
  targeting sequence with CTCN PAM
ucccgagaagcagagcaugu

SEQ ID NO: 12599 - RNA, 20 nt, Artificial Sequence
  targeting sequence with CTCN PAM
acaucaaagccagcaccuuc

SEQ ID NO: 12600 - RNA, 20 nt, Artificial Sequence
  targeting sequence with CTCN PAM
aagaucuucugccuccaugu

SEQ ID NO: 12601 - RNA, 20 nt, Artificial Sequence
  targeting sequence with CTCN PAM
augucuucuccauuucugcc

SEQ ID NO: 12602 - RNA, 20 nt, Artificial Sequence
  targeting sequence with CTCN PAM
auuucugccguggaggugcc

SEQ ID NO: 12603 - RNA, 20 nt, Artificial Sequence
  targeting sequence with CTCN PAM
acggcagaaauggagaagac

SEQ ID NO: 12604 - RNA, 20 nt, Artificial Sequence
  targeting sequence with CTCN PAM
uagcacuggcaaggcugaca

SEQ ID NO: 12605 - RNA, 20 nt, Artificial Sequence
  targeting sequence with CTCN PAM
ucccuuccuuuauggcuauc

SEQ ID NO: 12606 - RNA, 20 nt, Artificial Sequence
  targeting sequence with CTCN PAM
uuucaccucacauucgguua

SEQ ID NO: 12607 - RNA, 20 nt, Artificial Sequence
  targeting sequence with CTCN PAM
cauucgguuauggcagcccc

SEQ ID NO: 12608 - RNA, 20 nt, Artificial Sequence
  targeting sequence with CTCN PAM
acaaucuccuaaagcaucgu

SEQ ID NO: 12609 - RNA, 20 nt, Artificial Sequence
  targeting sequence with CTCN PAM
uaaagcaucguucuguguca

SEQ ID NO: 12610 - RNA, 20 nt, Artificial Sequence
  targeting sequence with CTCN PAM
cauaaauuguaggaaauaau

SEQ ID NO: 12611 - RNA, 20 nt, Artificial Sequence
  targeting sequence with CTCN PAM
guauuauuuccuacaauuua

SEQ ID NO: 12612 - RNA, 20 nt, Artificial Sequence
  targeting sequence with CTCN PAM
agagugaucuucccacccau

SEQ ID NO: 12613 - RNA, 20 nt, Artificial Sequence
  targeting sequence with CTCN PAM
agagcuaugcacacuguuac

SEQ ID NO: 12614 - RNA, 20 nt, Artificial Sequence
  targeting sequence with CTCN PAM
caccacagucauggcacuga

SEQ ID NO: 12615 - RNA, 20 nt, Artificial Sequence
  targeting sequence with CTCN PAM
cuccugccugguccccaccu

SEQ ID NO: 12616 - RNA, 20 nt, Artificial Sequence
  targeting sequence with CTCN PAM
ugccugguccccaccugccu

SEQ ID NO: 12617 - RNA, 20 nt, Artificial Sequence
  targeting sequence with CTCN PAM
gucagucuguuuuccccaua

SEQ ID NO: 12618 - RNA, 20 nt, Artificial Sequence
  targeting sequence with CTCN PAM
gcuucaggcuagagcccacu

SEQ ID NO: 12619 - RNA, 20 nt, Artificial Sequence
  targeting sequence with CTCN PAM
agccugaagcugaguuguau

SEQ ID NO: 12620 - RNA, 20 nt, Artificial Sequence
  targeting sequence with CTCN PAM
aaacucaugacugcaagacu

SEQ ID NO: 12621 - RNA, 20 nt, Artificial Sequence
  targeting sequence with CTCN PAM
ugacugcaagacuuacuggg

SEQ ID NO: 12622 - RNA, 20 nt, Artificial Sequence
  targeting sequence with CTCN PAM
gaucugaauuccacuaacau

SEQ ID NO: 12623 - RNA, 20 nt, Artificial Sequence
  targeting sequence with CTCN PAM
ugcuuucuggucuuuuuccu

SEQ ID NO: 12624 - RNA, 20 nt, Artificial Sequence
  targeting sequence with CTCN PAM
uucccuucuuccucuugcuu

SEQ ID NO: 12625 - RNA, 20 nt, Artificial Sequence
  targeting sequence with CTCN PAM
uccugcugccacuuccaccc

SEQ ID NO: 12626 - RNA, 20 nt, Artificial Sequence
  targeting sequence with CTCN PAM
uggacuguguccucgucauc

SEQ ID NO: 12627 - RNA, 20 nt, Artificial Sequence
  targeting sequence with CTCN PAM
ucauccuugucugccccauu

SEQ ID NO: 12628 - RNA, 20 nt, Artificial Sequence
  targeting sequence with CTCN PAM
ucucccucaauugccccaaa

SEQ ID NO: 12629 - RNA, 20 nt, Artificial Sequence
  targeting sequence with CTCN PAM
cucaauugccccaaacuagc

SEQ ID NO: 12630 - RNA, 20 nt, Artificial Sequence
  targeting sequence with CTCN PAM
auugccccaaacuagcucug

SEQ ID NO: 12631 - RNA, 20 nt, Artificial Sequence
  targeting sequence with CTCN PAM
gcuuauuuuauuaaaagguu

SEQ ID NO: 12632 - RNA, 20 nt, Artificial Sequence
  targeting sequence with CTCN PAM
caagauugccauccugaccu

SEQ ID NO: 12633 - RNA, 20 nt, Artificial Sequence
  targeting sequence with CTCN PAM
aaaauaaaugcaguuugcug

SEQ ID NO: 12634 - RNA, 20 nt, Artificial Sequence
  targeting sequence with CTCN PAM
cugacuguggccggccaaga

SEQ ID NO: 12635 - RNA, 20 nt, Artificial Sequence
  targeting sequence with CTCN PAM
gacuguggccggccaagagg

SEQ ID NO: 12636 - RNA, 20 nt, Artificial Sequence
  targeting sequence with CTCN PAM
uggccggccacagucagaga

SEQ ID NO: 12637 - RNA, 20 nt, Artificial Sequence
  targeting sequence with CTCN PAM
ucuuggccggccacagucag

SEQ ID NO: 12638 - RNA, 20 nt, Artificial Sequence
  targeting sequence with CTCN PAM
ggcuccucuuggccggccac

SEQ ID NO: 12639 - RNA, 20 nt, Artificial Sequence
  targeting sequence with CTCN PAM
gccaggacuuuaagauucag

SEQ ID NO: 12640 - RNA, 20 nt, Artificial Sequence
  targeting sequence with CTCN PAM
agacaaaggcuguucaucug

SEQ ID NO: 12641 - RNA, 20 nt, Artificial Sequence
  targeting sequence with CTCN PAM
gccuccggccauccuguggu

SEQ ID NO: 12642 - RNA, 20 nt, Artificial Sequence
  targeting sequence with CTCN PAM
ggccauccugugguuuuggc

SEQ ID NO: 12643 - RNA, 20 nt, Artificial Sequence
  targeting sequence with CTCN PAM
gggccaaaaccacaggaugg

SEQ ID NO: 12644 - RNA, 20 nt, Artificial Sequence
  targeting sequence with CTCN PAM
cugggccaaaaccacaggau

SEQ ID NO: 12645 - RNA, 20 nt, Artificial Sequence
  targeting sequence with CTCN PAM
ucucugggccaaaaccacag

SEQ ID NO: 12646 - RNA, 20 nt, Artificial Sequence
  targeting sequence with CTCN PAM
cuccucucugggccaaaacc

SEQ ID NO: 12647 - RNA, 20 nt, Artificial Sequence
  targeting sequence with CTCN PAM
uuguccuacuuggcagcccu

SEQ ID NO: 12648 - RNA, 20 nt, Artificial Sequence
  targeting sequence with CTCN PAM
uagggcucguuguccuacuu

SEQ ID NO: 12649 - RNA, 20 nt, Artificial Sequence
  targeting sequence with CTCN PAM
aggcgguggugacuucaugu

SEQ ID NO: 12650 - RNA, 20 nt, Artificial Sequence
  targeting sequence with CTCN PAM
gagaguauuuguucaguggg

SEQ ID NO: 12651 - RNA, 20 nt, Artificial Sequence
  targeting sequence with CTCN PAM
gagcuauacuuuaucuugcu

SEQ ID NO: 12652 - RNA, 20 nt, Artificial Sequence
  targeting sequence with CTCN PAM
cugagcuauacuuuaucuug

SEQ ID NO: 12653 - RNA, 20 nt, Artificial Sequence
  targeting sequence with CTCN PAM
acucaaauugugccucccaa

SEQ ID NO: 12654 - RNA, 20 nt, Artificial Sequence
  targeting sequence with CTCN PAM
aauugugccucccaaguaag

SEQ ID NO: 12655 - RNA, 20 nt, Artificial Sequence
  targeting sequence with CTCN PAM
caaguaaguccaaguguuag

SEQ ID NO: 12656 - RNA, 20 nt, Artificial Sequence
  targeting sequence with CTCN PAM
gcugugauaugccugccuga

SEQ ID NO: 12657 - RNA, 20 nt, Artificial Sequence
  targeting sequence with CTCN PAM
ggcaggcauaucacagcuga

SEQ ID NO: 12658 - RNA, 20 nt, Artificial Sequence
  targeting sequence with CTCN PAM
cggggcagucagcauggcaa

SEQ ID NO: 12659 - RNA, 20 nt, Artificial Sequence
  targeting sequence with CTCN PAM
uuccccgaaccacaccaacu

SEQ ID NO: 12660 - RNA, 20 nt, Artificial Sequence
  targeting sequence with CTCN PAM
gccaucucaagcagcuguaa

SEQ ID NO: 12661 - RNA, 20 nt, Artificial Sequence
  targeting sequence with CTCN PAM
agcagcuguaacuagagcaa

SEQ ID NO: 12662 - RNA, 20 nt, Artificial Sequence
  targeting sequence with CTCN PAM
aguuacagcugcuugagaug

SEQ ID NO: 12663 - RNA, 20 nt, Artificial Sequence
  targeting sequence with CTCN PAM
uuucacucuuuggggccuca

SEQ ID NO: 12664 - RNA, 20 nt, Artificial Sequence
  targeting sequence with CTCN PAM
uuggggccucauuucuuuuc

SEQ ID NO: 12665 - RNA, 20 nt, Artificial Sequence
  targeting sequence with CTCN PAM
uuucuuuucugugaaauggg

SEQ ID NO: 12666 - RNA, 20 nt, Artificial Sequence
  targeting sequence with CTCN PAM
uuauuacugacucauaaaau

SEQ ID NO: 12667 - RNA, 20 nt, Artificial Sequence
  targeting sequence with CTCN PAM
uaaaauagcaaaaaccacaa

SEQ ID NO: 12668 - RNA, 20 nt, Artificial Sequence
  targeting sequence with CTCN PAM
uugugugcuuuaagaaaagc

SEQ ID NO: 12669 - RNA, 20 nt, Artificial Sequence
  targeting sequence with CTCN PAM
ugaaagcuuuucuuaaagca

SEQ ID NO: 12670 - RNA, 20 nt, Artificial Sequence
  targeting sequence with CTCN PAM
aacuccugaaagcuuuucuu

SEQ ID NO: 12671 - RNA, 20 nt, Artificial Sequence
  targeting sequence with CTCN PAM
uggaagcuuucucaaacucc

SEQ ID NO: 12672 - RNA, 20 nt, Artificial Sequence
  targeting sequence with CTCN PAM
gaucaaguuucaccaucucc

SEQ ID NO: 12673 - RNA, 20 nt, Artificial Sequence
  targeting sequence with CTCN PAM
gggcucagaucaaguuucac

SEQ ID NO: 12674 - RNA, 20 nt, Artificial Sequence
  targeting sequence with CTCN PAM
cagggcucagaucaaguuuc

SEQ ID NO: 12675 - RNA, 20 nt, Artificial Sequence
  targeting sequence with CTCN PAM
uccuuuccagaccucucagg

SEQ ID NO: 12676 - RNA, 20 nt, Artificial Sequence
  targeting sequence with CTCN PAM
acucuuccuuuccagaccuc

SEQ ID NO: 12677 - RNA, 20 nt, Artificial Sequence
  targeting sequence with CTCN PAM
agucuuguuccuacccccac

SEQ ID NO: 12678 - RNA, 20 nt, Artificial Sequence
  targeting sequence with CTCN PAM
ccagucuuguuccuaccccc

SEQ ID NO: 12679 - RNA, 20 nt, Artificial Sequence
  targeting sequence with CTCN PAM
caggcucuccagucuuguuc

SEQ ID NO: 12680 - RNA, 20 nt, Artificial Sequence
  targeting sequence with CTCN PAM
ccaucucccaggcucuccag

SEQ ID NO: 12681 - RNA, 20 nt, Artificial Sequence
  targeting sequence with CTCN PAM
ucaccaucucccaggcucuc

SEQ ID NO: 12682 - RNA, 20 nt, Artificial Sequence
  targeting sequence with CTCN PAM
gcaccagcuccucaccaucu

SEQ ID NO: 12683 - RNA, 20 nt, Artificial Sequence
  targeting sequence with CTCN PAM
aaaaauaaugaagcacuggg

SEQ ID NO: 12684 - RNA, 20 nt, Artificial Sequence
  targeting sequence with CTCN PAM
ccuuugcccaugguagccug

SEQ ID NO: 12685 - RNA, 20 nt, Artificial Sequence
  targeting sequence with CTCN PAM
uuugcccaugguagccugag

SEQ ID NO: 12686 - RNA, 20 nt, Artificial Sequence
  targeting sequence with CTCN PAM
ggcuaccaugggcaaaggag

SEQ ID NO: 12687 - RNA, 20 nt, Artificial Sequence
  targeting sequence with CTCN PAM
gccacauccuaggcugguga

SEQ ID NO: 12688 - RNA, 20 nt, Artificial Sequence
  targeting sequence with CTCN PAM
guagccuaugccugcugccc

SEQ ID NO: 12689 - RNA, 20 nt, Artificial Sequence
  targeting sequence with CTCN PAM
cuuuagcggggcagcaggca

SEQ ID NO: 12690 - RNA, 20 nt, Artificial Sequence
  targeting sequence with CTCN PAM
uuggcacauuaaaugcuccc

SEQ ID NO: 12691 - RNA, 20 nt, Artificial Sequence
  targeting sequence with CTCN PAM
ucauuggcacauuaaaugcu

SEQ ID NO: 12692 - RNA, 20 nt, Artificial Sequence
  targeting sequence with CTCN PAM
ccucauuggcacauuaaaug

SEQ ID NO: 12693 - RNA, 20 nt, Artificial Sequence
  targeting sequence with CTCN PAM
gagaguagacagacucaaaa

SEQ ID NO: 12694 - RNA, 20 nt, Artificial Sequence
  targeting sequence with CTCN PAM
gagcaaaacauggcugcuuc

SEQ ID NO: 12695 - RNA, 20 nt, Artificial Sequence
  targeting sequence with CTCN PAM
cagagcaaaacauggcugcu

SEQ ID NO: 12696 - RNA, 20 nt, Artificial Sequence
  targeting sequence with CTCN PAM
aaauaaaaaaaauuccuuca

SEQ ID NO: 12697 - RNA, 20 nt, Artificial Sequence
  targeting sequence with CTCN PAM
auuuggggcuuuugucuguc

SEQ ID NO: 12698 - RNA, 20 nt, Artificial Sequence
  targeting sequence with CTCN PAM
acauuugggaaccauuagca

SEQ ID NO: 12699 - RNA, 20 nt, Artificial Sequence
  targeting sequence with CTCN PAM
gugcuaaugguucccaaaug

SEQ ID NO: 12700 - RNA, 20 nt, Artificial Sequence
  targeting sequence with CTCN PAM
ucccugcccaggaagccagg

SEQ ID NO: 12701 - RNA, 20 nt, Artificial Sequence
  targeting sequence with CTCN PAM
uggcuuccugggcagggaag

SEQ ID NO: 12702 - RNA, 20 nt, Artificial Sequence
  targeting sequence with CTCN PAM
ccuggcuuccugggcaggga

SEQ ID NO: 12703 - RNA, 20 nt, Artificial Sequence
  targeting sequence with CTCN PAM
agacucauucucaggccugc

SEQ ID NO: 12704 - RNA, 20 nt, Artificial Sequence
  targeting sequence with CTCN PAM
uucucaggccugcacgcaca

SEQ ID NO: 12705 - RNA, 20 nt, Artificial Sequence
  targeting sequence with CTCN PAM
ggccugcacgcacauaugca

SEQ ID NO: 12706 - RNA, 20 nt, Artificial Sequence
  targeting sequence with CTCN PAM
agguucugugccccuuccug

SEQ ID NO: 12707 - RNA, 20 nt, Artificial Sequence
  targeting sequence with CTCN PAM
ggcuauugccagcuauuugc

SEQ ID NO: 12708 - RNA, 20 nt, Artificial Sequence
  targeting sequence with CTCN PAM
cugagucucggucuccuggg

SEQ ID NO: 12709 - RNA, 20 nt, Artificial Sequence
  targeting sequence with CTCN PAM
gagucucggucuccugggcu

SEQ ID NO: 12710 - RNA, 20 nt, Artificial Sequence
  targeting sequence with CTCN PAM
gagaggacaaaugaccuguc

SEQ ID NO: 12711 - RNA, 20 nt, Artificial Sequence
  targeting sequence with CTCN PAM
gucuccugggcuguagccag

SEQ ID NO: 12712 - RNA, 20 nt, Artificial Sequence
  targeting sequence with CTCN PAM
ugggcuguagccagggagaa

SEQ ID NO: 12713 - RNA, 20 nt, Artificial Sequence
  targeting sequence with CTCN PAM
cuggcuacagcccaggagac

SEQ ID NO: 12714 - RNA, 20 nt, Artificial Sequence
  targeting sequence with CTCN PAM
uucuuagguuuauaaaaggc

SEQ ID NO: 12715 - RNA, 20 nt, Artificial Sequence
  targeting sequence with CTCN PAM
cagcaaggcaaccccaucuu

SEQ ID NO: 12716 - RNA, 20 nt, Artificial Sequence
  targeting sequence with CTCN PAM
uacaagaugggguugccuug

SEQ ID NO: 12717 - RNA, 20 nt, Artificial Sequence
  targeting sequence with CTCN PAM
ugaucccugcccuggggaca

SEQ ID NO: 12718 - RNA, 20 nt, Artificial Sequence
  targeting sequence with CTCN PAM
ccugaucccugcccugggga

SEQ ID NO: 12719 - RNA, 20 nt, Artificial Sequence
  targeting sequence with CTCN PAM
ggaaacagcucuccugaucc

SEQ ID NO: 12720 - RNA, 20 nt, Artificial Sequence
  targeting sequence with CTCN PAM
aaguuacccuggaagccucu

SEQ ID NO: 12721 - RNA, 20 nt, Artificial Sequence
  targeting sequence with CTCN PAM
gucccuggaagaagaggcca

SEQ ID NO: 12722 - RNA, 20 nt, Artificial Sequence
  targeting sequence with CTCN PAM
ucuuccagggacugagucca

SEQ ID NO: 12723 - RNA, 20 nt, Artificial Sequence
  targeting sequence with CTCN PAM
cacgaacucauucauugugu

SEQ ID NO: 12724 - RNA, 20 nt, Artificial Sequence
  targeting sequence with CTCN PAM
uucauugugucagcaaacgu

SEQ ID NO: 12725 - RNA, 20 nt, Artificial Sequence
  targeting sequence with CTCN PAM
gcagaaccccagucuacguu

SEQ ID NO: 12726 - RNA, 20 nt, Artificial Sequence
  targeting sequence with CTCN PAM
cucagcagaaccccagucua

SEQ ID NO: 12727 - RNA, 20 nt, Artificial Sequence
  targeting sequence with CTCN PAM
gcccuuuguccagaucgcag

SEQ ID NO: 12728 - RNA, 20 nt, Artificial Sequence
  targeting sequence with CTCN PAM
gcuuccucugcccuuugucc

SEQ ID NO: 12729 - RNA, 20 nt, Artificial Sequence
  targeting sequence with CTCN PAM
uuccccuggggugggggcuu

SEQ ID NO: 12730 - RNA, 20 nt, Artificial Sequence
  targeting sequence with CTCN PAM
agcccccaccccaggggaaa

SEQ ID NO: 12731 - RNA, 20 nt, Artificial Sequence
  targeting sequence with CTCN PAM
caagccccucaagcccccac

SEQ ID NO: 12732 - RNA, 20 nt, Artificial Sequence
  targeting sequence with CTCN PAM
gcagaagaggugacauuuca

SEQ ID NO: 12733 - RNA, 20 nt, Artificial Sequence
  targeting sequence with CTCN PAM
ucugcagaguccucccaagc

SEQ ID NO: 12734 - RNA, 20 nt, Artificial Sequence
  targeting sequence with CTCN PAM
ggaaaauaccuauuuggcuu

SEQ ID NO: 12735 - RNA, 20 nt, Artificial Sequence
  targeting sequence with CTCN PAM
gccucuggaaaauaccuauu

SEQ ID NO: 12736 - RNA, 20 nt, Artificial Sequence
  targeting sequence with CTCN PAM
ccacucugccucuggaaaau

SEQ ID NO: 12737 - RNA, 20 nt, Artificial Sequence
  targeting sequence with CTCN PAM
ccuggaaugccuuugccccu

SEQ ID NO: 12738 - RNA, 20 nt, Artificial Sequence
  targeting sequence with CTCN PAM
ccauaggaugucacccucac

SEQ ID NO: 12739 - RNA, 20 nt, Artificial Sequence
  targeting sequence with CTCN PAM
uucccaccuacaggccugcc

SEQ ID NO: 12740 - RNA, 20 nt, Artificial Sequence
  targeting sequence with CTCN PAM
ccuccuucccaccuacaggc

SEQ ID NO: 12741 - RNA, 20 nt, Artificial Sequence
  targeting sequence with CTCN PAM
gcccauccuccccuccuucc

SEQ ID NO: 12742 - RNA, 20 nt, Artificial Sequence
  targeting sequence with CTCN PAM
cugcccauccuccccuccuu

SEQ ID NO: 12743 - RNA, 20 nt, Artificial Sequence
  targeting sequence with CTCN PAM
acagcacaaacucucugccc

SEQ ID NO: 12744 - RNA, 20 nt, Artificial Sequence
  targeting sequence with CTCN PAM
ugacugggcuacugugcucc

SEQ ID NO: 12745 - RNA, 20 nt, Artificial Sequence
  targeting sequence with CTCN PAM
caugacugggcuacugugcu

SEQ ID NO: 12746 - RNA, 20 nt, Artificial Sequence
  targeting sequence with CTCN PAM
cucaugacugggcuacugug

SEQ ID NO: 12747 - RNA, 20 nt, Artificial Sequence
  targeting sequence with CTCN PAM
auccugcaccucucucauga

SEQ ID NO: 12748 - RNA, 20 nt, Artificial Sequence
  targeting sequence with CTCN PAM
ccaggcauggguaaucaucc

SEQ ID NO: 12749 - RNA, 20 nt, Artificial Sequence
  targeting sequence with CTCN PAM
agaugcgugggaugauuacc

SEQ ID NO: 12750 - RNA, 20 nt, Artificial Sequence
  targeting sequence with CTCN PAM
guaugcaucugguucuuucc

SEQ ID NO: 12751 - RNA, 20 nt, Artificial Sequence
  targeting sequence with CTCN PAM
gaaaacagucuucuuuuuuu

SEQ ID NO: 12752 - RNA, 20 nt, Artificial Sequence
  targeting sequence with CTCN PAM
cauguaccaguaccuggaua

SEQ ID NO: 12753 - RNA, 20 nt, Artificial Sequence
  targeting sequence with CTCN PAM
ugcuggcuagaugcuuaccu

SEQ ID NO: 12754 - RNA, 20 nt, Artificial Sequence
  targeting sequence with CTCN PAM
agcuccugcuggcuagaugc

SEQ ID NO: 12755 - RNA, 20 nt, Artificial Sequence
  targeting sequence with CTCN PAM
agcuuucauagacuaggcca

SEQ ID NO: 12756 - RNA, 20 nt, Artificial Sequence
  targeting sequence with CTCN PAM
cuagcuuucauagacuaggc

SEQ ID NO: 12757 - RNA, 20 nt, Artificial Sequence
  targeting sequence with CTCN PAM
gauggaggaaggaauggcuu

SEQ ID NO: 12758 - RNA, 20 nt, Artificial Sequence
  targeting sequence with CTCN PAM
aucugagguucuagauggaa

SEQ ID NO: 12759 - RNA, 20 nt, Artificial Sequence
  targeting sequence with CTCN PAM
acuccccuaccccuucccuc

SEQ ID NO: 12760 - RNA, 20 nt, Artificial Sequence
  targeting sequence with CTCN PAM
ccuaccccuucccucuuuau

SEQ ID NO: 12761 - RNA, 20 nt, Artificial Sequence
  targeting sequence with CTCN PAM
uuaucuccccacagucaauu

SEQ ID NO: 12762 - RNA, 20 nt, Artificial Sequence
  targeting sequence with CTCN PAM
ccacagucaauuaaugagcu

SEQ ID NO: 12763 - RNA, 20 nt, Artificial Sequence
  targeting sequence with CTCN PAM
uuaauugacuguggggagau

SEQ ID NO: 12764 - RNA, 20 nt, Artificial Sequence
  targeting sequence with CTCN PAM
uuuuguccauauucccgggc

SEQ ID NO: 12765 - RNA, 20 nt, Artificial Sequence
  targeting sequence with CTCN PAM
uucaaugucagcccgggaau

SEQ ID NO: 12766 - RNA, 20 nt, Artificial Sequence
  targeting sequence with CTCN PAM
uugccacuccuucaauguca

SEQ ID NO: 12767 - RNA, 20 nt, Artificial Sequence
  targeting sequence with CTCN PAM
ucaugccuacaagucuugau

SEQ ID NO: 12768 - RNA, 20 nt, Artificial Sequence
  targeting sequence with CTCN PAM
cuucaugccuacaagucuug

SEQ ID NO: 12769 - RNA, 20 nt, Artificial Sequence
  targeting sequence with CTCN PAM
ucucuucaugccuacaaguc

SEQ ID NO: 12770 - RNA, 20 nt, Artificial Sequence
  targeting sequence with CTCN PAM
gccaggcuucuuaguccugg

SEQ ID NO: 12771 - RNA, 20 nt, Artificial Sequence
  targeting sequence with CTCN PAM
uucucagccaggcuucuuag

SEQ ID NO: 12772 - RNA, 20 nt, Artificial Sequence
  targeting sequence with CTCN PAM
gggaccucaggccagccacu

SEQ ID NO: 12773 - RNA, 20 nt, Artificial Sequence
  targeting sequence with CTCN PAM
ggccagccacuuuccuugga

SEQ ID NO: 12774 - RNA, 20 nt, Artificial Sequence
  targeting sequence with CTCN PAM
aaggaaaguggcuggccuga

SEQ ID NO: 12775 - RNA, 20 nt, Artificial Sequence
  targeting sequence with CTCN PAM
caguucugaaaugggggugg

SEQ ID NO: 12776 - RNA, 20 nt, Artificial Sequence
  targeting sequence with CTCN PAM
ugacugcagcgggcauucuc

SEQ ID NO: 12777 - RNA, 20 nt, Artificial Sequence
  targeting sequence with CTCN PAM
guuaagccucaugacugcag

SEQ ID NO: 12778 - RNA, 20 nt, Artificial Sequence
  targeting sequence with CTCN PAM
guguaggaaaguggagaugg

SEQ ID NO: 12779 - RNA, 20 nt, Artificial Sequence
  targeting sequence with CTCN PAM
acuuuccuacacugaggaca

SEQ ID NO: 12780 - RNA, 20 nt, Artificial Sequence
  targeting sequence with CTCN PAM
aucuccacuuuccuacacug

SEQ ID NO: 12781 - RNA, 20 nt, Artificial Sequence
  targeting sequence with CTCN PAM
uccaucuccacuuuccuaca

SEQ ID NO: 12782 - RNA, 20 nt, Artificial Sequence
  targeting sequence with CTCN PAM
gaauucuuacagccuccucc

SEQ ID NO: 12783 - RNA, 20 nt, Artificial Sequence
  targeting sequence with CTCN PAM
ucugaauucuuacagccucc

SEQ ID NO: 12784 - RNA, 20 nt, Artificial Sequence
  targeting sequence with CTCN PAM
cgccuguaaauccuagcacu

SEQ ID NO: 12785 - RNA, 20 nt, Artificial Sequence
  targeting sequence with CTCN PAM
caaagugcuaggauuuacag

SEQ ID NO: 12786 - RNA, 20 nt, Artificial Sequence
  targeting sequence with CTCN PAM
gccucccaaagugcuaggau

SEQ ID NO: 12787 - RNA, 20 nt, Artificial Sequence
  targeting sequence with CTCN PAM
auggcccaggcuggagugca

SEQ ID NO: 12788 - RNA, 20 nt, Artificial Sequence
  targeting sequence with CTCN PAM
gacuuaaaaaaaaaaaaaaa

SEQ ID NO: 12789 - RNA, 20 nt, Artificial Sequence
  targeting sequence with CTCN PAM
gaauucuuuuuuuuuuuuuu

SEQ ID NO: 12790 - RNA, 20 nt, Artificial Sequence
  targeting sequence with CTCN PAM
ucugaauucuuuuuuuuuuu

SEQ ID NO: 12791 - RNA, 20 nt, Artificial Sequence
  targeting sequence with CTCN PAM
cuccucugaauucuuuuuuu

SEQ ID NO: 12792 - RNA, 20 nt, Artificial Sequence
  targeting sequence with CTCN PAM
ucccuccucugaauucuuuu

SEQ ID NO: 12793 - RNA, 20 nt, Artificial Sequence
  targeting sequence with CTCN PAM
auggagggagcuucccucuc

SEQ ID NO: 12794 - RNA, 20 nt, Artificial Sequence
  targeting sequence with CTCN PAM
auagagaugccuccucccuc

SEQ ID NO: 12795 - RNA, 20 nt, Artificial Sequence
  targeting sequence with CTCN PAM
cuccauagagaugccuccuc

SEQ ID NO: 12796 - RNA, 20 nt, Artificial Sequence
  targeting sequence with CTCN PAM
ccugccccacccagaaaugc

SEQ ID NO: 12797 - RNA, 20 nt, Artificial Sequence
  targeting sequence with CTCN PAM
ugccccacccagaaaugcca

SEQ ID NO: 12798 - RNA, 20 nt, Artificial Sequence
  targeting sequence with CTCN PAM
cugcuggcauuucugggugg

SEQ ID NO: 12799 - RNA, 20 nt, Artificial Sequence
  targeting sequence with CTCN PAM
cucccugcuggcauuucugg

SEQ ID NO: 12800 - RNA, 20 nt, Artificial Sequence
  targeting sequence with CTCN PAM
uauuaaaccuuguggcuuuu

SEQ ID NO: 12801 - RNA, 20 nt, Artificial Sequence
  targeting sequence with CTCN PAM
auauuuaaacaaauauauaa

SEQ ID NO: 12802 - RNA, 20 nt, Artificial Sequence
  targeting sequence with CTCN PAM
cuguguugcccaggcagguc

SEQ ID NO: 12803 - RNA, 20 nt, Artificial Sequence
  targeting sequence with CTCN PAM
ugggcucaagcagucuucuu

SEQ ID NO: 12804 - RNA, 20 nt, Artificial Sequence
  targeting sequence with CTCN PAM
agcagucuucuugccucagc

SEQ ID NO: 12805 - RNA, 20 nt, Artificial Sequence
  targeting sequence with CTCN PAM
gccucccaaagugcugggau

SEQ ID NO: 12806 - RNA, 20 nt, Artificial Sequence
  targeting sequence with CTCN PAM
caaagugcugggauuacagg

SEQ ID NO: 12807 - RNA, 20 nt, Artificial Sequence
  targeting sequence with CTCN PAM
ggauuuagaugaaauaguaa

SEQ ID NO: 12808 - RNA, 20 nt, Artificial Sequence
  targeting sequence with CTCN PAM
uuacucugugccaggcacuc

SEQ ID NO: 12809 - RNA, 20 nt, Artificial Sequence
  targeting sequence with CTCN PAM
gugccaggcacucaggcuca

SEQ ID NO: 12810 - RNA, 20 nt, Artificial Sequence
  targeting sequence with CTCN PAM
ggcucaccagcuuggauaua

SEQ ID NO: 12811 - RNA, 20 nt, Artificial Sequence
  targeting sequence with CTCN PAM
ccagcuuggauauagugguu

SEQ ID NO: 12812 - RNA, 20 nt, Artificial Sequence
  targeting sequence with CTCN PAM
aggaaccacuauauccaagc

SEQ ID NO: 12813 - RNA, 20 nt, Artificial Sequence
  targeting sequence with CTCN PAM
gccaucuaguggggauggcu

SEQ ID NO: 12814 - RNA, 20 nt, Artificial Sequence
  targeting sequence with CTCN PAM
ucucugccaucuagugggga

SEQ ID NO: 12815 - RNA, 20 nt, Artificial Sequence
  targeting sequence with CTCN PAM
gcagcucuucucugccaucu

SEQ ID NO: 12816 - RNA, 20 nt, Artificial Sequence
  targeting sequence with CTCN PAM
cgccagacccugagcagagc

SEQ ID NO: 12817 - RNA, 20 nt, Artificial Sequence
  targeting sequence with CTCN PAM
gggucuggcgggagcucagc

SEQ ID NO: 12818 - RNA, 20 nt, Artificial Sequence
  targeting sequence with CTCN PAM
gcucagggucuggcgggagc

SEQ ID NO: 12819 - RNA, 20 nt, Artificial Sequence
  targeting sequence with CTCN PAM
cuauucccaggcuucccucu

SEQ ID NO: 12820 - RNA, 20 nt, Artificial Sequence
  targeting sequence with CTCN PAM
gcugagcucauucaggggcc

SEQ ID NO: 12821 - RNA, 20 nt, Artificial Sequence
  targeting sequence with CTCN PAM
gcagagggaagccugggaau

SEQ ID NO: 12822 - RNA, 20 nt, Artificial Sequence
  targeting sequence with CTCN PAM
uucaggggccuugugacucu

SEQ ID NO: 12823 - RNA, 20 nt, Artificial Sequence
  targeting sequence with CTCN PAM
gaccaggcacccugacgcug

SEQ ID NO: 12824 - RNA, 20 nt, Artificial Sequence
  targeting sequence with CTCN PAM
gaaacagauuuauuaauggg

SEQ ID NO: 12825 - RNA, 20 nt, Artificial Sequence
  targeting sequence with CTCN PAM
gcugugcuagugucuaggau

SEQ ID NO: 12826 - RNA, 20 nt, Artificial Sequence
  targeting sequence with CTCN PAM
agggucuuucuagcuguagc

SEQ ID NO: 12827 - RNA, 20 nt, Artificial Sequence
  targeting sequence with CTCN PAM
caagggucuuucuagcugua

SEQ ID NO: 12828 - RNA, 20 nt, Artificial Sequence
  targeting sequence with CTCN PAM
aaccaucuucuuuguggaaa

SEQ ID NO: 12829 - RNA, 20 nt, Artificial Sequence
  targeting sequence with CTCN PAM
gcuucugggcuccaaccauc

SEQ ID NO: 12830 - RNA, 20 nt, Artificial Sequence
  targeting sequence with CTCN PAM
gagcgaggacucagaccucg

SEQ ID NO: 12831 - RNA, 20 nt, Artificial Sequence
  targeting sequence with CTCN PAM
gagccuacuucucugcuucu

SEQ ID NO: 12832 - RNA, 20 nt, Artificial Sequence
  targeting sequence with CTCN PAM
cucugagccuacuucucugc

SEQ ID NO: 12833 - RNA, 20 nt, Artificial Sequence
  targeting sequence with CTCN PAM
gaccucgaaugcuccuuucc

SEQ ID NO: 12834 - RNA, 20 nt, Artificial Sequence
  targeting sequence with CTCN PAM
aaugcuccuuucccucuugg

SEQ ID NO: 12835 - RNA, 20 nt, Artificial Sequence
  targeting sequence with CTCN PAM
uuucccucuuggccacugug

SEQ ID NO: 12836 - RNA, 20 nt, Artificial Sequence
  targeting sequence with CTCN PAM
uggccacugugcugggcuuu

SEQ ID NO: 12837 - RNA, 20 nt, Artificial Sequence
  targeting sequence with CTCN PAM
caaggcgcuuuaaggaaacc

SEQ ID NO: 12838 - RNA, 20 nt, Artificial Sequence
  targeting sequence with CTCN PAM
aggcgcuuuaaggaaaccca

SEQ ID NO: 12839 - RNA, 20 nt, Artificial Sequence
  targeting sequence with CTCN PAM
agaucuggguuuccuuaaag

SEQ ID NO: 12840 - RNA, 20 nt, Artificial Sequence
  targeting sequence with CTCN PAM
ucacaaacacuuguuugcca

SEQ ID NO: 12841 - RNA, 20 nt, Artificial Sequence
  targeting sequence with CTCN PAM
gaugccucccuuaacgcugc

SEQ ID NO: 12842 - RNA, 20 nt, Artificial Sequence
  targeting sequence with CTCN PAM
cuuaacgcugccucccaccc

SEQ ID NO: 12843 - RNA, 20 nt, Artificial Sequence
  targeting sequence with CTCN PAM
caccccugcucaugcucaga

SEQ ID NO: 12844 - RNA, 20 nt, Artificial Sequence
  targeting sequence with CTCN PAM
ugcucagaccauucauccgu

SEQ ID NO: 12845 - RNA, 20 nt, Artificial Sequence
  targeting sequence with CTCN PAM
gaccauucauccguguucuc

SEQ ID NO: 12846 - RNA, 20 nt, Artificial Sequence
  targeting sequence with CTCN PAM
aggcaugugguucguaguug

SEQ ID NO: 12847 - RNA, 20 nt, Artificial Sequence
  targeting sequence with CTCN PAM
aacuacgaaccacaugccug

SEQ ID NO: 12848 - RNA, 20 nt, Artificial Sequence
  targeting sequence with CTCN PAM
ccaacuacgaaccacaugcc

SEQ ID NO: 12849 - RNA, 20 nt, Artificial Sequence
  targeting sequence with CTCN PAM
uagcucugggaggugucaug

SEQ ID NO: 12850 - RNA, 20 nt, Artificial Sequence
  targeting sequence with CTCN PAM
gggaggugucaugaucuguu

SEQ ID NO: 12851 - RNA, 20 nt, Artificial Sequence
  targeting sequence with CTCN PAM
cagagcuaagagcucuccaa

SEQ ID NO: 12852 - RNA, 20 nt, Artificial Sequence
  targeting sequence with CTCN PAM
gaauuguggagggggacagg

SEQ ID NO: 12853 - RNA, 20 nt, Artificial Sequence
  targeting sequence with CTCN PAM
acaauucagagguccacauu

SEQ ID NO: 12854 - RNA, 20 nt, Artificial Sequence
  targeting sequence with CTCN PAM
gccccugucccccuccacaa

SEQ ID NO: 12855 - RNA, 20 nt, Artificial Sequence
  targeting sequence with CTCN PAM
cuggguccucagucucuuga

SEQ ID NO: 12856 - RNA, 20 nt, Artificial Sequence
  targeting sequence with CTCN PAM
gucucuugacaggaagccug

SEQ ID NO: 12857 - RNA, 20 nt, Artificial Sequence
  targeting sequence with CTCN PAM
ugacaggaagccugguccug

SEQ ID NO: 12858 - RNA, 20 nt, Artificial Sequence
  targeting sequence with CTCN PAM
ucucccgaggucuuuucagg

SEQ ID NO: 12859 - RNA, 20 nt, Artificial Sequence
  targeting sequence with CTCN PAM
cgaggucuuuucaggaggga

SEQ ID NO: 12860 - RNA, 20 nt, Artificial Sequence
  targeting sequence with CTCN PAM
ggagaugagcaaguccccgg

SEQ ID NO: 12861 - RNA, 20 nt, Artificial Sequence
  targeting sequence with CTCN PAM
ugaaaagaccucgggagaug

SEQ ID NO: 12862 - RNA, 20 nt, Artificial Sequence
  targeting sequence with CTCN PAM
cuccugaaaagaccucggga

SEQ ID NO: 12863 - RNA, 20 nt, Artificial Sequence
  targeting sequence with CTCN PAM
gcagcauggcauccucccuc

SEQ ID NO: 12864 - RNA, 20 nt, Artificial Sequence
  targeting sequence with CTCN PAM
gcucagcagcauggcauccu

SEQ ID NO: 12865 - RNA, 20 nt, Artificial Sequence
  targeting sequence with CTCN PAM
gcguguucaguucaaagggc

SEQ ID NO: 12866 - RNA, 20 nt, Artificial Sequence
  targeting sequence with CTCN PAM
ggagcugcugccuccucuag

SEQ ID NO: 12867 - RNA, 20 nt, Artificial Sequence
  targeting sequence with CTCN PAM
agagcccuuugaacugaaca

SEQ ID NO: 12868 - RNA, 20 nt, Artificial Sequence
  targeting sequence with CTCN PAM
ucuaggcacaggucagccca

SEQ ID NO: 12869 - RNA, 20 nt, Artificial Sequence
  targeting sequence with CTCN PAM
aggcacaggucagcccauuu

SEQ ID NO: 12870 - RNA, 20 nt, Artificial Sequence
  targeting sequence with CTCN PAM
uccaaacccugggcagaauc

SEQ ID NO: 12871 - RNA, 20 nt, Artificial Sequence
  targeting sequence with CTCN PAM
aaacccugggcagaaucuga

SEQ ID NO: 12872 - RNA, 20 nt, Artificial Sequence
  targeting sequence with CTCN PAM
gaaacuucuagagguccaug

SEQ ID NO: 12873 - RNA, 20 nt, Artificial Sequence
  targeting sequence with CTCN PAM
agaaguuucugaggaacaag

SEQ ID NO: 12874 - RNA, 20 nt, Artificial Sequence
  targeting sequence with CTCN PAM
uggaccucuagaaguuucug

SEQ ID NO: 12875 - RNA, 20 nt, Artificial Sequence
  targeting sequence with CTCN PAM
ggcuuuacugugaguucaag

SEQ ID NO: 12876 - RNA, 20 nt, Artificial Sequence
  targeting sequence with CTCN PAM
caguaaagccagagacuuua

SEQ ID NO: 12877 - RNA, 20 nt, Artificial Sequence
  targeting sequence with CTCN PAM
uuauguaaacccuaaaauug

SEQ ID NO: 12878 - RNA, 20 nt, Artificial Sequence
  targeting sequence with CTCN PAM
accuucuuccagaaucuguc

SEQ ID NO: 12879 - RNA, 20 nt, Artificial Sequence
  targeting sequence with CTCN PAM
cagcuuuccccuccucugcu

SEQ ID NO: 12880 - RNA, 20 nt, Artificial Sequence
  targeting sequence with CTCN PAM
gcuuuccccuccucugcucc

SEQ ID NO: 12881 - RNA, 20 nt, Artificial Sequence
  targeting sequence with CTCN PAM
ucugcucccucugugguacc

SEQ ID NO: 12882 - RNA, 20 nt, Artificial Sequence
  targeting sequence with CTCN PAM
gcucccucugugguaccagg

SEQ ID NO: 12883 - RNA, 20 nt, Artificial Sequence
  targeting sequence with CTCN PAM
cucugugguaccaggggcuc

SEQ ID NO: 12884 - RNA, 20 nt, Artificial Sequence
  targeting sequence with CTCN PAM
gugguaccaggggcucuggg

SEQ ID NO: 12885 - RNA, 20 nt, Artificial Sequence
  targeting sequence with CTCN PAM
ggguccccugugucuguggc

SEQ ID NO: 12886 - RNA, 20 nt, Artificial Sequence
  targeting sequence with CTCN PAM
caucaguccaugcaucucau

SEQ ID NO: 12887 - RNA, 20 nt, Artificial Sequence
  targeting sequence with CTCN PAM
ucaguccaugcaucucaucc

SEQ ID NO: 12888 - RNA, 20 nt, Artificial Sequence
  targeting sequence with CTCN PAM
uccucuccugcugugaugcu

SEQ ID NO: 12889 - RNA, 20 nt, Artificial Sequence
  targeting sequence with CTCN PAM
ccugcugugaugcugcguga

SEQ ID NO: 12890 - RNA, 20 nt, Artificial Sequence
  targeting sequence with CTCN PAM
ugcugugaugcugcgugacc

SEQ ID NO: 12891 - RNA, 20 nt, Artificial Sequence
  targeting sequence with CTCN PAM
ggggggucacgcagcaucac

SEQ ID NO: 12892 - RNA, 20 nt, Artificial Sequence
  targeting sequence with CTCN PAM
agacccaaagaagaacaagc

SEQ ID NO: 12893 - RNA, 20 nt, Artificial Sequence
  targeting sequence with CTCN PAM
caaggaggcaccgccacaga

SEQ ID NO: 12894 - RNA, 20 nt, Artificial Sequence
  targeting sequence with CTCN PAM
uugggagacucuagacccaa

SEQ ID NO: 12895 - RNA, 20 nt, Artificial Sequence
  targeting sequence with CTCN PAM
aaaugacugaugcaacuggg

SEQ ID NO: 12896 - RNA, 20 nt, Artificial Sequence
  targeting sequence with CTCN PAM
cugggugguauaaccuccug

SEQ ID NO: 12897 - RNA, 20 nt, Artificial Sequence
  targeting sequence with CTCN PAM
ugcacgcacgaugauuaauc

SEQ ID NO: 12898 - RNA, 20 nt, Artificial Sequence
  targeting sequence with CTCN PAM
cuuccucuccucuguggcuc

SEQ ID NO: 12899 - RNA, 20 nt, Artificial Sequence
  targeting sequence with CTCN PAM
ccucuguggcucacugucua

SEQ ID NO: 12900 - RNA, 20 nt, Artificial Sequence
  targeting sequence with CTCN PAM
ucuguggcucacugucuaga

SEQ ID NO: 12901 - RNA, 20 nt, Artificial Sequence
  targeting sequence with CTCN PAM
guggcucacugucuagauag

SEQ ID NO: 12902 - RNA, 20 nt, Artificial Sequence
  targeting sequence with CTCN PAM
cugucuagauagagcuugac

SEQ ID NO: 12903 - RNA, 20 nt, Artificial Sequence
  targeting sequence with CTCN PAM
aucuagacagugagccacag

SEQ ID NO: 12904 - RNA, 20 nt, Artificial Sequence
  targeting sequence with CTCN PAM
gaugaaggccuguggcgaag

SEQ ID NO: 12905 - RNA, 20 nt, Artificial Sequence
  targeting sequence with CTCN PAM
gauauuuagagcucaucagc

SEQ ID NO: 12906 - RNA, 20 nt, Artificial Sequence
  targeting sequence with CTCN PAM
aaauaucggaggucuuguac

SEQ ID NO: 12907 - RNA, 20 nt, Artificial Sequence
  targeting sequence with CTCN PAM
ucagcagcauugagguaaaa

SEQ ID NO: 12908 - RNA, 20 nt, Artificial Sequence
  targeting sequence with CTCN PAM
augcugcugaugagcucuaa

SEQ ID NO: 12909 - RNA, 20 nt, Artificial Sequence
  targeting sequence with CTCN PAM
agaaggcauacuugggguuc

SEQ ID NO: 12910 - RNA, 20 nt, Artificial Sequence
  targeting sequence with CTCN PAM
ugccuguuagaagggcugcc

SEQ ID NO: 12911 - RNA, 20 nt, Artificial Sequence
  targeting sequence with CTCN PAM
aggcucuugccuguuagaag

SEQ ID NO: 12912 - RNA, 20 nt, Artificial Sequence
  targeting sequence with CTCN PAM
guucccauguccucaaggcu

SEQ ID NO: 12913 - RNA, 20 nt, Artificial Sequence
  targeting sequence with CTCN PAM
cuggcgucugggcaucuggg

SEQ ID NO: 12914 - RNA, 20 nt, Artificial Sequence
  targeting sequence with CTCN PAM
gggggcagaguggccacacu

SEQ ID NO: 12915 - RNA, 20 nt, Artificial Sequence
  targeting sequence with CTCN PAM
gcccccggagcaaggcugug

SEQ ID NO: 12916 - RNA, 20 nt, Artificial Sequence
  targeting sequence with CTCN PAM
cccaguguggccacucugcc

SEQ ID NO: 12917 - RNA, 20 nt, Artificial Sequence
  targeting sequence with CTCN PAM
cacuaccugcuguugucucc

SEQ ID NO: 12918 - RNA, 20 nt, Artificial Sequence
  targeting sequence with CTCN PAM
cccagcuaucacacaacagc

SEQ ID NO: 12919 - RNA, 20 nt, Artificial Sequence
  targeting sequence with CTCN PAM
ccaggguuggguuucuaguc

SEQ ID NO: 12920 - RNA, 20 nt, Artificial Sequence
  targeting sequence with CTCN PAM
aggguuggguuucuagucug

SEQ ID NO: 12921 - RNA, 20 nt, Artificial Sequence
  targeting sequence with CTCN PAM
caggcugcugugaggauuca

SEQ ID NO: 12922 - RNA, 20 nt, Artificial Sequence
  targeting sequence with CTCN PAM
aacacuaucagauuacugga

SEQ ID NO: 12923 - RNA, 20 nt, Artificial Sequence
  targeting sequence with CTCN PAM
uccaacacuaucagauuacu

SEQ ID NO: 12924 - RNA, 20 nt, Artificial Sequence
  targeting sequence with CTCN PAM
ugugcauuugggaaacuccu

SEQ ID NO: 12925 - RNA, 20 nt, Artificial Sequence
  targeting sequence with CTCN PAM
gcucaugugcauuugggaaa

SEQ ID NO: 12926 - RNA, 20 nt, Artificial Sequence
  targeting sequence with CTCN PAM
auuccccagaaauggaccug

SEQ ID NO: 12927 - RNA, 20 nt, Artificial Sequence
  targeting sequence with CTCN PAM
ccagguccauuucuggggaa

SEQ ID NO: 12928 - RNA, 20 nt, Artificial Sequence
  targeting sequence with CTCN PAM
guucagacugugggccuugc

SEQ ID NO: 12929 - RNA, 20 nt, Artificial Sequence
  targeting sequence with CTCN PAM
ggggcgcucaguucagacug

SEQ ID NO: 12930 - RNA, 20 nt, Artificial Sequence
  targeting sequence with CTCN PAM
agaacucuggggcgcucagu

SEQ ID NO: 12931 - RNA, 20 nt, Artificial Sequence
  targeting sequence with CTCN PAM
gccagaaacaguagggcuag

SEQ ID NO: 12932 - RNA, 20 nt, Artificial Sequence
  targeting sequence with CTCN PAM
agucuauaaugcuagcacuu

SEQ ID NO: 12933 - RNA, 20 nt, Artificial Sequence
  targeting sequence with CTCN PAM
gugcugucuggcugucuguu

SEQ ID NO: 12934 - RNA, 20 nt, Artificial Sequence
  targeting sequence with CTCN PAM
ugaacauauuuauugugaag

SEQ ID NO: 12935 - RNA, 20 nt, Artificial Sequence
  targeting sequence with CTCN PAM
cauucccauaccuucacaau

SEQ ID NO: 12936 - RNA, 20 nt, Artificial Sequence
  targeting sequence with CTCN PAM
cuguuuccaacugggaauuc

SEQ ID NO: 12937 - RNA, 20 nt, Artificial Sequence
  targeting sequence with CTCN PAM
cauucauuuccccauaauaa

SEQ ID NO: 12938 - RNA, 20 nt, Artificial Sequence
  targeting sequence with CTCN PAM
uucauuuccccauaauaaac

SEQ ID NO: 12939 - RNA, 20 nt, Artificial Sequence
  targeting sequence with CTCN PAM
gcacaagggcuggcccauga

SEQ ID NO: 12940 - RNA, 20 nt, Artificial Sequence
  targeting sequence with CTCN PAM
gugggcacagagcugaggag

SEQ ID NO: 12941 - RNA, 20 nt, Artificial Sequence
  targeting sequence with CTCN PAM
gugcccacugagcucggcac

SEQ ID NO: 12942 - RNA, 20 nt, Artificial Sequence
  targeting sequence with CTCN PAM
cccuauuccaugcaggagga

SEQ ID NO: 12943 - RNA, 20 nt, Artificial Sequence
  targeting sequence with CTCN PAM
cuauuccaugcaggaggaaa

SEQ ID NO: 12944 - RNA, 20 nt, Artificial Sequence
  targeting sequence with CTCN PAM
ugcauggaauagggagagca

SEQ ID NO: 12945 - RNA, 20 nt, Artificial Sequence
  targeting sequence with CTCN PAM
gcaagacgaugccacauccc

SEQ ID NO: 12946 - RNA, 20 nt, Artificial Sequence
  targeting sequence with CTCN PAM
ugcucucucggccacauacc

SEQ ID NO: 12947 - RNA, 20 nt, Artificial Sequence
  targeting sequence with CTCN PAM
cucggccacauacccucccu

SEQ ID NO: 12948 - RNA, 20 nt, Artificial Sequence
  targeting sequence with CTCN PAM
cggccacauacccucccuac

SEQ ID NO: 12949 - RNA, 20 nt, Artificial Sequence
  targeting sequence with CTCN PAM
gccacauacccucccuaccc

SEQ ID NO: 12950 - RNA, 20 nt, Artificial Sequence
  targeting sequence with CTCN PAM
cuacccgcguguuguaaggg

SEQ ID NO: 12951 - RNA, 20 nt, Artificial Sequence
  targeting sequence with CTCN PAM
gaacaagcccuuuaccacgc

SEQ ID NO: 12952 - RNA, 20 nt, Artificial Sequence
  targeting sequence with CTCN PAM
aaaugcccagugcugcugac

SEQ ID NO: 12953 - RNA, 20 nt, Artificial Sequence
  targeting sequence with CTCN PAM
uuggcuucaggugaagaccc

SEQ ID NO: 12954 - RNA, 20 nt, Artificial Sequence
  targeting sequence with CTCN PAM
cuacaaaaguaacugcugug

SEQ ID NO: 12955 - RNA, 20 nt, Artificial Sequence
  targeting sequence with CTCN PAM
acaaaaguaacugcuguggg

SEQ ID NO: 12956 - RNA, 20 nt, Artificial Sequence
  targeting sequence with CTCN PAM
ccucguaugcuaugagcugg

SEQ ID NO: 12957 - RNA, 20 nt, Artificial Sequence
  targeting sequence with CTCN PAM
ucguaugcuaugagcuggga

SEQ ID NO: 12958 - RNA, 20 nt, Artificial Sequence
  targeting sequence with CTCN PAM
uaugcuaugagcugggaagu

SEQ ID NO: 12959 - RNA, 20 nt, Artificial Sequence
  targeting sequence with CTCN PAM
uagcauacgaggagaggacu

SEQ ID NO: 12960 - RNA, 20 nt, Artificial Sequence
  targeting sequence with CTCN PAM
uaagauugucucuugaaaaa

SEQ ID NO: 12961 - RNA, 20 nt, Artificial Sequence
  targeting sequence with CTCN PAM
ugaaaaaaaguaaagugccu

SEQ ID NO: 12962 - RNA, 20 nt, Artificial Sequence
  targeting sequence with CTCN PAM
aaggcacuuuacuuuuuuuc

SEQ ID NO: 12963 - RNA, 20 nt, Artificial Sequence
  targeting sequence with CTCN PAM
auaucgacugccugcagacu

SEQ ID NO: 12964 - RNA, 20 nt, Artificial Sequence
  targeting sequence with CTCN PAM
gcauaauuccagagaacugc

SEQ ID NO: 12965 - RNA, 20 nt, Artificial Sequence
  targeting sequence with CTCN PAM
ggaauuaugcugagcaccca

SEQ ID NO: 12966 - RNA, 20 nt, Artificial Sequence
  targeting sequence with CTCN PAM
ccuauccaaaaggcacccac

SEQ ID NO: 12967 - RNA, 20 nt, Artificial Sequence
  targeting sequence with CTCN PAM
gcaggugcaugucaacaugg

SEQ ID NO: 12968 - RNA, 20 nt, Artificial Sequence
  targeting sequence with CTCN PAM
gcaaaaaaaaaacaaacaaa

SEQ ID NO: 12969 - RNA, 20 nt, Artificial Sequence
  targeting sequence with CTCN PAM
aucucugcaaaaaaaaaaca

SEQ ID NO: 12970 - RNA, 20 nt, Artificial Sequence
  targeting sequence with CTCN PAM
ugggcucaagugauccuccu

SEQ ID NO: 12971 - RNA, 20 nt, Artificial Sequence
  targeting sequence with CTCN PAM
agugauccuccucuuuugac

SEQ ID NO: 12972 - RNA, 20 nt, Artificial Sequence
  targeting sequence with CTCN PAM
ucuuuugaccucccaaagug

SEQ ID NO: 12973 - RNA, 20 nt, Artificial Sequence
  targeting sequence with CTCN PAM
uuugaccucccaaaguguag

SEQ ID NO: 12974 - RNA, 20 nt, Artificial Sequence
  targeting sequence with CTCN PAM
caaaguguagggaucacagg

SEQ ID NO: 12975 - RNA, 20 nt, Artificial Sequence
  targeting sequence with CTCN PAM
cggcaagauuucaauucauu

SEQ ID NO: 12976 - RNA, 20 nt, Artificial Sequence
  targeting sequence with CTCN PAM
uaauaguuggaaaugaauug

SEQ ID NO: 12977 - RNA, 20 nt, Artificial Sequence
  targeting sequence with CTCN PAM
ucaaacaaacuaacuccuaa

SEQ ID NO: 12978 - RNA, 20 nt, Artificial Sequence
  targeting sequence with CTCN PAM
ggcucaucaaacaaacuaac

SEQ ID NO: 12979 - RNA, 20 nt, Artificial Sequence
  targeting sequence with CTCN PAM
agcuguuaaaacuuucacca

SEQ ID NO: 12980 - RNA, 20 nt, Artificial Sequence
  targeting sequence with CTCN PAM
uagacaagcuggugaaaguu

SEQ ID NO: 12981 - RNA, 20 nt, Artificial Sequence
  targeting sequence with CTCN PAM
aauaugcugcucuuucuaga

SEQ ID NO: 12982 - RNA, 20 nt, Artificial Sequence
  targeting sequence with CTCN PAM
uucuagaaaacaagcaaaag

SEQ ID NO: 12983 - RNA, 20 nt, Artificial Sequence
  targeting sequence with CTCN PAM
ggguuugggugcuacugagu

SEQ ID NO: 12984 - RNA, 20 nt, Artificial Sequence
  targeting sequence with CTCN PAM
guagcacccaaacccugagc

SEQ ID NO: 12985 - RNA, 20 nt, Artificial Sequence
  targeting sequence with CTCN PAM
agcuguagacaagcgaaugu

SEQ ID NO: 12986 - RNA, 20 nt, Artificial Sequence
  targeting sequence with CTCN PAM
aguauuuguaaacacucagu

SEQ ID NO: 12987 - RNA, 20 nt, Artificial Sequence
  targeting sequence with CTCN PAM
agauauuccuuguaucacac

SEQ ID NO: 12988 - RNA, 20 nt, Artificial Sequence
  targeting sequence with CTCN PAM
gucugacccugaccuguucc

SEQ ID NO: 12989 - RNA, 20 nt, Artificial Sequence
  targeting sequence with CTCN PAM
ucuugagucucagcguccuu

SEQ ID NO: 12990 - RNA, 20 nt, Artificial Sequence
  targeting sequence with CTCN PAM
agaagaggaacaggucaggg

SEQ ID NO: 12991 - RNA, 20 nt, Artificial Sequence
  targeting sequence with CTCN PAM
gcguccuucacucuaacacu

SEQ ID NO: 12992 - RNA, 20 nt, Artificial Sequence
  targeting sequence with CTCN PAM
aacacuuggguagugagacc

SEQ ID NO: 12993 - RNA, 20 nt, Artificial Sequence
  targeting sequence with CTCN PAM
cuacccaaguguuagaguga

SEQ ID NO: 12994 - RNA, 20 nt, Artificial Sequence
  targeting sequence with CTCN PAM
ggguaggucucacuacccaa

SEQ ID NO: 12995 - RNA, 20 nt, Artificial Sequence
  targeting sequence with CTCN PAM
gugacccucaggguaggucu

SEQ ID NO: 12996 - RNA, 20 nt, Artificial Sequence
  targeting sequence with CTCN PAM
cagugacccucaggguaggu

SEQ ID NO: 12997 - RNA, 20 nt, Artificial Sequence
  targeting sequence with CTCN PAM
uuagaaguagggauaucgua

SEQ ID NO: 12998 - RNA, 20 nt, Artificial Sequence
  targeting sequence with CTCN PAM
cucuugggcagaaacccuaa

SEQ ID NO: 12999 - RNA, 20 nt, Artificial Sequence
  targeting sequence with CTCN PAM
ugggcagaaacccuaaacau

SEQ ID NO: 13000 - RNA, 20 nt, Artificial Sequence
  targeting sequence with CTCN PAM
ugcucugucauccccaugag

SEQ ID NO: 13001 - RNA, 20 nt, Artificial Sequence
  targeting sequence with CTCN PAM
gucauccccaugagccacaa

SEQ ID NO: 13002 - RNA, 20 nt, Artificial Sequence
  targeting sequence with CTCN PAM
uggggaugacagagcaggag

SEQ ID NO: 13003 - RNA, 20 nt, Artificial Sequence
  targeting sequence with CTCN PAM
gccaaacggggccugcggau

SEQ ID NO: 13004 - RNA, 20 nt, Artificial Sequence
  targeting sequence with CTCN PAM
caaauccgcaggccccguuu

SEQ ID NO: 13005 - RNA, 20 nt, Artificial Sequence
  targeting sequence with CTCN PAM
caagaucucccaaauccgca

SEQ ID NO: 13006 - RNA, 20 nt, Artificial Sequence
  targeting sequence with CTCN PAM
uccaugaccccuaagcuccc

SEQ ID NO: 13007 - RNA, 20 nt, Artificial Sequence
  targeting sequence with CTCN PAM
gacucauccaugaccccuaa

SEQ ID NO: 13008 - RNA, 20 nt, Artificial Sequence
  targeting sequence with CTCN PAM
ggguugcuuuccuguguauu

SEQ ID NO: 13009 - RNA, 20 nt, Artificial Sequence
  targeting sequence with CTCN PAM
ccuagguucccgcugggaag

SEQ ID NO: 13010 - RNA, 20 nt, Artificial Sequence
  targeting sequence with CTCN PAM
ccccuagguucccgcuggga

SEQ ID NO: 13011 - RNA, 20 nt, Artificial Sequence
  targeting sequence with CTCN PAM
cuccccuagguucccgcugg

SEQ ID NO: 13012 - RNA, 20 nt, Artificial Sequence
  targeting sequence with CTCN PAM
uggcuguugucucucucccc

SEQ ID NO: 13013 - RNA, 20 nt, Artificial Sequence
  targeting sequence with CTCN PAM
cuugaaauagccacaucuaa

SEQ ID NO: 13014 - RNA, 20 nt, Artificial Sequence
  targeting sequence with CTCN PAM
gcagccaugggcaggaagca

SEQ ID NO: 13015 - RNA, 20 nt, Artificial Sequence
  targeting sequence with CTCN PAM
uggaaaaauuagaagcaaag

SEQ ID NO: 13016 - RNA, 20 nt, Artificial Sequence
  targeting sequence with CTCN PAM
ccuggaaaaauuagaagcaa

SEQ ID NO: 13017 - RNA, 20 nt, Artificial Sequence
  targeting sequence with CTCN PAM
ccgcuucuuccucuccugga

SEQ ID NO: 13018 - RNA, 20 nt, Artificial Sequence
  targeting sequence with CTCN PAM
ccccgcuucuuccucuccug

SEQ ID NO: 13019 - RNA, 20 nt, Artificial Sequence
  targeting sequence with CTCN PAM
uggaacuuccccugguagga

SEQ ID NO: 13020 - RNA, 20 nt, Artificial Sequence
  targeting sequence with CTCN PAM
uguacaguuuggcggccuca

SEQ ID NO: 13021 - RNA, 20 nt, Artificial Sequence
  targeting sequence with CTCN PAM
ucuuguacaguuuggcggcc

SEQ ID NO: 13022 - RNA, 20 nt, Artificial Sequence
  targeting sequence with CTCN PAM
ugcccacuccucuuguacag

SEQ ID NO: 13023 - RNA, 20 nt, Artificial Sequence
  targeting sequence with CTCN PAM
cgcuugaaauguacaccgac

SEQ ID NO: 13024 - RNA, 20 nt, Artificial Sequence
  targeting sequence with CTCN PAM
gcauguuugaguaugccaag

SEQ ID NO: 13025 - RNA, 20 nt, Artificial Sequence
  targeting sequence with CTCN PAM
aacaugcagaggucggugua

SEQ ID NO: 13026 - RNA, 20 nt, Artificial Sequence
  targeting sequence with CTCN PAM
agcuuggagcccacugguau

SEQ ID NO: 13027 - RNA, 20 nt, Artificial Sequence
  targeting sequence with CTCN PAM
aagcuggagcuugggccugg

SEQ ID NO: 13028 - RNA, 20 nt, Artificial Sequence
  targeting sequence with CTCN PAM
cgugcgguguccaaguuauu

SEQ ID NO: 13029 - RNA, 20 nt, Artificial Sequence
  targeting sequence with CTCN PAM
uggggaaaauaacuuggaca

SEQ ID NO: 13030 - RNA, 20 nt, Artificial Sequence
  targeting sequence with CTCN PAM
gaaaggauguggggaaacug

SEQ ID NO: 13031 - RNA, 20 nt, Artificial Sequence
  targeting sequence with CTCN PAM
ccuaaaacugaccuuuaagg

SEQ ID NO: 13032 - RNA, 20 nt, Artificial Sequence
  targeting sequence with CTCN PAM
augaagggauugugcuggug

SEQ ID NO: 13033 - RNA, 20 nt, Artificial Sequence
  targeting sequence with CTCN PAM
acucaaugaagggauugugc

SEQ ID NO: 13034 - RNA, 20 nt, Artificial Sequence
  targeting sequence with CTCN PAM
gggcuucagggcuguccccc

SEQ ID NO: 13035 - RNA, 20 nt, Artificial Sequence
  targeting sequence with CTCN PAM
caauccuugucaggagccgc

SEQ ID NO: 13036 - RNA, 20 nt, Artificial Sequence
  targeting sequence with CTCN PAM
auccuugucaggagccgcca

SEQ ID NO: 13037 - RNA, 20 nt, Artificial Sequence
  targeting sequence with CTCN PAM
ugacaaggauugagaggauu

SEQ ID NO: 13038 - RNA, 20 nt, Artificial Sequence
  targeting sequence with CTCN PAM
ugccugaagacaccgauucu

SEQ ID NO: 13039 - RNA, 20 nt, Artificial Sequence
  targeting sequence with CTCN PAM
cugggcuucugggaagucag

SEQ ID NO: 13040 - RNA, 20 nt, Artificial Sequence
  targeting sequence with CTCN PAM
gccugacuucccagaagccc

SEQ ID NO: 13041 - RNA, 20 nt, Artificial Sequence
  targeting sequence with CTCN PAM
gcccucccauguuagcgcag

SEQ ID NO: 13042 - RNA, 20 nt, Artificial Sequence
  targeting sequence with CTCN PAM
cauguuagcgcagcaugccu

SEQ ID NO: 13043 - RNA, 20 nt, Artificial Sequence
  targeting sequence with CTCN PAM
cgccugccggcugcagagug

SEQ ID NO: 13044 - RNA, 20 nt, Artificial Sequence
  targeting sequence with CTCN PAM
gcagccggcaggcgugaggc

SEQ ID NO: 13045 - RNA, 20 nt, Artificial Sequence
  targeting sequence with CTCN PAM
gccaucacccacugcaacca

SEQ ID NO: 13046 - RNA, 20 nt, Artificial Sequence
  targeting sequence with CTCN PAM
ccagcagagcugggccuuuu

SEQ ID NO: 13047 - RNA, 20 nt, Artificial Sequence
  targeting sequence with CTCN PAM
gcuggggaguaagguucaug

SEQ ID NO: 13048 - RNA, 20 nt, Artificial Sequence
  targeting sequence with CTCN PAM
uacaccugccuuaaaaggcc

SEQ ID NO: 13049 - RNA, 20 nt, Artificial Sequence
  targeting sequence with CTCN PAM
ccuacaccugccuuaaaagg

SEQ ID NO: 13050 - RNA, 20 nt, Artificial Sequence
  targeting sequence with CTCN PAM
ucuccuacaccugccuuaaa

SEQ ID NO: 13051 - RNA, 20 nt, Artificial Sequence
  targeting sequence with CTCN PAM
ugauggcuucugugggaagg

SEQ ID NO: 13052 - RNA, 20 nt, Artificial Sequence
  targeting sequence with CTCN PAM
uucccacagaagccaucagg

SEQ ID NO: 13053 - RNA, 20 nt, Artificial Sequence
  targeting sequence with CTCN PAM
uuagugcaacuccuucccac

SEQ ID NO: 13054 - RNA, 20 nt, Artificial Sequence
  targeting sequence with CTCN PAM
gggcuccuuagugcaacucc

SEQ ID NO: 13055 - RNA, 20 nt, Artificial Sequence
  targeting sequence with CTCN PAM
uugaaccuugcuuagacuga

SEQ ID NO: 13056 - RNA, 20 nt, Artificial Sequence
  targeting sequence with CTCN PAM
uugcccaguguaccgaagcc

SEQ ID NO: 13057 - RNA, 20 nt, Artificial Sequence
  targeting sequence with CTCN PAM
caguauguuaugaagugacu

SEQ ID NO: 13058 - RNA, 20 nt, Artificial Sequence
  targeting sequence with CTCN PAM
guauguuaugaagugacuca

SEQ ID NO: 13059 - RNA, 20 nt, Artificial Sequence
  targeting sequence with CTCN PAM
ucagccauaaccuauuggug

SEQ ID NO: 13060 - RNA, 20 nt, Artificial Sequence
  targeting sequence with CTCN PAM
agcucacaaguucaagaugg

SEQ ID NO: 13061 - RNA, 20 nt, Artificial Sequence
  targeting sequence with CTCN PAM
caaguucaagauggaaaauc

SEQ ID NO: 13062 - RNA, 20 nt, Artificial Sequence
  targeting sequence with CTCN PAM
uccaccaccuguucgacccu

SEQ ID NO: 13063 - RNA, 20 nt, Artificial Sequence
  targeting sequence with CTCN PAM
uccaaguccugaugaacaau

SEQ ID NO: 13064 - RNA, 20 nt, Artificial Sequence
  targeting sequence with CTCN PAM
ugggccccagccugucuuuu

SEQ ID NO: 13065 - RNA, 20 nt, Artificial Sequence
  targeting sequence with CTCN PAM
guaccugagacccagggugu

SEQ ID NO: 13066 - RNA, 20 nt, Artificial Sequence
  targeting sequence with CTCN PAM
gguacggagugaagaaauca

SEQ ID NO: 13067 - RNA, 20 nt, Artificial Sequence
  targeting sequence with CTCN PAM
cucuacuuuuuccucgucac

SEQ ID NO: 13068 - RNA, 20 nt, Artificial Sequence
  targeting sequence with CTCN PAM
acuuuuuccucgucaccuuu

SEQ ID NO: 13069 - RNA, 20 nt, Artificial Sequence
  targeting sequence with CTCN PAM
ucaccuuuccuacccucccu

SEQ ID NO: 13070 - RNA, 20 nt, Artificial Sequence
  targeting sequence with CTCN PAM
cucaggccccaccaaagaca

SEQ ID NO: 13071 - RNA, 20 nt, Artificial Sequence
  targeting sequence with CTCN PAM
ggccccaccaaagacaccua

SEQ ID NO: 13072 - RNA, 20 nt, Artificial Sequence
  targeting sequence with CTCN PAM
guaugaauguguuaugaaau

SEQ ID NO: 13073 - RNA, 20 nt, Artificial Sequence
  targeting sequence with CTCN PAM
ggugaucucaguaugaaugu

SEQ ID NO: 13074 - RNA, 20 nt, Artificial Sequence
  targeting sequence with CTCN PAM
gcuuccggggauaacaaaau

SEQ ID NO: 13075 - RNA, 20 nt, Artificial Sequence
  targeting sequence with CTCN PAM
ggaugaacccuuaagggauc

SEQ ID NO: 13076 - RNA, 20 nt, Artificial Sequence
  targeting sequence with CTCN PAM
agggucuugaucccuuaagg

SEQ ID NO: 13077 - RNA, 20 nt, Artificial Sequence
  targeting sequence with CTCN PAM
gggguucccaacccuaaauu

SEQ ID NO: 13078 - RNA, 20 nt, Artificial Sequence
  targeting sequence with CTCN PAM
ucaaggaggcagcugugcug

SEQ ID NO: 13079 - RNA, 20 nt, Artificial Sequence
  targeting sequence with CTCN PAM
aggaggcagcugugcugcag

SEQ ID NO: 13080 - RNA, 20 nt, Artificial Sequence
  targeting sequence with CTCN PAM
uugaggaggccucagggguu

SEQ ID NO: 13081 - RNA, 20 nt, Artificial Sequence
  targeting sequence with CTCN PAM
aaccuguaauacuagcacuu

SEQ ID NO: 13082 - RNA, 20 nt, Artificial Sequence
  targeting sequence with CTCN PAM
caaagugcuaguauuacagg

SEQ ID NO: 13083 - RNA, 20 nt, Artificial Sequence
  targeting sequence with CTCN PAM
agcaauccacccacuucagc

SEQ ID NO: 13084 - RNA, 20 nt, Artificial Sequence
  targeting sequence with CTCN PAM
ggaggucgagaccagccugg

SEQ ID NO: 13085 - RNA, 20 nt, Artificial Sequence
  targeting sequence with CTCN PAM
ugagcucaagcaauccaccc

SEQ ID NO: 13086 - RNA, 20 nt, Artificial Sequence
  targeting sequence with CTCN PAM
accuccugagcucaagcaau

SEQ ID NO: 13087 - RNA, 20 nt, Artificial Sequence
  targeting sequence with CTCN PAM
cucuaccaaaaaugcaaaaa

SEQ ID NO: 13088 - RNA, 20 nt, Artificial Sequence
  targeting sequence with CTCN PAM
cuaccaaaaaugcaaaaaau

SEQ ID NO: 13089 - RNA, 20 nt, Artificial Sequence
  targeting sequence with CTCN PAM
accaaaaaugcaaaaaauua

SEQ ID NO: 13090 - RNA, 20 nt, Artificial Sequence
  targeting sequence with CTCN PAM
caguagcugggacuacaggc

SEQ ID NO: 13091 - RNA, 20 nt, Artificial Sequence
  targeting sequence with CTCN PAM
agcaaucuuuccaccuuagc

SEQ ID NO: 13092 - RNA, 20 nt, Artificial Sequence
  targeting sequence with CTCN PAM
ggggcucaagcaaucuuucc

SEQ ID NO: 13093 - RNA, 20 nt, Artificial Sequence
  targeting sequence with CTCN PAM
cugcaacuuccaccucuggg

SEQ ID NO: 13094 - RNA, 20 nt, Artificial Sequence
  targeting sequence with CTCN PAM
gucacccaggcuggaaugca

SEQ ID NO: 13095 - RNA, 20 nt, Artificial Sequence
  targeting sequence with CTCN PAM
ggggcaccaaggccaggcau

SEQ ID NO: 13096 - RNA, 20 nt, Artificial Sequence
  targeting sequence with CTCN PAM
caccagcucuggggcaccaa

SEQ ID NO: 13097 - RNA, 20 nt, Artificial Sequence
  targeting sequence with CTCN PAM
ucgguuugccaaaccucccu

SEQ ID NO: 13098 - RNA, 20 nt, Artificial Sequence
  targeting sequence with CTCN PAM
cuucccuucucagaugguaa

SEQ ID NO: 13099 - RNA, 20 nt, Artificial Sequence
  targeting sequence with CTCN PAM
gaugguaauagcgacagcuc

SEQ ID NO: 13100 - RNA, 20 nt, Artificial Sequence
  targeting sequence with CTCN PAM
guuuagucaugagauuugca

SEQ ID NO: 13101 - RNA, 20 nt, Artificial Sequence
  targeting sequence with CTCN PAM
ugacuaaacugagcugucgc

SEQ ID NO: 13102 - RNA, 20 nt, Artificial Sequence
  targeting sequence with CTCN PAM
ucuuccuaaucuuucuacag

SEQ ID NO: 13103 - RNA, 20 nt, Artificial Sequence
  targeting sequence with CTCN PAM
caucuuccuaaucuuucuac

SEQ ID NO: 13104 - RNA, 20 nt, Artificial Sequence
  targeting sequence with CTCN PAM
guggucacguguggccccuc

SEQ ID NO: 13105 - RNA, 20 nt, Artificial Sequence
  targeting sequence with CTCN PAM
cucccuggcuggccccacuc

SEQ ID NO: 13106 - RNA, 20 nt, Artificial Sequence
  targeting sequence with CTCN PAM
cccuggcuggccccacuccu

SEQ ID NO: 13107 - RNA, 20 nt, Artificial Sequence
  targeting sequence with CTCN PAM
cuggcuggccccacuccugc

SEQ ID NO: 13108 - RNA, 20 nt, Artificial Sequence
  targeting sequence with CTCN PAM
ugccccugcucugaggcccc

SEQ ID NO: 13109 - RNA, 20 nt, Artificial Sequence
  targeting sequence with CTCN PAM
gaggccccuccuuacacugu

SEQ ID NO: 13110 - RNA, 20 nt, Artificial Sequence
  targeting sequence with CTCN PAM
gagcaggggcaggagugggg

SEQ ID NO: 13111 - RNA, 20 nt, Artificial Sequence
  targeting sequence with CTCN PAM
uuacacugugguggacuucg

SEQ ID NO: 13112 - RNA, 20 nt, Artificial Sequence
  targeting sequence with CTCN PAM
caccagaacugcagcccauu

SEQ ID NO: 13113 - RNA, 20 nt, Artificial Sequence
  targeting sequence with CTCN PAM
auuugcuccgucucucuaug

SEQ ID NO: 13114 - RNA, 20 nt, Artificial Sequence
  targeting sequence with CTCN PAM
gucucucuaugaagguaaau

SEQ ID NO: 13115 - RNA, 20 nt, Artificial Sequence
  targeting sequence with CTCN PAM
cuaugaagguaaauacucug

SEQ ID NO: 13116 - RNA, 20 nt, Artificial Sequence
  targeting sequence with CTCN PAM
augaagguaaauacucuggg

SEQ ID NO: 13117 - RNA, 20 nt, Artificial Sequence
  targeting sequence with CTCN PAM
gggacuuguuuuugguuuua

SEQ ID NO: 13118 - RNA, 20 nt, Artificial Sequence
  targeting sequence with CTCN PAM
uuggaauagugaucaaaaac

SEQ ID NO: 13119 - RNA, 20 nt, Artificial Sequence
  targeting sequence with CTCN PAM
aauucagacuaccagguggg

SEQ ID NO: 13120 - RNA, 20 nt, Artificial Sequence
  targeting sequence with CTCN PAM
cccaccccccacauaaugug

SEQ ID NO: 13121 - RNA, 20 nt, Artificial Sequence
  targeting sequence with CTCN PAM
uaacucuuauguaguauguu

SEQ ID NO: 13122 - RNA, 20 nt, Artificial Sequence
  targeting sequence with CTCN PAM
uauguaguauguucuuauca

SEQ ID NO: 13123 - RNA, 20 nt, Artificial Sequence
  targeting sequence with CTCN PAM
ugcuuggugauuuugauaag

SEQ ID NO: 13124 - RNA, 20 nt, Artificial Sequence
  targeting sequence with CTCN PAM
uucaucacucagcacagccu

SEQ ID NO: 13125 - RNA, 20 nt, Artificial Sequence
  targeting sequence with CTCN PAM
gcacagccucuuucugucca

SEQ ID NO: 13126 - RNA, 20 nt, Artificial Sequence
  targeting sequence with CTCN PAM
uucuguccacuucagggcca

SEQ ID NO: 13127 - RNA, 20 nt, Artificial Sequence
  targeting sequence with CTCN PAM
gcaaacuggaaauucaaagg

SEQ ID NO: 13128 - RNA, 20 nt, Artificial Sequence
  targeting sequence with CTCN PAM
cugagugaccagcuggccua

SEQ ID NO: 13129 - RNA, 20 nt, Artificial Sequence
  targeting sequence with CTCN PAM
gggagcugugacuucauuga

SEQ ID NO: 13130 - RNA, 20 nt, Artificial Sequence
  targeting sequence with CTCN PAM
cucucagccucucacccuug

SEQ ID NO: 13131 - RNA, 20 nt, Artificial Sequence
  targeting sequence with CTCN PAM
cagccucucacccuugccgu

SEQ ID NO: 13132 - RNA, 20 nt, Artificial Sequence
  targeting sequence with CTCN PAM
gccucucacccuugccgugg

SEQ ID NO: 13133 - RNA, 20 nt, Artificial Sequence
  targeting sequence with CTCN PAM
cacccuugccguggucaccc

SEQ ID NO: 13134 - RNA, 20 nt, Artificial Sequence
  targeting sequence with CTCN PAM
cccuugccguggucaccccu

SEQ ID NO: 13135 - RNA, 20 nt, Artificial Sequence
  targeting sequence with CTCN PAM
ggggaccaggggugaccacg

SEQ ID NO: 13136 - RNA, 20 nt, Artificial Sequence
  targeting sequence with CTCN PAM
cugaagucccuuugaaggac

SEQ ID NO: 13137 - RNA, 20 nt, Artificial Sequence
  targeting sequence with CTCN PAM
uaagaugccuguuuuccucc

SEQ ID NO: 13138 - RNA, 20 nt, Artificial Sequence
  targeting sequence with CTCN PAM
agcugccacccucauuucac

SEQ ID NO: 13139 - RNA, 20 nt, Artificial Sequence
  targeting sequence with CTCN PAM
uuucaccagccagguaggca

SEQ ID NO: 13140 - RNA, 20 nt, Artificial Sequence
  targeting sequence with CTCN PAM
augccagcacgaagcuggaa

SEQ ID NO: 13141 - RNA, 20 nt, Artificial Sequence
  targeting sequence with CTCN PAM
agggagaaccaaaggccagc

SEQ ID NO: 13142 - RNA, 20 nt, Artificial Sequence
  targeting sequence with CTCN PAM
cuggagcugacaaagggaag

SEQ ID NO: 13143 - RNA, 20 nt, Artificial Sequence
  targeting sequence with CTCN PAM
ccuucuuaaaauguaucaua

SEQ ID NO: 13144 - RNA, 20 nt, Artificial Sequence
  targeting sequence with CTCN PAM
gaaagcacauuuacccugaa

SEQ ID NO: 13145 - RNA, 20 nt, Artificial Sequence
  targeting sequence with CTCN PAM
uuugcuuucaggguaaaugu

SEQ ID NO: 13146 - RNA, 20 nt, Artificial Sequence
  targeting sequence with CTCN PAM
cuuuuuucccucauuugcuu

SEQ ID NO: 13147 - RNA, 20 nt, Artificial Sequence
  targeting sequence with CTCN PAM
ugugucagaaaaguacaguc

SEQ ID NO: 13148 - RNA, 20 nt, Artificial Sequence
  targeting sequence with CTCN PAM
uuuccccaugauuaacacuc

SEQ ID NO: 13149 - RNA, 20 nt, Artificial Sequence
  targeting sequence with CTCN PAM
gugaggcugacacaaaguac

SEQ ID NO: 13150 - RNA, 20 nt, Artificial Sequence
  targeting sequence with CTCN PAM
cugagaacaaaaaaagcacu

SEQ ID NO: 13151 - RNA, 20 nt, Artificial Sequence
  targeting sequence with CTCN PAM
ccacaggguacauuauuccu

SEQ ID NO: 13152 - RNA, 20 nt, Artificial Sequence
  targeting sequence with CTCN PAM
acaggguacauuauuccuga

SEQ ID NO: 13153 - RNA, 20 nt, Artificial Sequence
  targeting sequence with CTCN PAM
ggaauaauguacccugugga

SEQ ID NO: 13154 - RNA, 20 nt, Artificial Sequence
  targeting sequence with CTCN PAM
caguuucccuuuuugaaaag

SEQ ID NO: 13155 - RNA, 20 nt, Artificial Sequence
  targeting sequence with CTCN PAM
accuuuaaaagcugccucaa

SEQ ID NO: 13156 - RNA, 20 nt, Artificial Sequence
  targeting sequence with CTCN PAM
auucuggcaaacucccacgu

SEQ ID NO: 13157 - RNA, 20 nt, Artificial Sequence
  targeting sequence with CTCN PAM
cacguguguauuuuggguaa

SEQ ID NO: 13158 - RNA, 20 nt, Artificial Sequence
  targeting sequence with CTCN PAM
gaaaagaggugguguucuga

SEQ ID NO: 13159 - RNA, 20 nt, Artificial Sequence
  targeting sequence with CTCN PAM
uuucagaguaguuacccaaa

SEQ ID NO: 13160 - RNA, 20 nt, Artificial Sequence
  targeting sequence with CTCN PAM
gaacaccaccucuuuucaga

SEQ ID NO: 13161 - RNA, 20 nt, Artificial Sequence
  targeting sequence with CTCN PAM
cacauuguagggccagccca

SEQ ID NO: 13162 - RNA, 20 nt, Artificial Sequence
  targeting sequence with CTCN PAM
gggcuggcccuacaaugugu

SEQ ID NO: 13163 - RNA, 20 nt, Artificial Sequence
  targeting sequence with CTCN PAM
gaagugguaugcccagcuuc

SEQ ID NO: 13164 - RNA, 20 nt, Artificial Sequence
  targeting sequence with CTCN PAM
gcauaccucugaagugguau

SEQ ID NO: 13165 - RNA, 20 nt, Artificial Sequence
  targeting sequence with CTCN PAM
gagccuccaggaccacagcc

SEQ ID NO: 13166 - RNA, 20 nt, Artificial Sequence
  targeting sequence with CTCN PAM
gagaucaggccuagggccug

SEQ ID NO: 13167 - RNA, 20 nt, Artificial Sequence
  targeting sequence with CTCN PAM
aggaccacagccaucucuuc

SEQ ID NO: 13168 - RNA, 20 nt, Artificial Sequence
  targeting sequence with CTCN PAM
uccuucucagguccucuccu

SEQ ID NO: 13169 - RNA, 20 nt, Artificial Sequence
  targeting sequence with CTCN PAM
gguccucuccugagcaccuu

SEQ ID NO: 13170 - RNA, 20 nt, Artificial Sequence
  targeting sequence with CTCN PAM
ccugagcaccuucccugccu

SEQ ID NO: 13171 - RNA, 20 nt, Artificial Sequence
  targeting sequence with CTCN PAM
ugagcaccuucccugccuca

SEQ ID NO: 13172 - RNA, 20 nt, Artificial Sequence
  targeting sequence with CTCN PAM
ggagaggaccugagaaggaa

SEQ ID NO: 13173 - RNA, 20 nt, Artificial Sequence
  targeting sequence with CTCN PAM
gauucccccauggccuccug

SEQ ID NO: 13174 - RNA, 20 nt, Artificial Sequence
  targeting sequence with CTCN PAM
ugcugucccacugucggauc

SEQ ID NO: 13175 - RNA, 20 nt, Artificial Sequence
  targeting sequence with CTCN PAM
ccccugcagaccugaccuca

SEQ ID NO: 13176 - RNA, 20 nt, Artificial Sequence
  targeting sequence with CTCN PAM
gcacaggaucccuaaccauu

SEQ ID NO: 13177 - RNA, 20 nt, Artificial Sequence
  targeting sequence with CTCN PAM
gcugaaugguuagggauccu

SEQ ID NO: 13178 - RNA, 20 nt, Artificial Sequence
  targeting sequence with CTCN PAM
gguuaguugcuucucagcug

SEQ ID NO: 13179 - RNA, 20 nt, Artificial Sequence
  targeting sequence with CTCN PAM
cugguuaguugcuucucagc

SEQ ID NO: 13180 - RNA, 20 nt, Artificial Sequence
  targeting sequence with CTCN PAM
aguucagggcacagaauguu

SEQ ID NO: 13181 - RNA, 20 nt, Artificial Sequence
  targeting sequence with CTCN PAM
gagagggcauggagggcacg

SEQ ID NO: 13182 - RNA, 20 nt, Artificial Sequence
  targeting sequence with CTCN PAM
gagucaccagcaaacauucu

SEQ ID NO: 13183 - RNA, 20 nt, Artificial Sequence
  targeting sequence with CTCN PAM
cugagucaccagcaaacauu

SEQ ID NO: 13184 - RNA, 20 nt, Artificial Sequence
  targeting sequence with CTCN PAM
augcccucucugagucacca

SEQ ID NO: 13185 - RNA, 20 nt, Artificial Sequence
  targeting sequence with CTCN PAM
gugcccuccaugcccucucu

SEQ ID NO: 13186 - RNA, 20 nt, Artificial Sequence
  targeting sequence with CTCN PAM
gccucacucugaagcaugug

SEQ ID NO: 13187 - RNA, 20 nt, Artificial Sequence
  targeting sequence with CTCN PAM
cucugaagcaugugguauca

SEQ ID NO: 13188 - RNA, 20 nt, Artificial Sequence
  targeting sequence with CTCN PAM
gaagcaugugguaucaccca

SEQ ID NO: 13189 - RNA, 20 nt, Artificial Sequence
  targeting sequence with CTCN PAM
auauguggaauugugcacca

SEQ ID NO: 13190 - RNA, 20 nt, Artificial Sequence
  targeting sequence with CTCN PAM
uugcuguuuaggaacagucc

SEQ ID NO: 13191 - RNA, 20 nt, Artificial Sequence
  targeting sequence with CTCN PAM
cauaguuuggucaauacagg

SEQ ID NO: 13192 - RNA, 20 nt, Artificial Sequence
  targeting sequence with CTCN PAM
cacauaguuuggucaauaca

SEQ ID NO: 13193 - RNA, 20 nt, Artificial Sequence
  targeting sequence with CTCN PAM
cucacauaguuuggucaaua

SEQ ID NO: 13194 - RNA, 20 nt, Artificial Sequence
  targeting sequence with CTCN PAM
cucucacauaguuuggucaa

SEQ ID NO: 13195 - RNA, 20 nt, Artificial Sequence
  targeting sequence with CTCN PAM
caaaugggcauuuguucauc

SEQ ID NO: 13196 - RNA, 20 nt, Artificial Sequence
  targeting sequence with CTCN PAM
ggcugcccugcagguguucc

SEQ ID NO: 13197 - RNA, 20 nt, Artificial Sequence
  targeting sequence with CTCN PAM
ucccgagaccugggacuccc

SEQ ID NO: 13198 - RNA, 20 nt, Artificial Sequence
  targeting sequence with CTCN PAM
ggaagagugaucucaggcug

SEQ ID NO: 13199 - RNA, 20 nt, Artificial Sequence
  targeting sequence with CTCN PAM
cccaacucagccccucaggg

SEQ ID NO: 13200 - RNA, 20 nt, Artificial Sequence
  targeting sequence with CTCN PAM
gccccucagggccgggcccu

SEQ ID NO: 13201 - RNA, 20 nt, Artificial Sequence
  targeting sequence with CTCN PAM
gggccgggcccugccuaccu

SEQ ID NO: 13202 - RNA, 20 nt, Artificial Sequence
  targeting sequence with CTCN PAM
ugguugccugcuucagccau

SEQ ID NO: 13203 - RNA, 20 nt, Artificial Sequence
  targeting sequence with CTCN PAM
acauggcugaagcaggcaac

SEQ ID NO: 13204 - RNA, 20 nt, Artificial Sequence
  targeting sequence with CTCN PAM
ggaucagaacuuccugugcc

SEQ ID NO: 13205 - RNA, 20 nt, Artificial Sequence
  targeting sequence with CTCN PAM
ggauuuccuuggaucuggag

SEQ ID NO: 13206 - RNA, 20 nt, Artificial Sequence
  targeting sequence with CTCN PAM
agauccaaggaaauccugag

SEQ ID NO: 13207 - RNA, 20 nt, Artificial Sequence
  targeting sequence with CTCN PAM
uugauauuucuggcccaguc

SEQ ID NO: 13208 - RNA, 20 nt, Artificial Sequence
  targeting sequence with CTCN PAM
acggcggcuuugggcuccuu

SEQ ID NO: 13209 - RNA, 20 nt, Artificial Sequence
  targeting sequence with CTCN PAM
gcaggagagcacgucaaggc

SEQ ID NO: 13210 - RNA, 20 nt, Artificial Sequence
  targeting sequence with CTCN PAM
ugcugagauguacaucucca

SEQ ID NO: 13211 - RNA, 20 nt, Artificial Sequence
  targeting sequence with CTCN PAM
ccugcugagauguacaucuc

SEQ ID NO: 13212 - RNA, 20 nt, Artificial Sequence
  targeting sequence with CTCN PAM
auggccuugacgugcucucc

SEQ ID NO: 13213 - RNA, 20 nt, Artificial Sequence
  targeting sequence with CTCN PAM
gggcagggaccaaaaccuac

SEQ ID NO: 13214 - RNA, 20 nt, Artificial Sequence
  targeting sequence with CTCN PAM
ugacugacaagggaaccaau

SEQ ID NO: 13215 - RNA, 20 nt, Artificial Sequence
  targeting sequence with CTCN PAM
ugaagaaccuagccacuauc

SEQ ID NO: 13216 - RNA, 20 nt, Artificial Sequence
  targeting sequence with CTCN PAM
gugucuccugaagaaccuag

SEQ ID NO: 13217 - RNA, 20 nt, Artificial Sequence
  targeting sequence with CTCN PAM
uggaaggcagccacugccuu

SEQ ID NO: 13218 - RNA, 20 nt, Artificial Sequence
  targeting sequence with CTCN PAM
acaagcuccuggaaggcagc

SEQ ID NO: 13219 - RNA, 20 nt, Artificial Sequence
  targeting sequence with CTCN PAM
ucccugguccccaccauccc

SEQ ID NO: 13220 - RNA, 20 nt, Artificial Sequence
  targeting sequence with CTCN PAM
ucuucccugguccccaccau

SEQ ID NO: 13221 - RNA, 20 nt, Artificial Sequence
  targeting sequence with CTCN PAM
gcaaauggcagcugugaugu

SEQ ID NO: 13222 - RNA, 20 nt, Artificial Sequence
  targeting sequence with CTCN PAM
cuacaacccagacgcuguga

SEQ ID NO: 13223 - RNA, 20 nt, Artificial Sequence
  targeting sequence with CTCN PAM
ucgcccaccuugcagaugau

SEQ ID NO: 13224 - RNA, 20 nt, Artificial Sequence
  targeting sequence with CTCN PAM
cccaccuugcagaugaugaa

SEQ ID NO: 13225 - RNA, 20 nt, Artificial Sequence
  targeting sequence with CTCN PAM
acaacuuuccagcuaucugg

SEQ ID NO: 13226 - RNA, 20 nt, Artificial Sequence
  targeting sequence with CTCN PAM
gcucuacaacuuuccagcua

SEQ ID NO: 13227 - RNA, 20 nt, Artificial Sequence
  targeting sequence with CTCN PAM
gaucugcuggaugucgaugc

SEQ ID NO: 13228 - RNA, 20 nt, Artificial Sequence
  targeting sequence with CTCN PAM
cauaagaauucuucccugau

SEQ ID NO: 13229 - RNA, 20 nt, Artificial Sequence
  targeting sequence with CTCN PAM
uaggagacacucuuuccaug

SEQ ID NO: 13230 - RNA, 20 nt, Artificial Sequence
  targeting sequence with CTCN PAM
uaagagaagauauccauggu

SEQ ID NO: 13231 - RNA, 20 nt, Artificial Sequence
  targeting sequence with CTCN PAM
uuccaugaagggaccuuaaa

SEQ ID NO: 13232 - RNA, 20 nt, Artificial Sequence
  targeting sequence with CTCN PAM
uggaauucuuuaaggucccu

SEQ ID NO: 13233 - RNA, 20 nt, Artificial Sequence
  targeting sequence with CTCN PAM
auuuaccucuuggaauucuu

SEQ ID NO: 13234 - RNA, 20 nt, Artificial Sequence
  targeting sequence with CTCN PAM
cuguguuucugcuguacuuc

SEQ ID NO: 13235 - RNA, 20 nt, Artificial Sequence
  targeting sequence with CTCN PAM
gguuggaauaaaagacgugu

SEQ ID NO: 13236 - RNA, 20 nt, Artificial Sequence
  targeting sequence with CTCN PAM
cauucccacacgucuuuuau

SEQ ID NO: 13237 - RNA, 20 nt, Artificial Sequence
  targeting sequence with CTCN PAM
gaugccaaacggaggugcuu

SEQ ID NO: 13238 - RNA, 20 nt, Artificial Sequence
  targeting sequence with CTCN PAM
guuuggcaucggaggcccuu

SEQ ID NO: 13239 - RNA, 20 nt, Artificial Sequence
  targeting sequence with CTCN PAM
cuauuggcaaaucuaagcac

SEQ ID NO: 13240 - RNA, 20 nt, Artificial Sequence
  targeting sequence with CTCN PAM
ggcaggcagguagaauggag

SEQ ID NO: 13241 - RNA, 20 nt, Artificial Sequence
  targeting sequence with CTCN PAM
auucuaccugccugccugag

SEQ ID NO: 13242 - RNA, 20 nt, Artificial Sequence
  targeting sequence with CTCN PAM
acugcacuagccaguuaucu

SEQ ID NO: 13243 - RNA, 20 nt, Artificial Sequence
  targeting sequence with CTCN PAM
ugcucuacugcacuagccag

SEQ ID NO: 13244 - RNA, 20 nt, Artificial Sequence
  targeting sequence with CTCN PAM
gcuaccaaguucccuccugc

SEQ ID NO: 13245 - RNA, 20 nt, Artificial Sequence
  targeting sequence with CTCN PAM
ugcccucagcuaccaaguuc

SEQ ID NO: 13246 - RNA, 20 nt, Artificial Sequence
  targeting sequence with CTCN PAM
caugcccucagcuaccaagu

SEQ ID NO: 13247 - RNA, 20 nt, Artificial Sequence
  targeting sequence with CTCN PAM
cucaugcccucagcuaccaa

SEQ ID NO: 13248 - RNA, 20 nt, Artificial Sequence
  targeting sequence with CTCN PAM
ccacugccccaacacccugg

SEQ ID NO: 13249 - RNA, 20 nt, Artificial Sequence
  targeting sequence with CTCN PAM
guggcugcugguggguuaca

SEQ ID NO: 13250 - RNA, 20 nt, Artificial Sequence
  targeting sequence with CTCN PAM
cuguuguccaccuugacgaa

SEQ ID NO: 13251 - RNA, 20 nt, Artificial Sequence
  targeting sequence with CTCN PAM
cccuguuguccaccuugacg

SEQ ID NO: 13252 - RNA, 20 nt, Artificial Sequence
  targeting sequence with CTCN PAM
ucucccuguuguccaccuug

SEQ ID NO: 13253 - RNA, 20 nt, Artificial Sequence
  targeting sequence with CTCN PAM
gugcugccccaccccaaccc

SEQ ID NO: 13254 - RNA, 20 nt, Artificial Sequence
  targeting sequence with CTCN PAM
gcacaccggaccuugagggg

SEQ ID NO: 13255 - RNA, 20 nt, Artificial Sequence
  targeting sequence with CTCN PAM
agguccggugugcugagucc

SEQ ID NO: 13256 - RNA, 20 nt, Artificial Sequence
  targeting sequence with CTCN PAM
cagucagugagcuucaggcu

SEQ ID NO: 13257 - RNA, 20 nt, Artificial Sequence
  targeting sequence with CTCN PAM
cugacugggaggacaaagcc

SEQ ID NO: 13258 - RNA, 20 nt, Artificial Sequence
  targeting sequence with CTCN PAM
agcaugugcacacacacgug

SEQ ID NO: 13259 - RNA, 20 nt, Artificial Sequence
  targeting sequence with CTCN PAM
ugaggguggcucaggcuggg

SEQ ID NO: 13260 - RNA, 20 nt, Artificial Sequence
  targeting sequence with CTCN PAM
ggagcuugucccaucguguc

SEQ ID NO: 13261 - RNA, 20 nt, Artificial Sequence
  targeting sequence with CTCN PAM
ggcuggguccuaaaggcugu

SEQ ID NO: 13262 - RNA, 20 nt, Artificial Sequence
  targeting sequence with CTCN PAM
uccauauccccaaauccugg

SEQ ID NO: 13263 - RNA, 20 nt, Artificial Sequence
  targeting sequence with CTCN PAM
caaagggaccuugauggaug

SEQ ID NO: 13264 - RNA, 20 nt, Artificial Sequence
  targeting sequence with CTCN PAM
gucuuuaaaaaaauuacuau

SEQ ID NO: 13265 - RNA, 20 nt, Artificial Sequence
  targeting sequence with CTCN PAM
ucuauaugaaccccuucauu

SEQ ID NO: 13266 - RNA, 20 nt, Artificial Sequence
  targeting sequence with CTCN PAM
cuucuauaugaaccccuuca

SEQ ID NO: 13267 - RNA, 20 nt, Artificial Sequence
  targeting sequence with CTCN PAM
guucucucuucugguuuuuc

SEQ ID NO: 13268 - RNA, 20 nt, Artificial Sequence
  targeting sequence with CTCN PAM
cuucugguuuuucuugucac

SEQ ID NO: 13269 - RNA, 20 nt, Artificial Sequence
  targeting sequence with CTCN PAM
ucugguuuuucuugucacuu

SEQ ID NO: 13270 - RNA, 20 nt, Artificial Sequence
  targeting sequence with CTCN PAM
ggguaaccugauacuauagc

SEQ ID NO: 13271 - RNA, 20 nt, Artificial Sequence
  targeting sequence with CTCN PAM
aguacccucaggguaaccug

SEQ ID NO: 13272 - RNA, 20 nt, Artificial Sequence
  targeting sequence with CTCN PAM
agggacguugggugugaugg

SEQ ID NO: 13273 - RNA, 20 nt, Artificial Sequence
  targeting sequence with CTCN PAM
gcagaaaaaggacacguuuu

SEQ ID NO: 13274 - RNA, 20 nt, Artificial Sequence
  targeting sequence with CTCN PAM
gugccuugccugucuccaga

SEQ ID NO: 13275 - RNA, 20 nt, Artificial Sequence
  targeting sequence with CTCN PAM
agacagggauucguuacagc

SEQ ID NO: 13276 - RNA, 20 nt, Artificial Sequence
  targeting sequence with CTCN PAM
uuccuuucucaccaagacua

SEQ ID NO: 13277 - RNA, 20 nt, Artificial Sequence
  targeting sequence with CTCN PAM
ccaagacuagccuggguaga

SEQ ID NO: 13278 - RNA, 20 nt, Artificial Sequence
  targeting sequence with CTCN PAM
ugggagaguuaguuugacuc

SEQ ID NO: 13279 - RNA, 20 nt, Artificial Sequence
  targeting sequence with CTCN PAM
caggagaaaggguucuaccc

SEQ ID NO: 13280 - RNA, 20 nt, Artificial Sequence
  targeting sequence with CTCN PAM
cccaggagaaaggguucuac

SEQ ID NO: 13281 - RNA, 20 nt, Artificial Sequence
  targeting sequence with CTCN PAM
aaauuccagccugaccagag

SEQ ID NO: 13282 - RNA, 20 nt, Artificial Sequence
  targeting sequence with CTCN PAM
ggucaggcuggaauuuggag

SEQ ID NO: 13283 - RNA, 20 nt, Artificial Sequence
  targeting sequence with CTCN PAM
cuggucaggcuggaauuugg

SEQ ID NO: 13284 - RNA, 20 nt, Artificial Sequence
  targeting sequence with CTCN PAM
uguccccaugagugauggga

SEQ ID NO: 13285 - RNA, 20 nt, Artificial Sequence
  targeting sequence with CTCN PAM
uggggacaugaggccuggau

SEQ ID NO: 13286 - RNA, 20 nt, Artificial Sequence
  targeting sequence with CTCN PAM
caucacucauggggacauga

SEQ ID NO: 13287 - RNA, 20 nt, Artificial Sequence
  targeting sequence with CTCN PAM
ccauggggaagcagugguga

SEQ ID NO: 13288 - RNA, 20 nt, Artificial Sequence
  targeting sequence with CTCN PAM
ccacugcuuccccaugguga

SEQ ID NO: 13289 - RNA, 20 nt, Artificial Sequence
  targeting sequence with CTCN PAM
ucccucuuuggucagcacgu

SEQ ID NO: 13290 - RNA, 20 nt, Artificial Sequence
  targeting sequence with CTCN PAM
cucuuuggucagcacguugg

SEQ ID NO: 13291 - RNA, 20 nt, Artificial Sequence
  targeting sequence with CTCN PAM
uuggucagcacguuggccag

SEQ ID NO: 13292 - RNA, 20 nt, Artificial Sequence
  targeting sequence with CTCN PAM
uggccaacgugcugaccaaa

SEQ ID NO: 13293 - RNA, 20 nt, Artificial Sequence
  targeting sequence with CTCN PAM
ggacaaaggccugcaggaag

SEQ ID NO: 13294 - RNA, 20 nt, Artificial Sequence
  targeting sequence with CTCN PAM
gagcaggccccacacucacc

SEQ ID NO: 13295 - RNA, 20 nt, Artificial Sequence
  targeting sequence with CTCN PAM
gagcucuggacaaaggccug

SEQ ID NO: 13296 - RNA, 20 nt, Artificial Sequence
  targeting sequence with CTCN PAM
ccucuuccuuuagagggcag

SEQ ID NO: 13297 - RNA, 20 nt, Artificial Sequence
  targeting sequence with CTCN PAM
uccuuuagagggcagucauu

SEQ ID NO: 13298 - RNA, 20 nt, Artificial Sequence
  targeting sequence with CTCN PAM
aaaggaagaggugagugugg

SEQ ID NO: 13299 - RNA, 20 nt, Artificial Sequence
  targeting sequence with CTCN PAM
augacugcccucuaaaggaa

SEQ ID NO: 13300 - RNA, 20 nt, Artificial Sequence
  targeting sequence with CTCN PAM
cggaaaaguggaugccaagg

SEQ ID NO: 13301 - RNA, 20 nt, Artificial Sequence
  targeting sequence with CTCN PAM
uuccaccacgggugcaggaa

SEQ ID NO: 13302 - RNA, 20 nt, Artificial Sequence
  targeting sequence with CTCN PAM
ucugagagauggaaauaauc

SEQ ID NO: 13303 - RNA, 20 nt, Artificial Sequence
  targeting sequence with CTCN PAM
gaugagaagaauaaagucug

SEQ ID NO: 13304 - RNA, 20 nt, Artificial Sequence
  targeting sequence with CTCN PAM
cagaugagaagaauaaaguc

SEQ ID NO: 13305 - RNA, 20 nt, Artificial Sequence
  targeting sequence with CTCN PAM
uaggguggugaagauucuga

SEQ ID NO: 13306 - RNA, 20 nt, Artificial Sequence
  targeting sequence with CTCN PAM
uggcgucaucuggguaccug

SEQ ID NO: 13307 - RNA, 20 nt, Artificial Sequence
  targeting sequence with CTCN PAM
gggucuugucaacggcaagc

SEQ ID NO: 13308 - RNA, 20 nt, Artificial Sequence
  targeting sequence with CTCN PAM
uaccugccccuucccucucc

SEQ ID NO: 13309 - RNA, 20 nt, Artificial Sequence
  targeting sequence with CTCN PAM
ccagguugaucgacaucgcc

SEQ ID NO: 13310 - RNA, 20 nt, Artificial Sequence
  targeting sequence with CTCN PAM
agguugaucgacaucgcccg

SEQ ID NO: 13311 - RNA, 20 nt, Artificial Sequence
  targeting sequence with CTCN PAM
gccuuguccaguuugcgggc

SEQ ID NO: 13312 - RNA, 20 nt, Artificial Sequence
  targeting sequence with CTCN PAM
cgcucagccuuguccaguuu

SEQ ID NO: 13313 - RNA, 20 nt, Artificial Sequence
  targeting sequence with CTCN PAM
agaagcuggacagcccuggc

SEQ ID NO: 13314 - RNA, 20 nt, Artificial Sequence
  targeting sequence with CTCN PAM
gcagcauagccagggcuguc

SEQ ID NO: 13315 - RNA, 20 nt, Artificial Sequence
  targeting sequence with CTCN PAM
agucccuggugcagcugcac

SEQ ID NO: 13316 - RNA, 20 nt, Artificial Sequence
  targeting sequence with CTCN PAM
acgugcagcugcaccaggga

SEQ ID NO: 13317 - RNA, 20 nt, Artificial Sequence
  targeting sequence with CTCN PAM
ucccagcgcugggucuccac

SEQ ID NO: 13318 - RNA, 20 nt, Artificial Sequence
  targeting sequence with CTCN PAM
ccucaucccagcgcuggguc

SEQ ID NO: 13319 - RNA, 20 nt, Artificial Sequence
  targeting sequence with CTCN PAM
ugggcuggggccccaccuga

SEQ ID NO: 13320 - RNA, 20 nt, Artificial Sequence
  targeting sequence with CTCN PAM
gguggggccccagcccauga

SEQ ID NO: 13321 - RNA, 20 nt, Artificial Sequence
  targeting sequence with CTCN PAM
aucugaaccccaaagggccc

SEQ ID NO: 13322 - RNA, 20 nt, Artificial Sequence
  targeting sequence with CTCN PAM
ccaucugaaccccaaagggc

SEQ ID NO: 13323 - RNA, 20 nt, Artificial Sequence
  targeting sequence with CTCN PAM
ugauggaaggaacauugggc

SEQ ID NO: 13324 - RNA, 20 nt, Artificial Sequence
  targeting sequence with CTCN PAM
aauucucugagccacagaau

SEQ ID NO: 13325 - RNA, 20 nt, Artificial Sequence
  targeting sequence with CTCN PAM
gagccacagaaucguggagg

SEQ ID NO: 13326 - RNA, 20 nt, Artificial Sequence
  targeting sequence with CTCN PAM
gagaauucgagguuaaguua

SEQ ID NO: 13327 - RNA, 20 nt, Artificial Sequence
  targeting sequence with CTCN PAM
acgauucuguggcucagaga

SEQ ID NO: 13328 - RNA, 20 nt, Artificial Sequence
  targeting sequence with CTCN PAM
augacugaaugaagggacaa

SEQ ID NO: 13329 - RNA, 20 nt, Artificial Sequence
  targeting sequence with CTCN PAM
gccaggguggugacaggcac

SEQ ID NO: 13330 - RNA, 20 nt, Artificial Sequence
  targeting sequence with CTCN PAM
agugccugcuguugggcuga

SEQ ID NO: 13331 - RNA, 20 nt, Artificial Sequence
  targeting sequence with CTCN PAM
gcccaacagcaggcacugga

SEQ ID NO: 13332 - RNA, 20 nt, Artificial Sequence
  targeting sequence with CTCN PAM
gaccagcaccacaggcucag

SEQ ID NO: 13333 - RNA, 20 nt, Artificial Sequence
  targeting sequence with CTCN PAM
gacacauggcugauguggag

SEQ ID NO: 13334 - RNA, 20 nt, Artificial Sequence
  targeting sequence with CTCN PAM
acaucagccaugugucugag

SEQ ID NO: 13335 - RNA, 20 nt, Artificial Sequence
  targeting sequence with CTCN PAM
cagucuggaucuggaaagca

SEQ ID NO: 13336 - RNA, 20 nt, Artificial Sequence
  targeting sequence with CTCN PAM
cacagucuggaucuggaaag

SEQ ID NO: 13337 - RNA, 20 nt, Artificial Sequence
  targeting sequence with CTCN PAM
cuucucugcccccaccccac

SEQ ID NO: 13338 - RNA, 20 nt, Artificial Sequence
  targeting sequence with CTCN PAM
gcccccaccccacaaccacu

SEQ ID NO: 13339 - RNA, 20 nt, Artificial Sequence
  targeting sequence with CTCN PAM
cuggugucaggggcuguaaa

SEQ ID NO: 13340 - RNA, 20 nt, Artificial Sequence
  targeting sequence with CTCN PAM
ggugucaggggcuguaaaga

SEQ ID NO: 13341 - RNA, 20 nt, Artificial Sequence
  targeting sequence with CTCN PAM
cugaccuggcuaauucuuua

SEQ ID NO: 13342 - RNA, 20 nt, Artificial Sequence
  targeting sequence with CTCN PAM
ggcuggcagaagcagcugau

SEQ ID NO: 13343 - RNA, 20 nt, Artificial Sequence
  targeting sequence with CTCN PAM
acccccacccuccagcucac

SEQ ID NO: 13344 - RNA, 20 nt, Artificial Sequence
  targeting sequence with CTCN PAM
agcucacuggcucccuguuc

SEQ ID NO: 13345 - RNA, 20 nt, Artificial Sequence
  targeting sequence with CTCN PAM
cuggcucccuguucccugca

SEQ ID NO: 13346 - RNA, 20 nt, Artificial Sequence
  targeting sequence with CTCN PAM
cuguucccugcagagaaauc

SEQ ID NO: 13347 - RNA, 20 nt, Artificial Sequence
  targeting sequence with CTCN PAM
gcagggaacagggagccagu

SEQ ID NO: 13348 - RNA, 20 nt, Artificial Sequence
  targeting sequence with CTCN PAM
gggauggauuucucugcagg

SEQ ID NO: 13349 - RNA, 20 nt, Artificial Sequence
  targeting sequence with CTCN PAM
cggggauggauuucucugca

SEQ ID NO: 13350 - RNA, 20 nt, Artificial Sequence
  targeting sequence with CTCN PAM
uaauccucucggggauggau

SEQ ID NO: 13351 - RNA, 20 nt, Artificial Sequence
  targeting sequence with CTCN PAM
cccgacucacccacccaccc

SEQ ID NO: 13352 - RNA, 20 nt, Artificial Sequence
  targeting sequence with CTCN PAM
cccacccacccaucaugguc

SEQ ID NO: 13353 - RNA, 20 nt, Artificial Sequence
  targeting sequence with CTCN PAM
aaaauggaccaugaugggug

SEQ ID NO: 13354 - RNA, 20 nt, Artificial Sequence
  targeting sequence with CTCN PAM
gugaaggcuuugcuuucacu

SEQ ID NO: 13355 - RNA, 20 nt, Artificial Sequence
  targeting sequence with CTCN PAM
cagugaaggcuuugcuuuca

SEQ ID NO: 13356 - RNA, 20 nt, Artificial Sequence
  targeting sequence with CTCN PAM
ucucagugaaggcuuugcuu

SEQ ID NO: 13357 - RNA, 20 nt, Artificial Sequence
  targeting sequence with CTCN PAM
cugaacagcuccauugguga

SEQ ID NO: 13358 - RNA, 20 nt, Artificial Sequence
  targeting sequence with CTCN PAM
gaacagcuccauuggugagg

SEQ ID NO: 13359 - RNA, 20 nt, Artificial Sequence
  targeting sequence with CTCN PAM
auuggugaggugaugagguc

SEQ ID NO: 13360 - RNA, 20 nt, Artificial Sequence
  targeting sequence with CTCN PAM
ccaauggagcuguucagaga

SEQ ID NO: 13361 - RNA, 20 nt, Artificial Sequence
  targeting sequence with CTCN PAM
ucaccucaccaauggagcug

SEQ ID NO: 13362 - RNA, 20 nt, Artificial Sequence
  targeting sequence with CTCN PAM
ugacugaccucaucaccuca

SEQ ID NO: 13363 - RNA, 20 nt, Artificial Sequence
  targeting sequence with CTCN PAM
gucccuagccccaccuuuuc

SEQ ID NO: 13364 - RNA, 20 nt, Artificial Sequence
  targeting sequence with CTCN PAM
agagaaauuuauuagauuuc

SEQ ID NO: 13365 - RNA, 20 nt, Artificial Sequence
  targeting sequence with CTCN PAM
ugagaagccaccauugccuc

SEQ ID NO: 13366 - RNA, 20 nt, Artificial Sequence
  targeting sequence with CTCN PAM
aaucuaugcugcuugggaaa

SEQ ID NO: 13367 - RNA, 20 nt, Artificial Sequence
  targeting sequence with CTCN PAM
gaccucgcugugcaucaggc

SEQ ID NO: 13368 - RNA, 20 nt, Artificial Sequence
  targeting sequence with CTCN PAM
cugugcaucaggcagacuuu

SEQ ID NO: 13369 - RNA, 20 nt, Artificial Sequence
  targeting sequence with CTCN PAM
ccauggcucauguccgguuc

SEQ ID NO: 13370 - RNA, 20 nt, Artificial Sequence
  targeting sequence with CTCN PAM
uguccgguucuccuggccug

SEQ ID NO: 13371 - RNA, 20 nt, Artificial Sequence
  targeting sequence with CTCN PAM
uggccugacaggugguucug

SEQ ID NO: 13372 - RNA, 20 nt, Artificial Sequence
  targeting sequence with CTCN PAM
ccuaagccccagaaccaccu

SEQ ID NO: 13373 - RNA, 20 nt, Artificial Sequence
  targeting sequence with CTCN PAM
uguagugcugcaaacagauu

SEQ ID NO: 13374 - RNA, 20 nt, Artificial Sequence
  targeting sequence with CTCN PAM
aaauaaaauguuuccgauuc

SEQ ID NO: 13375 - RNA, 20 nt, Artificial Sequence
  targeting sequence with CTCN PAM
ucgaaaacaaaaggcaauua

SEQ ID NO: 13376 - RNA, 20 nt, Artificial Sequence
  targeting sequence with CTCN PAM
cccaaaaaacuacccacaga

SEQ ID NO: 13377 - RNA, 20 nt, Artificial Sequence
  targeting sequence with CTCN PAM
cccccucugaguugucaggc

SEQ ID NO: 13378 - RNA, 20 nt, Artificial Sequence
  targeting sequence with CTCN PAM
cccucugaguugucaggcug

SEQ ID NO: 13379 - RNA, 20 nt, Artificial Sequence
  targeting sequence with CTCN PAM
gaguugucaggcuggcaaaa

SEQ ID NO: 13380 - RNA, 20 nt, Artificial Sequence
  targeting sequence with CTCN PAM
gagggggagagugccucccc

SEQ ID NO: 13381 - RNA, 20 nt, Artificial Sequence
  targeting sequence with CTCN PAM
uucccccaggccuuugcuuu

SEQ ID NO: 13382 - RNA, 20 nt, Artificial Sequence
  targeting sequence with CTCN PAM
cccaaagcaaaggccugggg

SEQ ID NO: 13383 - RNA, 20 nt, Artificial Sequence
  targeting sequence with CTCN PAM
ggaugcuucucacccaaagc

SEQ ID NO: 13384 - RNA, 20 nt, Artificial Sequence
  targeting sequence with CTCN PAM
guggcuagcagagaacgauc

SEQ ID NO: 13385 - RNA, 20 nt, Artificial Sequence
  targeting sequence with CTCN PAM
gcuagccacugagcauacgg

SEQ ID NO: 13386 - RNA, 20 nt, Artificial Sequence
  targeting sequence with CTCN PAM
aagcgaucguucucugcuag

SEQ ID NO: 13387 - RNA, 20 nt, Artificial Sequence
  targeting sequence with CTCN PAM
uucuagaaggugacagucug

SEQ ID NO: 13388 - RNA, 20 nt, Artificial Sequence
  targeting sequence with CTCN PAM
ugcuccuucuagaaggugac

SEQ ID NO: 13389 - RNA, 20 nt, Artificial Sequence
  targeting sequence with CTCN PAM
aaggccaauggucuuuccau

SEQ ID NO: 13390 - RNA, 20 nt, Artificial Sequence
  targeting sequence with CTCN PAM
ugggccacacucacuugcca

SEQ ID NO: 13391 - RNA, 20 nt, Artificial Sequence
  targeting sequence with CTCN PAM
cuugccacaggcccuuaaga

SEQ ID NO: 13392 - RNA, 20 nt, Artificial Sequence
  targeting sequence with CTCN PAM
uaagggccuguggcaaguga

SEQ ID NO: 13393 - RNA, 20 nt, Artificial Sequence
  targeting sequence with CTCN PAM
ucuccaagccucugugguua

SEQ ID NO: 13394 - RNA, 20 nt, Artificial Sequence
  targeting sequence with CTCN PAM
ccaagccucugugguuacug

SEQ ID NO: 13395 - RNA, 20 nt, Artificial Sequence
  targeting sequence with CTCN PAM
aagccucugugguuacugag

SEQ ID NO: 13396 - RNA, 20 nt, Artificial Sequence
  targeting sequence with CTCN PAM
gugguuacugagcaaagugc

SEQ ID NO: 13397 - RNA, 20 nt, Artificial Sequence
  targeting sequence with CTCN PAM
guaaccacagaggcuuggag

SEQ ID NO: 13398 - RNA, 20 nt, Artificial Sequence
  targeting sequence with CTCN PAM
caacagcccuaugguauagc

SEQ ID NO: 13399 - RNA, 20 nt, Artificial Sequence
  targeting sequence with CTCN PAM
ucugcaaaaugggaaucaua

SEQ ID NO: 13400 - RNA, 20 nt, Artificial Sequence
  targeting sequence with CTCN PAM
uuacccuucaguuuucucau

SEQ ID NO: 13401 - RNA, 20 nt, Artificial Sequence
  targeting sequence with CTCN PAM
cugccacuuccuagcuauga

SEQ ID NO: 13402 - RNA, 20 nt, Artificial Sequence
  targeting sequence with CTCN PAM
cauuaccucccugccacuuc

SEQ ID NO: 13403 - RNA, 20 nt, Artificial Sequence
  targeting sequence with CTCN PAM
ugguacccuggcucacauua

SEQ ID NO: 13404 - RNA, 20 nt, Artificial Sequence
  targeting sequence with CTCN PAM
cuuauuguccucaugguacc

SEQ ID NO: 13405 - RNA, 20 nt, Artificial Sequence
  targeting sequence with CTCN PAM
cacuguguggcaauccuccc

SEQ ID NO: 13406 - RNA, 20 nt, Artificial Sequence
  targeting sequence with CTCN PAM
acugagaauagaaacucagc

SEQ ID NO: 13407 - RNA, 20 nt, Artificial Sequence
  targeting sequence with CTCN PAM
guagagaccaugccucacac

SEQ ID NO: 13408 - RNA, 20 nt, Artificial Sequence
  targeting sequence with CTCN PAM
gcuucuauuucuggcucaga

SEQ ID NO: 13409 - RNA, 20 nt, Artificial Sequence
  targeting sequence with CTCN PAM
gauaaacgggugacuucugc

SEQ ID NO: 13410 - RNA, 20 nt, Artificial Sequence
  targeting sequence with CTCN PAM
ucaagaauucuguugguaaa

SEQ ID NO: 13411 - RNA, 20 nt, Artificial Sequence
  targeting sequence with CTCN PAM
agaauucuguugguaaaaug

SEQ ID NO: 13412 - RNA, 20 nt, Artificial Sequence
  targeting sequence with CTCN PAM
uauuucagaugcuguuguac

SEQ ID NO: 13413 - RNA, 20 nt, Artificial Sequence
  targeting sequence with CTCN PAM
cugugucaggcccuggcuga

SEQ ID NO: 13414 - RNA, 20 nt, Artificial Sequence
  targeting sequence with CTCN PAM
gugucaggcccuggcugagc

SEQ ID NO: 13415 - RNA, 20 nt, Artificial Sequence
  targeting sequence with CTCN PAM
gccagggccugacacagaga

SEQ ID NO: 13416 - RNA, 20 nt, Artificial Sequence
  targeting sequence with CTCN PAM
ucguccuugcacagcuguug

SEQ ID NO: 13417 - RNA, 20 nt, Artificial Sequence
  targeting sequence with CTCN PAM
gcugcugacuagauuuguga

SEQ ID NO: 13418 - RNA, 20 nt, Artificial Sequence
  targeting sequence with CTCN PAM
cugacuggggaaccugauuu

SEQ ID NO: 13419 - RNA, 20 nt, Artificial Sequence
  targeting sequence with CTCN PAM
gacuggggaaccugauuuuu

SEQ ID NO: 13420 - RNA, 20 nt, Artificial Sequence
  targeting sequence with CTCN PAM
cuggacacauugcagaacaa

SEQ ID NO: 13421 - RNA, 20 nt, Artificial Sequence
  targeting sequence with CTCN PAM
ggacacauugcagaacaaau

SEQ ID NO: 13422 - RNA, 20 nt, Artificial Sequence
  targeting sequence with CTCN PAM
cuguuggagccccucaaccg

SEQ ID NO: 13423 - RNA, 20 nt, Artificial Sequence
  targeting sequence with CTCN PAM
aacagggagacauuuguucu

SEQ ID NO: 13424 - RNA, 20 nt, Artificial Sequence
  targeting sequence with CTCN PAM
accgaaagcccucauugaag

SEQ ID NO: 13425 - RNA, 20 nt, Artificial Sequence
  targeting sequence with CTCN PAM
uugaagguuagcgcauucuc

SEQ ID NO: 13426 - RNA, 20 nt, Artificial Sequence
  targeting sequence with CTCN PAM
gcugcuucagcauuuccaga

SEQ ID NO: 13427 - RNA, 20 nt, Artificial Sequence
  targeting sequence with CTCN PAM
ggaaaugcugaagcagcaga

SEQ ID NO: 13428 - RNA, 20 nt, Artificial Sequence
  targeting sequence with CTCN PAM
gacaagagguuguagaugag

SEQ ID NO: 13429 - RNA, 20 nt, Artificial Sequence
  targeting sequence with CTCN PAM
ugucugaguaccaaguuacu

SEQ ID NO: 13430 - RNA, 20 nt, Artificial Sequence
  targeting sequence with CTCN PAM
ucuacaaccucuugucugag

SEQ ID NO: 13431 - RNA, 20 nt, Artificial Sequence
  targeting sequence with CTCN PAM
uucucugaaggcggaggauu

SEQ ID NO: 13432 - RNA, 20 nt, Artificial Sequence
  targeting sequence with CTCN PAM
gaaggcggaggauuaggauc

SEQ ID NO: 13433 - RNA, 20 nt, Artificial Sequence
  targeting sequence with CTCN PAM
gccuucagagaaggagaagg

SEQ ID NO: 13434 - RNA, 20 nt, Artificial Sequence
  targeting sequence with CTCN PAM
aaugauccuaauccuccgcc

SEQ ID NO: 13435 - RNA, 20 nt, Artificial Sequence
  targeting sequence with CTCN PAM
cauauggcaagugucauggc

SEQ ID NO: 13436 - RNA, 20 nt, Artificial Sequence
  targeting sequence with CTCN PAM
uauggcaagugucauggcua

SEQ ID NO: 13437 - RNA, 20 nt, Artificial Sequence
  targeting sequence with CTCN PAM
aggggcuggccacguaguag

SEQ ID NO: 13438 - RNA, 20 nt, Artificial Sequence
  targeting sequence with CTCN PAM
gaaaauaucuguuaaacagu

SEQ ID NO: 13439 - RNA, 20 nt, Artificial Sequence
  targeting sequence with CTCN PAM
aucguuccuauacuguuuaa

SEQ ID NO: 13440 - RNA, 20 nt, Artificial Sequence
  targeting sequence with CTCN PAM
caaucguuccuauacuguuu

SEQ ID NO: 13441 - RNA, 20 nt, Artificial Sequence
  targeting sequence with CTCN PAM
guuaucacaaccauuuguga

SEQ ID NO: 13442 - RNA, 20 nt, Artificial Sequence
  targeting sequence with CTCN PAM
guuugucuucaaaugacugc

SEQ ID NO: 13443 - RNA, 20 nt, Artificial Sequence
  targeting sequence with CTCN PAM
aguccucaguuugucuucaa

SEQ ID NO: 13444 - RNA, 20 nt, Artificial Sequence
  targeting sequence with CTCN PAM
auuuugcaaagcccauuuca

SEQ ID NO: 13445 - RNA, 20 nt, Artificial Sequence
  targeting sequence with CTCN PAM
uaaaaagggggauaauuuuc

SEQ ID NO: 13446 - RNA, 20 nt, Artificial Sequence
  targeting sequence with CTCN PAM
ccacagacuuaugaagaagg

SEQ ID NO: 13447 - RNA, 20 nt, Artificial Sequence
  targeting sequence with CTCN PAM
cuggauccucaccacagacu

SEQ ID NO: 13448 - RNA, 20 nt, Artificial Sequence
  targeting sequence with CTCN PAM
aagugcaguaaaguggcagg

SEQ ID NO: 13449 - RNA, 20 nt, Artificial Sequence
  targeting sequence with CTCN PAM
uaaggugauagaaacaggac

SEQ ID NO: 13450 - RNA, 20 nt, Artificial Sequence
  targeting sequence with CTCN PAM
uuccagggcaaaguuuugug

SEQ ID NO: 13451 - RNA, 20 nt, Artificial Sequence
  targeting sequence with CTCN PAM
cugaagaugagcaaguuuca

SEQ ID NO: 13452 - RNA, 20 nt, Artificial Sequence
  targeting sequence with CTCN PAM
ucuucagugagguucugccc

SEQ ID NO: 13453 - RNA, 20 nt, Artificial Sequence
  targeting sequence with CTCN PAM
uagacuuugcccuggaauuu

SEQ ID NO: 13454 - RNA, 20 nt, Artificial Sequence
  targeting sequence with CTCN PAM
aguuuuuccuuucugcaugc

SEQ ID NO: 13455 - RNA, 20 nt, Artificial Sequence
  targeting sequence with CTCN PAM
cuguacuuuuuccaggaugu

SEQ ID NO: 13456 - RNA, 20 nt, Artificial Sequence
  targeting sequence with CTCN PAM
aaauaaccaaggcuacaucc

SEQ ID NO: 13457 - RNA, 20 nt, Artificial Sequence
  targeting sequence with CTCN PAM
aaugaguguccuacuuccaa

SEQ ID NO: 13458 - RNA, 20 nt, Artificial Sequence
  targeting sequence with CTCN PAM
uuggagcaucugcagugcuu

SEQ ID NO: 13459 - RNA, 20 nt, Artificial Sequence
  targeting sequence with CTCN PAM
guggggcuugcacagggcug

SEQ ID NO: 13460 - RNA, 20 nt, Artificial Sequence
  targeting sequence with CTCN PAM
cuccaccacuccuacagcgu

SEQ ID NO: 13461 - RNA, 20 nt, Artificial Sequence
  targeting sequence with CTCN PAM
accacuccuacagcguucca

SEQ ID NO: 13462 - RNA, 20 nt, Artificial Sequence
  targeting sequence with CTCN PAM
uacagcguuccacaaggcug

SEQ ID NO: 13463 - RNA, 20 nt, Artificial Sequence
  targeting sequence with CTCN PAM
gucgcccagccuuguggaac

SEQ ID NO: 13464 - RNA, 20 nt, Artificial Sequence
  targeting sequence with CTCN PAM
cugucgcccagccuugugga

SEQ ID NO: 13465 - RNA, 20 nt, Artificial Sequence
  targeting sequence with CTCN PAM
agcaccuggaccgcuucucu

SEQ ID NO: 13466 - RNA, 20 nt, Artificial Sequence
  targeting sequence with CTCN PAM
caaacaaugccguggcggag

SEQ ID NO: 13467 - RNA, 20 nt, Artificial Sequence
  targeting sequence with CTCN PAM
gccacggcauuguuugugag

SEQ ID NO: 13468 - RNA, 20 nt, Artificial Sequence
  targeting sequence with CTCN PAM
ccgccacggcauuguuugug

SEQ ID NO: 13469 - RNA, 20 nt, Artificial Sequence
  targeting sequence with CTCN PAM
auauagcucaagguguguaa

SEQ ID NO: 13470 - RNA, 20 nt, Artificial Sequence
  targeting sequence with CTCN PAM
agguguguaaacaucagcca

SEQ ID NO: 13471 - RNA, 20 nt, Artificial Sequence
  targeting sequence with CTCN PAM
gacaccaagauaaacaucag

SEQ ID NO: 13472 - RNA, 20 nt, Artificial Sequence
  targeting sequence with CTCN PAM
ucugauguuuaucuuggugu

SEQ ID NO: 13473 - RNA, 20 nt, Artificial Sequence
  targeting sequence with CTCN PAM
uaccauucugaugggcaaac

SEQ ID NO: 13474 - RNA, 20 nt, Artificial Sequence
  targeting sequence with CTCN PAM
gaauuagcaaugcagggcug

SEQ ID NO: 13475 - RNA, 20 nt, Artificial Sequence
  targeting sequence with CTCN PAM
ccccugcuaccugggagccc

SEQ ID NO: 13476 - RNA, 20 nt, Artificial Sequence
  targeting sequence with CTCN PAM
ccugcuaccugggagcccau

SEQ ID NO: 13477 - RNA, 20 nt, Artificial Sequence
  targeting sequence with CTCN PAM
cagguagcaggggagagaua

SEQ ID NO: 13478 - RNA, 20 nt, Artificial Sequence
  targeting sequence with CTCN PAM
cccagguccagcuaugggcu

SEQ ID NO: 13479 - RNA, 20 nt, Artificial Sequence
  targeting sequence with CTCN PAM
uuuaauuaaaaaaauuuaaa

SEQ ID NO: 13480 - RNA, 20 nt, Artificial Sequence
  targeting sequence with CTCN PAM
uucaucuucucauuuaauua

SEQ ID NO: 13481 - RNA, 20 nt, Artificial Sequence
  targeting sequence with CTCN PAM
cguucaucuucucauuuaau

SEQ ID NO: 13482 - RNA, 20 nt, Artificial Sequence
  targeting sequence with CTCN PAM
agauucuuacucaucccagc

SEQ ID NO: 13483 - RNA, 20 nt, Artificial Sequence
  targeting sequence with CTCN PAM
ucccagccaggaaaacaguu

SEQ ID NO: 13484 - RNA, 20 nt, Artificial Sequence
  targeting sequence with CTCN PAM
uucaguacaucaugggaagu

SEQ ID NO: 13485 - RNA, 20 nt, Artificial Sequence
  targeting sequence with CTCN PAM
uccacuuccacuacuccuuc

SEQ ID NO: 13486 - RNA, 20 nt, Artificial Sequence
  targeting sequence with CTCN PAM
uugucucuuccacuuccacu

SEQ ID NO: 13487 - RNA, 20 nt, Artificial Sequence
  targeting sequence with CTCN PAM
acuggacaaggccacaugca

SEQ ID NO: 13488 - RNA, 20 nt, Artificial Sequence
  targeting sequence with CTCN PAM
ggaaggauugugacuugcua

SEQ ID NO: 13489 - RNA, 20 nt, Artificial Sequence
  targeting sequence with CTCN PAM
gcaugcccaucuguccugug

SEQ ID NO: 13490 - RNA, 20 nt, Artificial Sequence
  targeting sequence with CTCN PAM
cacaggacagaugggcaugc

SEQ ID NO: 13491 - RNA, 20 nt, Artificial Sequence
  targeting sequence with CTCN PAM
cagcaaccaaagggaccagg

SEQ ID NO: 13492 - RNA, 20 nt, Artificial Sequence
  targeting sequence with CTCN PAM
cagagucaugcuuacaguuu

SEQ ID NO: 13493 - RNA, 20 nt, Artificial Sequence
  targeting sequence with CTCN PAM
gugaggcucccagcaaccaa

SEQ ID NO: 13494 - RNA, 20 nt, Artificial Sequence
  targeting sequence with CTCN PAM
uaucagaagcauaaggcacu

SEQ ID NO: 13495 - RNA, 20 nt, Artificial Sequence
  targeting sequence with CTCN PAM
gcugcuccuaucagaagcau

SEQ ID NO: 13496 - RNA, 20 nt, Artificial Sequence
  targeting sequence with CTCN PAM
ucccucugcugcuccuauca

SEQ ID NO: 13497 - RNA, 20 nt, Artificial Sequence
  targeting sequence with CTCN PAM
ucuuaugccucuucccucug

SEQ ID NO: 13498 - RNA, 20 nt, Artificial Sequence
  targeting sequence with CTCN PAM
uccgacacaucuugggucuu

SEQ ID NO: 13499 - RNA, 20 nt, Artificial Sequence
  targeting sequence with CTCN PAM
cccaggggaauaaucuggga

SEQ ID NO: 13500 - RNA, 20 nt, Artificial Sequence
  targeting sequence with CTCN PAM
cagauuauuccccuggggga

SEQ ID NO: 13501 - RNA, 20 nt, Artificial Sequence
  targeting sequence with CTCN PAM
cugcacccucccagauuauu

SEQ ID NO: 13502 - RNA, 20 nt, Artificial Sequence
  targeting sequence with CTCN PAM
cacugcacccucccagauua

SEQ ID NO: 13503 - RNA, 20 nt, Artificial Sequence
  targeting sequence with CTCN PAM
aacucccuggccuuaugccc

SEQ ID NO: 13504 - RNA, 20 nt, Artificial Sequence
  targeting sequence with CTCN PAM
cuggccuuaugcccugucca

SEQ ID NO: 13505 - RNA, 20 nt, Artificial Sequence
  targeting sequence with CTCN PAM
aggauggugaauucuuaggu

SEQ ID NO: 13506 - RNA, 20 nt, Artificial Sequence
  targeting sequence with CTCN PAM
uaagcagaguggcuuucccc

SEQ ID NO: 13507 - RNA, 20 nt, Artificial Sequence
  targeting sequence with CTCN PAM
gcuuaggaguagggccacuc

SEQ ID NO: 13508 - RNA, 20 nt, Artificial Sequence
  targeting sequence with CTCN PAM
cuacacuuugucccucaccc

SEQ ID NO: 13509 - RNA, 20 nt, Artificial Sequence
  targeting sequence with CTCN PAM
cccuggcacagacacugugu

SEQ ID NO: 13510 - RNA, 20 nt, Artificial Sequence
  targeting sequence with CTCN PAM
caccacacagugucugugcc

SEQ ID NO: 13511 - RNA, 20 nt, Artificial Sequence
  targeting sequence with CTCN PAM
uccuggggccaguuggcagc

SEQ ID NO: 13512 - RNA, 20 nt, Artificial Sequence
  targeting sequence with CTCN PAM
uggggccaguuggcagccac

SEQ ID NO: 13513 - RNA, 20 nt, Artificial Sequence
  targeting sequence with CTCN PAM
cacccgcugcacacagcaga

SEQ ID NO: 13514 - RNA, 20 nt, Artificial Sequence
  targeting sequence with CTCN PAM
gccaaacgcuggaaguggua

SEQ ID NO: 13515 - RNA, 20 nt, Artificial Sequence
  targeting sequence with CTCN PAM
ggugcuggugacccagccac

SEQ ID NO: 13516 - RNA, 20 nt, Artificial Sequence
  targeting sequence with CTCN PAM
ugagcuaggggucccgggca

SEQ ID NO: 13517 - RNA, 20 nt, Artificial Sequence
  targeting sequence with CTCN PAM
ggagaugguacccucaggug

SEQ ID NO: 13518 - RNA, 20 nt, Artificial Sequence
  targeting sequence with CTCN PAM
uuagauaugcccgggacccc

SEQ ID NO: 13519 - RNA, 20 nt, Artificial Sequence
  targeting sequence with CTCN PAM
gcaguucacugugaccagug

SEQ ID NO: 13520 - RNA, 20 nt, Artificial Sequence
  targeting sequence with CTCN PAM
ucugggaagaaaaaguuuga

SEQ ID NO: 13521 - RNA, 20 nt, Artificial Sequence
  targeting sequence with CTCN PAM
gggaagaaaaaguuugaguu

SEQ ID NO: 13522 - RNA, 20 nt, Artificial Sequence
  targeting sequence with CTCN PAM
aacuuuuucuucccagagga

SEQ ID NO: 13523 - RNA, 20 nt, Artificial Sequence
  targeting sequence with CTCN PAM
ugaauugugauccagagcug

SEQ ID NO: 13524 - RNA, 20 nt, Artificial Sequence
  targeting sequence with CTCN PAM
ggaucacaauucaggagccc

SEQ ID NO: 13525 - RNA, 20 nt, Artificial Sequence
  targeting sequence with CTCN PAM
gugcaggcuuugaugacuca

SEQ ID NO: 13526 - RNA, 20 nt, Artificial Sequence
  targeting sequence with CTCN PAM
gggaaacucugcauuaacca

SEQ ID NO: 13527 - RNA, 20 nt, Artificial Sequence
  targeting sequence with CTCN PAM
gcauuaaccagcaagagggg

SEQ ID NO: 13528 - RNA, 20 nt, Artificial Sequence
  targeting sequence with CTCN PAM
ugcugguuaaugcagaguuu

SEQ ID NO: 13529 - RNA, 20 nt, Artificial Sequence
  targeting sequence with CTCN PAM
caccccucuugcugguuaau

SEQ ID NO: 13530 - RNA, 20 nt, Artificial Sequence
  targeting sequence with CTCN PAM
uggaacucccaccccucuug

SEQ ID NO: 13531 - RNA, 20 nt, Artificial Sequence
  targeting sequence with CTCN PAM
ccuucaguagggcgaaggcc

SEQ ID NO: 13532 - RNA, 20 nt, Artificial Sequence
  targeting sequence with CTCN PAM
uucaguagggcgaaggccca

SEQ ID NO: 13533 - RNA, 20 nt, Artificial Sequence
  targeting sequence with CTCN PAM
agaucccucccuggcccugu

SEQ ID NO: 13534 - RNA, 20 nt, Artificial Sequence
  targeting sequence with CTCN PAM
agccuuugguuaaucugggc

SEQ ID NO: 13535 - RNA, 20 nt, Artificial Sequence
  targeting sequence with CTCN PAM
cuggcccugucagugauuug

SEQ ID NO: 13536 - RNA, 20 nt, Artificial Sequence
  targeting sequence with CTCN PAM
cugucccucaguuuccuucu

SEQ ID NO: 13537 - RNA, 20 nt, Artificial Sequence
  targeting sequence with CTCN PAM
gucccucaguuuccuucucu

SEQ ID NO: 13538 - RNA, 20 nt, Artificial Sequence
  targeting sequence with CTCN PAM
guuuccuucucugugaaacu

SEQ ID NO: 13539 - RNA, 20 nt, Artificial Sequence
  targeting sequence with CTCN PAM
gugaaacuagaguguuggcu

SEQ ID NO: 13540 - RNA, 20 nt, Artificial Sequence
  targeting sequence with CTCN PAM
aguuucacagagaaggaaac

SEQ ID NO: 13541 - RNA, 20 nt, Artificial Sequence
  targeting sequence with CTCN PAM
agaaacccaaguaguucuuu

SEQ ID NO: 13542 - RNA, 20 nt, Artificial Sequence
  targeting sequence with CTCN PAM
uuggcaaaaauguguugauc

SEQ ID NO: 13543 - RNA, 20 nt, Artificial Sequence
  targeting sequence with CTCN PAM
uggaaagcauuuucugcauc

SEQ ID NO: 13544 - RNA, 20 nt, Artificial Sequence
  targeting sequence with CTCN PAM
acaacuuuuugcagggaaaa

SEQ ID NO: 13545 - RNA, 20 nt, Artificial Sequence
  targeting sequence with CTCN PAM
ugcuaaccaacuaccacuuc

SEQ ID NO: 13546 - RNA, 20 nt, Artificial Sequence
  targeting sequence with CTCN PAM
ucgcaauauucaccugaccu

SEQ ID NO: 13547 - RNA, 20 nt, Artificial Sequence
  targeting sequence with CTCN PAM
acccaccugacugcacauca

SEQ ID NO: 13548 - RNA, 20 nt, Artificial Sequence
  targeting sequence with CTCN PAM
ucgauuugcugagcauacuu

SEQ ID NO: 13549 - RNA, 20 nt, Artificial Sequence
  targeting sequence with CTCN PAM
auuugcugagcauacuucuc

SEQ ID NO: 13550 - RNA, 20 nt, Artificial Sequence
  targeting sequence with CTCN PAM
gcaaaucgaggagaugcacc

SEQ ID NO: 13551 - RNA, 20 nt, Artificial Sequence
  targeting sequence with CTCN PAM
aauguaaucauuucaccagg

SEQ ID NO: 13552 - RNA, 20 nt, Artificial Sequence
  targeting sequence with CTCN PAM
aaagcaguucccaaagccaa

SEQ ID NO: 13553 - RNA, 20 nt, Artificial Sequence
  targeting sequence with CTCN PAM
guccagccguggagcugguc

SEQ ID NO: 13554 - RNA, 20 nt, Artificial Sequence
  targeting sequence with CTCN PAM
acggcuggacugagaaaaag

SEQ ID NO: 13555 - RNA, 20 nt, Artificial Sequence
  targeting sequence with CTCN PAM
caucugauugagaaauguuu

SEQ ID NO: 13556 - RNA, 20 nt, Artificial Sequence
  targeting sequence with CTCN PAM
aucagaugugaggugugaca

SEQ ID NO: 13557 - RNA, 20 nt, Artificial Sequence
  targeting sequence with CTCN PAM
ugaggcacccacuuaucaag

SEQ ID NO: 13558 - RNA, 20 nt, Artificial Sequence
  targeting sequence with CTCN PAM
ugagcugauagaaaaugaaa

SEQ ID NO: 13559 - RNA, 20 nt, Artificial Sequence
  targeting sequence with CTCN PAM
augucaaccauucuacgguu

SEQ ID NO: 13560 - RNA, 20 nt, Artificial Sequence
  targeting sequence with CTCN PAM
uguaguugugagaggaucag

SEQ ID NO: 13561 - RNA, 20 nt, Artificial Sequence
  targeting sequence with CTCN PAM
caacuacaggagaaguugcc

SEQ ID NO: 13562 - RNA, 20 nt, Artificial Sequence
  targeting sequence with CTCN PAM
cacaacuacaggagaaguug

SEQ ID NO: 13563 - RNA, 20 nt, Artificial Sequence
  targeting sequence with CTCN PAM
cgguuguugucaacuuccag

SEQ ID NO: 13564 - RNA, 20 nt, Artificial Sequence
  targeting sequence with CTCN PAM
guuguugucaacuuccagug

SEQ ID NO: 13565 - RNA, 20 nt, Artificial Sequence
  targeting sequence with CTCN PAM
ucaucuucaagccucucauc

SEQ ID NO: 13566 - RNA, 20 nt, Artificial Sequence
  targeting sequence with CTCN PAM
ucuucaagccucucaucucc

SEQ ID NO: 13567 - RNA, 20 nt, Artificial Sequence
  targeting sequence with CTCN PAM
caucuccuuugcaaaacuuc

SEQ ID NO: 13568 - RNA, 20 nt, Artificial Sequence
  targeting sequence with CTCN PAM
ucuccuuugcaaaacuucuu

SEQ ID NO: 13569 - RNA, 20 nt, Artificial Sequence
  targeting sequence with CTCN PAM
uuugcaaaacuucuugaacc

SEQ ID NO: 13570 - RNA, 20 nt, Artificial Sequence
  targeting sequence with CTCN PAM
uaacaucgacaacgcauuug

SEQ ID NO: 13571 - RNA, 20 nt, Artificial Sequence
  targeting sequence with CTCN PAM
guugcuuuaugacccauuuu

SEQ ID NO: 13572 - RNA, 20 nt, Artificial Sequence
  targeting sequence with CTCN PAM
aauaagaaaacugcuugaau

SEQ ID NO: 13573 - RNA, 20 nt, Artificial Sequence
  targeting sequence with CTCN PAM
uuagcaaaaaaacauaaagc

SEQ ID NO: 13574 - RNA, 20 nt, Artificial Sequence
  targeting sequence with CTCN PAM
cuuuauguuuuuuugcuaau

SEQ ID NO: 13575 - RNA, 20 nt, Artificial Sequence
  targeting sequence with CTCN PAM
ggaauuugcuguuugauagu

SEQ ID NO: 13576 - RNA, 20 nt, Artificial Sequence
  targeting sequence with CTCN PAM
cauauuggcucuggaauuug

SEQ ID NO: 13577 - RNA, 20 nt, Artificial Sequence
  targeting sequence with CTCN PAM
guagucuggcacuggagccu

SEQ ID NO: 13578 - RNA, 20 nt, Artificial Sequence
  targeting sequence with CTCN PAM
agugccagacuacugagacu

SEQ ID NO: 13579 - RNA, 20 nt, Artificial Sequence
  targeting sequence with CTCN PAM
cugucuccuuuuagagaaag

SEQ ID NO: 13580 - RNA, 20 nt, Artificial Sequence
  targeting sequence with CTCN PAM
uuuuagagaaagcaggcuag

SEQ ID NO: 13581 - RNA, 20 nt, Artificial Sequence
  targeting sequence with CTCN PAM
aaaaggagacagggagggaa

SEQ ID NO: 13582 - RNA, 20 nt, Artificial Sequence
  targeting sequence with CTCN PAM
agaguccucacacacaaaug

SEQ ID NO: 13583 - RNA, 20 nt, Artificial Sequence
  targeting sequence with CTCN PAM
aguuuacccacuaaaccaac

SEQ ID NO: 13584 - RNA, 20 nt, Artificial Sequence
  targeting sequence with CTCN PAM
cgaguuuacccacuaaacca

SEQ ID NO: 13585 - RNA, 20 nt, Artificial Sequence
  targeting sequence with CTCN PAM
cacacaaaugacacuguguu

SEQ ID NO: 13586 - RNA, 20 nt, Artificial Sequence
  targeting sequence with CTCN PAM
ggccuucagcuucuuucucu

SEQ ID NO: 13587 - RNA, 20 nt, Artificial Sequence
  targeting sequence with CTCN PAM
auaaaauagggauaacagca

SEQ ID NO: 13588 - RNA, 20 nt, Artificial Sequence
  targeting sequence with CTCN PAM
aaacaaucccaucaaguaca

SEQ ID NO: 13589 - RNA, 20 nt, Artificial Sequence
  targeting sequence with CTCN PAM
ucuaauccucaaaacaaucc

SEQ ID NO: 13590 - RNA, 20 nt, Artificial Sequence
  targeting sequence with CTCN PAM
uccaauauuaacucgucuaa

SEQ ID NO: 13591 - RNA, 20 nt, Artificial Sequence
  targeting sequence with CTCN PAM
gugcuagguacucuuccaau

SEQ ID NO: 13592 - RNA, 20 nt, Artificial Sequence
  targeting sequence with CTCN PAM
aggcaaggcuucacgccagc

SEQ ID NO: 13593 - RNA, 20 nt, Artificial Sequence
  targeting sequence with CTCN PAM
cuccagcugggcaucuagca

SEQ ID NO: 13594 - RNA, 20 nt, Artificial Sequence
  targeting sequence with CTCN PAM
agcugggcaucuagcauuuc

SEQ ID NO: 13595 - RNA, 20 nt, Artificial Sequence
  targeting sequence with CTCN PAM
uuuuucagagaugaggucuc

SEQ ID NO: 13596 - RNA, 20 nt, Artificial Sequence
  targeting sequence with CTCN PAM
gaaaaaagagaaaugcuaga

SEQ ID NO: 13597 - RNA, 20 nt, Artificial Sequence
  targeting sequence with CTCN PAM
ucucugaaaaaagagaaaug

SEQ ID NO: 13598 - RNA, 20 nt, Artificial Sequence
  targeting sequence with CTCN PAM
gucgcccaagguggagugca

SEQ ID NO: 13599 - RNA, 20 nt, Artificial Sequence
  targeting sequence with CTCN PAM
accuugggcgacagagaccu

SEQ ID NO: 13600 - RNA, 20 nt, Artificial Sequence
  targeting sequence with CTCN PAM
uggcagccucaaacugcugg

SEQ ID NO: 13601 - RNA, 20 nt, Artificial Sequence
  targeting sequence with CTCN PAM
aacugcuggacucaagugau

SEQ ID NO: 13602 - RNA, 20 nt, Artificial Sequence
  targeting sequence with CTCN PAM
agugauccuccugccugagc

SEQ ID NO: 13603 - RNA, 20 nt, Artificial Sequence
  targeting sequence with CTCN PAM
ugccugagccucccagagca

SEQ ID NO: 13604 - RNA, 20 nt, Artificial Sequence
  targeting sequence with CTCN PAM
ggcaggaggaucacuugagu

SEQ ID NO: 13605 - RNA, 20 nt, Artificial Sequence
  targeting sequence with CTCN PAM
cagagcacugggauuacagg

SEQ ID NO: 13606 - RNA, 20 nt, Artificial Sequence
  targeting sequence with CTCN PAM
gggaggcucaggcaggagga

SEQ ID NO: 13607 - RNA, 20 nt, Artificial Sequence
  targeting sequence with CTCN PAM
ugccuguaaucccagugcuc

SEQ ID NO: 13608 - RNA, 20 nt, Artificial Sequence
  targeting sequence with CTCN PAM
caaaugcccugccuuccacc

SEQ ID NO: 13609 - RNA, 20 nt, Artificial Sequence
  targeting sequence with CTCN PAM
aaugcccugccuuccaccuu

SEQ ID NO: 13610 - RNA, 20 nt, Artificial Sequence
  targeting sequence with CTCN PAM
aaucugugcugacuucucag

SEQ ID NO: 13611 - RNA, 20 nt, Artificial Sequence
  targeting sequence with CTCN PAM
gcacauuuuuugccucuugg

SEQ ID NO: 13612 - RNA, 20 nt, Artificial Sequence
  targeting sequence with CTCN PAM
ugggaaagucuggcaagaag

SEQ ID NO: 13613 - RNA, 20 nt, Artificial Sequence
  targeting sequence with CTCN PAM
ugacaggcucugugcaugcc

SEQ ID NO: 13614 - RNA, 20 nt, Artificial Sequence
  targeting sequence with CTCN PAM
gugcaugccgucagucuagu

SEQ ID NO: 13615 - RNA, 20 nt, Artificial Sequence
  targeting sequence with CTCN PAM
ucccacagcagggucagugg

SEQ ID NO: 13616 - RNA, 20 nt, Artificial Sequence
  targeting sequence with CTCN PAM
agggaccucaucuucccuua

SEQ ID NO: 13617 - RNA, 20 nt, Artificial Sequence
  targeting sequence with CTCN PAM
ucuucccuuacagucuuugg

SEQ ID NO: 13618 - RNA, 20 nt, Artificial Sequence
  targeting sequence with CTCN PAM
uuucaggaaagccaaagacu

SEQ ID NO: 13619 - RNA, 20 nt, Artificial Sequence
  targeting sequence with CTCN PAM
gggucccucaucuuuaucag

SEQ ID NO: 13620 - RNA, 20 nt, Artificial Sequence
  targeting sequence with CTCN PAM
ucuuuaucaggugcucaccu

SEQ ID NO: 13621 - RNA, 20 nt, Artificial Sequence
  targeting sequence with CTCN PAM
ccuggagagaaaccaccaca

SEQ ID NO: 13622 - RNA, 20 nt, Artificial Sequence
  targeting sequence with CTCN PAM
aggugagcaccugauaaaga

SEQ ID NO: 13623 - RNA, 20 nt, Artificial Sequence
  targeting sequence with CTCN PAM
ccaggugagcaccugauaaa

SEQ ID NO: 13624 - RNA, 20 nt, Artificial Sequence
  targeting sequence with CTCN PAM
uuuuguggugguuucucucc

SEQ ID NO: 13625 - RNA, 20 nt, Artificial Sequence
  targeting sequence with CTCN PAM
acuuaggcuggaagucaggg

SEQ ID NO: 13626 - RNA, 20 nt, Artificial Sequence
  targeting sequence with CTCN PAM
gccucacuuugcccaagcca

SEQ ID NO: 13627 - RNA, 20 nt, Artificial Sequence
  targeting sequence with CTCN PAM
cuuugcccaagccacuccag

SEQ ID NO: 13628 - RNA, 20 nt, Artificial Sequence
  targeting sequence with CTCN PAM
agagccuggcucucagcucc

SEQ ID NO: 13629 - RNA, 20 nt, Artificial Sequence
  targeting sequence with CTCN PAM
ggaguggcuugggcaaagug

SEQ ID NO: 13630 - RNA, 20 nt, Artificial Sequence
  targeting sequence with CTCN PAM
cagcuccuucccucagacuu

SEQ ID NO: 13631 - RNA, 20 nt, Artificial Sequence
  targeting sequence with CTCN PAM
gcuccuucccucagacuuuu

SEQ ID NO: 13632 - RNA, 20 nt, Artificial Sequence
  targeting sequence with CTCN PAM
uucccucagacuuuucucuc

SEQ ID NO: 13633 - RNA, 20 nt, Artificial Sequence
  targeting sequence with CTCN PAM
gacuuuucucucgcugcucc

SEQ ID NO: 13634 - RNA, 20 nt, Artificial Sequence
  targeting sequence with CTCN PAM
cgcugcucccuguccucuuc

SEQ ID NO: 13635 - RNA, 20 nt, Artificial Sequence
  targeting sequence with CTCN PAM
cugcucccuguccucuuccu

SEQ ID NO: 13636 - RNA, 20 nt, Artificial Sequence
  targeting sequence with CTCN PAM
cuguccucuuccucaccugg

SEQ ID NO: 13637 - RNA, 20 nt, Artificial Sequence
  targeting sequence with CTCN PAM
uccucaccuggggcaugggg

SEQ ID NO: 13638 - RNA, 20 nt, Artificial Sequence
  targeting sequence with CTCN PAM
ccuggggcauggggcugagg

SEQ ID NO: 13639 - RNA, 20 nt, Artificial Sequence
  targeting sequence with CTCN PAM
gccccaugccccaggugagg

SEQ ID NO: 13640 - RNA, 20 nt, Artificial Sequence
  targeting sequence with CTCN PAM
ugucucuaacagcugagcuc

SEQ ID NO: 13641 - RNA, 20 nt, Artificial Sequence
  targeting sequence with CTCN PAM
aacagcugagcucugcucca

SEQ ID NO: 13642 - RNA, 20 nt, Artificial Sequence
  targeting sequence with CTCN PAM
gcuguuagagacaggagccc

SEQ ID NO: 13643 - RNA, 20 nt, Artificial Sequence
  targeting sequence with CTCN PAM
gcuccaggaccuacauggga

SEQ ID NO: 13644 - RNA, 20 nt, Artificial Sequence
  targeting sequence with CTCN PAM
aggaccuacaugggacuagg

SEQ ID NO: 13645 - RNA, 20 nt, Artificial Sequence
  targeting sequence with CTCN PAM
uagucccauguagguccugg

SEQ ID NO: 13646 - RNA, 20 nt, Artificial Sequence
  targeting sequence with CTCN PAM
gaccagcuggggcccuggcu

SEQ ID NO: 13647 - RNA, 20 nt, Artificial Sequence
  targeting sequence with CTCN PAM
uaucccagcugaaucuuauu

SEQ ID NO: 13648 - RNA, 20 nt, Artificial Sequence
  targeting sequence with CTCN PAM
ucacagggucugucacguag

SEQ ID NO: 13649 - RNA, 20 nt, Artificial Sequence
  targeting sequence with CTCN PAM
ggggaaacguuuagaggccu

SEQ ID NO: 13650 - RNA, 20 nt, Artificial Sequence
  targeting sequence with CTCN PAM
aaacguuuccccugagggau

SEQ ID NO: 13651 - RNA, 20 nt, Artificial Sequence
  targeting sequence with CTCN PAM
ucacaggccucuaaacguuu

SEQ ID NO: 13652 - RNA, 20 nt, Artificial Sequence
  targeting sequence with CTCN PAM
aggaagucucuucacaggcc

SEQ ID NO: 13653 - RNA, 20 nt, Artificial Sequence
  targeting sequence with CTCN PAM
uccaggaagucucuucacag

SEQ ID NO: 13654 - RNA, 20 nt, Artificial Sequence
  targeting sequence with CTCN PAM
cagccagaaggagggagaga

SEQ ID NO: 13655 - RNA, 20 nt, Artificial Sequence
  targeting sequence with CTCN PAM
gccagaaggagggagagaau

SEQ ID NO: 13656 - RNA, 20 nt, Artificial Sequence
  targeting sequence with CTCN PAM
uucuggcugagaggacaccu

SEQ ID NO: 13657 - RNA, 20 nt, Artificial Sequence
  targeting sequence with CTCN PAM
cuccuucuggcugagaggac

SEQ ID NO: 13658 - RNA, 20 nt, Artificial Sequence
  targeting sequence with CTCN PAM
cccuccuucuggcugagagg

SEQ ID NO: 13659 - RNA, 20 nt, Artificial Sequence
  targeting sequence with CTCN PAM
acuucacuugccccauuuuu

SEQ ID NO: 13660 - RNA, 20 nt, Artificial Sequence
  targeting sequence with CTCN PAM
uccacuucacuugccccauu

SEQ ID NO: 13661 - RNA, 20 nt, Artificial Sequence
  targeting sequence with CTCN PAM
aggccuuugcacaggcugug

SEQ ID NO: 13662 - RNA, 20 nt, Artificial Sequence
  targeting sequence with CTCN PAM
ccuccaggccuuugcacagg

SEQ ID NO: 13663 - RNA, 20 nt, Artificial Sequence
  targeting sequence with CTCN PAM
gcugggcccuggaugcugaa

SEQ ID NO: 13664 - RNA, 20 nt, Artificial Sequence
  targeting sequence with CTCN PAM
gggaaagaugccauguaucc

SEQ ID NO: 13665 - RNA, 20 nt, Artificial Sequence
  targeting sequence with CTCN PAM
ccugcuaccuauucucucug

SEQ ID NO: 13666 - RNA, 20 nt, Artificial Sequence
  targeting sequence with CTCN PAM
cugggacguuacuuagcuuc

SEQ ID NO: 13667 - RNA, 20 nt, Artificial Sequence
  targeting sequence with CTCN PAM
gggacguuacuuagcuuccc

SEQ ID NO: 13668 - RNA, 20 nt, Artificial Sequence
  targeting sequence with CTCN PAM
gccugugguucuacugcacu

SEQ ID NO: 13669 - RNA, 20 nt, Artificial Sequence
  targeting sequence with CTCN PAM
gguuuucuuggguucuugga

SEQ ID NO: 13670 - RNA, 20 nt, Artificial Sequence
  targeting sequence with CTCN PAM
aagaacccaagaaaaccuga

SEQ ID NO: 13671 - RNA, 20 nt, Artificial Sequence
  targeting sequence with CTCN PAM
gaacugaagaaguguagagc

SEQ ID NO: 13672 - RNA, 20 nt, Artificial Sequence
  targeting sequence with CTCN PAM
acacuucuucaguucagagc

SEQ ID NO: 13673 - RNA, 20 nt, Artificial Sequence
  targeting sequence with CTCN PAM
cuuugcucuacacuucuuca

SEQ ID NO: 13674 - RNA, 20 nt, Artificial Sequence
  targeting sequence with CTCN PAM
ggaguucagaccaauuaggg

SEQ ID NO: 13675 - RNA, 20 nt, Artificial Sequence
  targeting sequence with CTCN PAM
ugaggacucacuuugcucua

SEQ ID NO: 13676 - RNA, 20 nt, Artificial Sequence
  targeting sequence with CTCN PAM
gugaugaguagggccucaca

SEQ ID NO: 13677 - RNA, 20 nt, Artificial Sequence
  targeting sequence with CTCN PAM
ucacugagccaccaaagcuu

SEQ ID NO: 13678 - RNA, 20 nt, Artificial Sequence
  targeting sequence with CTCN PAM
caagacccuucuuaagugcu

SEQ ID NO: 13679 - RNA, 20 nt, Artificial Sequence
  targeting sequence with CTCN PAM
caagaaagaggaguuacugg

SEQ ID NO: 13680 - RNA, 20 nt, Artificial Sequence
  targeting sequence with CTCN PAM
uucuugugagcacuuaagaa

SEQ ID NO: 13681 - RNA, 20 nt, Artificial Sequence
  targeting sequence with CTCN PAM
ucuuucuugugagcacuuaa

SEQ ID NO: 13682 - RNA, 20 nt, Artificial Sequence
  targeting sequence with CTCN PAM
ccaucuaaagcuuuauuaga

SEQ ID NO: 13683 - RNA, 20 nt, Artificial Sequence
  targeting sequence with CTCN PAM
guuuauauacagugugccag

SEQ ID NO: 13684 - RNA, 20 nt, Artificial Sequence
  targeting sequence with CTCN PAM
cacagaaaauuccuuauuug

SEQ ID NO: 13685 - RNA, 20 nt, Artificial Sequence
  targeting sequence with CTCN PAM
gcagacaaauaaggaauuuu

SEQ ID NO: 13686 - RNA, 20 nt, Artificial Sequence
  targeting sequence with CTCN PAM
agguacgaagaccaaucacu

SEQ ID NO: 13687 - RNA, 20 nt, Artificial Sequence
  targeting sequence with CTCN PAM
uguuagugccuaugccagga

SEQ ID NO: 13688 - RNA, 20 nt, Artificial Sequence
  targeting sequence with CTCN PAM
uggcauaggcacuaacagga

SEQ ID NO: 13689 - RNA, 20 nt, Artificial Sequence
  targeting sequence with CTCN PAM
acugcugacccauuucccug

SEQ ID NO: 13690 - RNA, 20 nt, Artificial Sequence
  targeting sequence with CTCN PAM
gcaugugugcucguuuggug

SEQ ID NO: 13691 - RNA, 20 nt, Artificial Sequence
  targeting sequence with CTCN PAM
uuugguggcacaucagucaa

SEQ ID NO: 13692 - RNA, 20 nt, Artificial Sequence
  targeting sequence with CTCN PAM
ucugugcuuuccaacagcag

SEQ ID NO: 13693 - RNA, 20 nt, Artificial Sequence
  targeting sequence with CTCN PAM
agcaugaacccacaugccuc

SEQ ID NO: 13694 - RNA, 20 nt, Artificial Sequence
  targeting sequence with CTCN PAM
ccagcaugaacccacaugcc

SEQ ID NO: 13695 - RNA, 20 nt, Artificial Sequence
  targeting sequence with CTCN PAM
guugaaagacaggcuuauau

SEQ ID NO: 13696 - RNA, 20 nt, Artificial Sequence
  targeting sequence with CTCN PAM
uuuagagcuaauuggagaca

SEQ ID NO: 13697 - RNA, 20 nt, Artificial Sequence
  targeting sequence with CTCN PAM
aaaagagaagaccuucuaug

SEQ ID NO: 13698 - RNA, 20 nt, Artificial Sequence
  targeting sequence with CTCN PAM
aauuagcucuaaaagagaag

SEQ ID NO: 13699 - RNA, 20 nt, Artificial Sequence
  targeting sequence with CTCN PAM
aguugucuccaauuagcucu

SEQ ID NO: 13700 - RNA, 20 nt, Artificial Sequence
  targeting sequence with CTCN PAM
gaacuacucaaguugucucc

SEQ ID NO: 13701 - RNA, 20 nt, Artificial Sequence
  targeting sequence with CTCN PAM
agaggcaguacagcuuggaa

SEQ ID NO: 13702 - RNA, 20 nt, Artificial Sequence
  targeting sequence with CTCN PAM
ggaguugguaauuauuccau

SEQ ID NO: 13703 - RNA, 20 nt, Artificial Sequence
  targeting sequence with CTCN PAM
gcucuguucuaguuggugac

SEQ ID NO: 13704 - RNA, 20 nt, Artificial Sequence
  targeting sequence with CTCN PAM
guucuaguuggugacuuggg

SEQ ID NO: 13705 - RNA, 20 nt, Artificial Sequence
  targeting sequence with CTCN PAM
ucaguacugugaggauaaaa

SEQ ID NO: 13706 - RNA, 20 nt, Artificial Sequence
  targeting sequence with CTCN PAM
caguacugaugaggaaaccg

SEQ ID NO: 13707 - RNA, 20 nt, Artificial Sequence
  targeting sequence with CTCN PAM
ucuggucuuuaacauaauaa

SEQ ID NO: 13708 - RNA, 20 nt, Artificial Sequence
  targeting sequence with CTCN PAM
gcacacaguaggaguaggug

SEQ ID NO: 13709 - RNA, 20 nt, Artificial Sequence
  targeting sequence with CTCN PAM
uacugugugcugagcgccau

SEQ ID NO: 13710 - RNA, 20 nt, Artificial Sequence
  targeting sequence with CTCN PAM
auaaucagagccgcucuugu

SEQ ID NO: 13711 - RNA, 20 nt, Artificial Sequence
  targeting sequence with CTCN PAM
gauuauugagcaccuacucc

SEQ ID NO: 13712 - RNA, 20 nt, Artificial Sequence
  targeting sequence with CTCN PAM
uguugaugucacucagaauu

SEQ ID NO: 13713 - RNA, 20 nt, Artificial Sequence
  targeting sequence with CTCN PAM
gaauuauuggugucugccuu

SEQ ID NO: 13714 - RNA, 20 nt, Artificial Sequence
  targeting sequence with CTCN PAM
ugaagaacucaaucccuguu

SEQ ID NO: 13715 - RNA, 20 nt, Artificial Sequence
  targeting sequence with CTCN PAM
aucccuguuugcuuuucucu

SEQ ID NO: 13716 - RNA, 20 nt, Artificial Sequence
  targeting sequence with CTCN PAM
cacugcaggaagauccguuc

SEQ ID NO: 13717 - RNA, 20 nt, Artificial Sequence
  targeting sequence with CTCN PAM
cugcaggaagauccguucag

SEQ ID NO: 13718 - RNA, 20 nt, Artificial Sequence
  targeting sequence with CTCN PAM
uuucaacaucuccagguucc

SEQ ID NO: 13719 - RNA, 20 nt, Artificial Sequence
  targeting sequence with CTCN PAM
agguuccugcugcacagccu

SEQ ID NO: 13720 - RNA, 20 nt, Artificial Sequence
  targeting sequence with CTCN PAM
ggcaucucuaaaguguaucc

SEQ ID NO: 13721 - RNA, 20 nt, Artificial Sequence
  targeting sequence with CTCN PAM
aaaguguauccuuucucuua

SEQ ID NO: 13722 - RNA, 20 nt, Artificial Sequence
  targeting sequence with CTCN PAM
uaucccuccuccgucccacc

SEQ ID NO: 13723 - RNA, 20 nt, Artificial Sequence
  targeting sequence with CTCN PAM
uccgucccaccaccguucuu

SEQ ID NO: 13724 - RNA, 20 nt, Artificial Sequence
  targeting sequence with CTCN PAM
gucccaccaccguucuuguc

SEQ ID NO: 13725 - RNA, 20 nt, Artificial Sequence
  targeting sequence with CTCN PAM
ggaaggaauuucuuggggcc

SEQ ID NO: 13726 - RNA, 20 nt, Artificial Sequence
  targeting sequence with CTCN PAM
cucagcaacccucagggaag

SEQ ID NO: 13727 - RNA, 20 nt, Artificial Sequence
  targeting sequence with CTCN PAM
cagcaacccucagggaagac

SEQ ID NO: 13728 - RNA, 20 nt, Artificial Sequence
  targeting sequence with CTCN PAM
gcaacccucagggaagacag

SEQ ID NO: 13729 - RNA, 20 nt, Artificial Sequence
  targeting sequence with CTCN PAM
gggaagacagagaacucacc

SEQ ID NO: 13730 - RNA, 20 nt, Artificial Sequence
  targeting sequence with CTCN PAM
gucuucccugaggguugcug

SEQ ID NO: 13731 - RNA, 20 nt, Artificial Sequence
  targeting sequence with CTCN PAM
cccucccgcugcuguuuggc

SEQ ID NO: 13732 - RNA, 20 nt, Artificial Sequence
  targeting sequence with CTCN PAM
cgcugcuguuuggcuauaga

SEQ ID NO: 13733 - RNA, 20 nt, Artificial Sequence
  targeting sequence with CTCN PAM
auagccaaacagcagcggga

SEQ ID NO: 13734 - RNA, 20 nt, Artificial Sequence
  targeting sequence with CTCN PAM
gcagggaggcccaggggccc

SEQ ID NO: 13735 - RNA, 20 nt, Artificial Sequence
  targeting sequence with CTCN PAM
cugcugagccucuauagcca

SEQ ID NO: 13736 - RNA, 20 nt, Artificial Sequence
  targeting sequence with CTCN PAM
uggccugggccccugggccu

SEQ ID NO: 13737 - RNA, 20 nt, Artificial Sequence
  targeting sequence with CTCN PAM
ucuucucuuggccugggccc

SEQ ID NO: 13738 - RNA, 20 nt, Artificial Sequence
  targeting sequence with CTCN PAM
cugagcugaacccagcagug

SEQ ID NO: 13739 - RNA, 20 nt, Artificial Sequence
  targeting sequence with CTCN PAM
gagcugaacccagcaguggg

SEQ ID NO: 13740 - RNA, 20 nt, Artificial Sequence
  targeting sequence with CTCN PAM
gagagcccugaaaacucauc

SEQ ID NO: 13741 - RNA, 20 nt, Artificial Sequence
  targeting sequence with CTCN PAM
ggccaacacacugucccaau

SEQ ID NO: 13742 - RNA, 20 nt, Artificial Sequence
  targeting sequence with CTCN PAM
uagaacccacagaugagggu

SEQ ID NO: 13743 - RNA, 20 nt, Artificial Sequence
  targeting sequence with CTCN PAM
ucuguggguucuaggaggga

SEQ ID NO: 13744 - RNA, 20 nt, Artificial Sequence
  targeting sequence with CTCN PAM
agacuggggaggagggagug

SEQ ID NO: 13745 - RNA, 20 nt, Artificial Sequence
  targeting sequence with CTCN PAM
ccagucuggagaagugccca

SEQ ID NO: 13746 - RNA, 20 nt, Artificial Sequence
  targeting sequence with CTCN PAM
uccccagucuggagaagugc

SEQ ID NO: 13747 - RNA, 20 nt, Artificial Sequence
  targeting sequence with CTCN PAM
cuccuccccagucuggagaa

SEQ ID NO: 13748 - RNA, 20 nt, Artificial Sequence
  targeting sequence with CTCN PAM
uugauggcagcuuugccacc

SEQ ID NO: 13749 - RNA, 20 nt, Artificial Sequence
  targeting sequence with CTCN PAM
cucuuugauggcagcuuugc

SEQ ID NO: 13750 - RNA, 20 nt, Artificial Sequence
  targeting sequence with CTCN PAM
gacacagcacacauccacca

SEQ ID NO: 13751 - RNA, 20 nt, Artificial Sequence
  targeting sequence with CTCN PAM
gcuucauuccacccucagac

SEQ ID NO: 13752 - RNA, 20 nt, Artificial Sequence
  targeting sequence with CTCN PAM
agguaaacuucccugaccau

SEQ ID NO: 13753 - RNA, 20 nt, Artificial Sequence
  targeting sequence with CTCN PAM
uccagguaaacuucccugac

SEQ ID NO: 13754 - RNA, 20 nt, Artificial Sequence
  targeting sequence with CTCN PAM
uccuccagguaaacuucccu

SEQ ID NO: 13755 - RNA, 20 nt, Artificial Sequence
  targeting sequence with CTCN PAM
gcuugcaugauggacaucuc

SEQ ID NO: 13756 - RNA, 20 nt, Artificial Sequence
  targeting sequence with CTCN PAM
ccuggaacauccacuuggcc

SEQ ID NO: 13757 - RNA, 20 nt, Artificial Sequence
  targeting sequence with CTCN PAM
auaugcuggguccuccccug

SEQ ID NO: 13758 - RNA, 20 nt, Artificial Sequence
  targeting sequence with CTCN PAM
ccauaugcuggguccucccc

SEQ ID NO: 13759 - RNA, 20 nt, Artificial Sequence
  targeting sequence with CTCN PAM
cacaugccuugcuugccucu

SEQ ID NO: 13760 - RNA, 20 nt, Artificial Sequence
  targeting sequence with CTCN PAM
cccacaugccuugcuugccu

SEQ ID NO: 13761 - RNA, 20 nt, Artificial Sequence
  targeting sequence with CTCN PAM
cccucucccacaugccuugc

SEQ ID NO: 13762 - RNA, 20 nt, Artificial Sequence
  targeting sequence with CTCN PAM
cacccaggguccccucaccc

SEQ ID NO: 13763 - RNA, 20 nt, Artificial Sequence
  targeting sequence with CTCN PAM
ggccccucccacccaggguc

SEQ ID NO: 13764 - RNA, 20 nt, Artificial Sequence
  targeting sequence with CTCN PAM
ccggccccucccacccaggg

SEQ ID NO: 13765 - RNA, 20 nt, Artificial Sequence
  targeting sequence with CTCN PAM
ggccuuggguccugcugccu

SEQ ID NO: 13766 - RNA, 20 nt, Artificial Sequence
  targeting sequence with CTCN PAM
caggccuuggguccugcugc

SEQ ID NO: 13767 - RNA, 20 nt, Artificial Sequence
  targeting sequence with CTCN PAM
cuucuguagccaucgagggc

SEQ ID NO: 13768 - RNA, 20 nt, Artificial Sequence
  targeting sequence with CTCN PAM
ucuguagccaucgagggcca

SEQ ID NO: 13769 - RNA, 20 nt, Artificial Sequence
  targeting sequence with CTCN PAM
auggcuacagaagagaggaa

SEQ ID NO: 13770 - RNA, 20 nt, Artificial Sequence
  targeting sequence with CTCN PAM
gcuuaugguaccacuguggc

SEQ ID NO: 13771 - RNA, 20 nt, Artificial Sequence
  targeting sequence with CTCN PAM
ugacauccaagaccuuaaaa

SEQ ID NO: 13772 - RNA, 20 nt, Artificial Sequence
  targeting sequence with CTCN PAM
cuguacucucagcuccuucc

SEQ ID NO: 13773 - RNA, 20 nt, Artificial Sequence
  targeting sequence with CTCN PAM
cagcuccuucccagccgcag

SEQ ID NO: 13774 - RNA, 20 nt, Artificial Sequence
  targeting sequence with CTCN PAM
gcuccuucccagccgcagcc

SEQ ID NO: 13775 - RNA, 20 nt, Artificial Sequence
  targeting sequence with CTCN PAM
uucccagccgcagccccacc

SEQ ID NO: 13776 - RNA, 20 nt, Artificial Sequence
  targeting sequence with CTCN PAM
guaaggaaaacccacuccac

SEQ ID NO: 13777 - RNA, 20 nt, Artificial Sequence
  targeting sequence with CTCN PAM
acuggagaagacccagagcu

SEQ ID NO: 13778 - RNA, 20 nt, Artificial Sequence
  targeting sequence with CTCN PAM
aguggaguggguuuuccuua

SEQ ID NO: 13779 - RNA, 20 nt, Artificial Sequence
  targeting sequence with CTCN PAM
gggucuucuccaguggagug

SEQ ID NO: 13780 - RNA, 20 nt, Artificial Sequence
  targeting sequence with CTCN PAM
uuguuguaagaauuggccuc

SEQ ID NO: 13781 - RNA, 20 nt, Artificial Sequence
  targeting sequence with CTCN PAM
cuagaggauuccaggcccau

SEQ ID NO: 13782 - RNA, 20 nt, Artificial Sequence
  targeting sequence with CTCN PAM
agcgaggccaauucuuacaa

SEQ ID NO: 13783 - RNA, 20 nt, Artificial Sequence
  targeting sequence with CTCN PAM
aaucaaggggugccuuccug

SEQ ID NO: 13784 - RNA, 20 nt, Artificial Sequence
  targeting sequence with CTCN PAM
aggaaggcaccccuugauuu

SEQ ID NO: 13785 - RNA, 20 nt, Artificial Sequence
  targeting sequence with CTCN PAM
gcugcaugcgucuccgucuu

SEQ ID NO: 13786 - RNA, 20 nt, Artificial Sequence
  targeting sequence with CTCN PAM
gucuuuccccguaggagcag

SEQ ID NO: 13787 - RNA, 20 nt, Artificial Sequence
  targeting sequence with CTCN PAM
uacggggaaagacggagacg

SEQ ID NO: 13788 - RNA, 20 nt, Artificial Sequence
  targeting sequence with CTCN PAM
gcccccacaggcauagcccu

SEQ ID NO: 13789 - RNA, 20 nt, Artificial Sequence
  targeting sequence with CTCN PAM
uccuuuccagcaaguucugu

SEQ ID NO: 13790 - RNA, 20 nt, Artificial Sequence
  targeting sequence with CTCN PAM
aacagaacuugcuggaaagg

SEQ ID NO: 13791 - RNA, 20 nt, Artificial Sequence
  targeting sequence with CTCN PAM
acccugagccuuacccugug

SEQ ID NO: 13792 - RNA, 20 nt, Artificial Sequence
  targeting sequence with CTCN PAM
ggguagagguucuaucaagc

SEQ ID NO: 13793 - RNA, 20 nt, Artificial Sequence
  targeting sequence with CTCN PAM
ugacagucccugacuuugag

SEQ ID NO: 13794 - RNA, 20 nt, Artificial Sequence
  targeting sequence with CTCN PAM
aagucagggacugucaggag

SEQ ID NO: 13795 - RNA, 20 nt, Artificial Sequence
  targeting sequence with CTCN PAM
ucaaagucagggacugucag

SEQ ID NO: 13796 - RNA, 20 nt, Artificial Sequence
  targeting sequence with CTCN PAM
agcaugacuccucaaaguca

SEQ ID NO: 13797 - RNA, 20 nt, Artificial Sequence
  targeting sequence with CTCN PAM
ccacagaacugcugaagugg

SEQ ID NO: 13798 - RNA, 20 nt, Artificial Sequence
  targeting sequence with CTCN PAM
acagaacugcugaaguggac

SEQ ID NO: 13799 - RNA, 20 nt, Artificial Sequence
  targeting sequence with CTCN PAM
cgccgucugcagugcagccc

SEQ ID NO: 13800 - RNA, 20 nt, Artificial Sequence
  targeting sequence with CTCN PAM
caguguuccugcucccgccg

SEQ ID NO: 13801 - RNA, 20 nt, Artificial Sequence
  targeting sequence with CTCN PAM
cccaguguuccugcucccgc

SEQ ID NO: 13802 - RNA, 20 nt, Artificial Sequence
  targeting sequence with CTCN PAM
cgcaucucucccaguguucc

SEQ ID NO: 13803 - RNA, 20 nt, Artificial Sequence
  targeting sequence with CTCN PAM
ugcccuuccucccgcaucuc

SEQ ID NO: 13804 - RNA, 20 nt, Artificial Sequence
  targeting sequence with CTCN PAM
gauguuggcugcccccaggc

SEQ ID NO: 13805 - RNA, 20 nt, Artificial Sequence
  targeting sequence with CTCN PAM
ggucaccuccgauguuggcu

SEQ ID NO: 13806 - RNA, 20 nt, Artificial Sequence
  targeting sequence with CTCN PAM
caggucaccuccgauguugg

SEQ ID NO: 13807 - RNA, 20 nt, Artificial Sequence
  targeting sequence with CTCN PAM
ucucaggucaccuccgaugu

SEQ ID NO: 13808 - RNA, 20 nt, Artificial Sequence
  targeting sequence with CTCN PAM
ccucucaggucaccuccgau

SEQ ID NO: 13809 - RNA, 20 nt, Artificial Sequence
  targeting sequence with CTCN PAM
ucagccucuggcugaggagc

SEQ ID NO: 13810 - RNA, 20 nt, Artificial Sequence
  targeting sequence with CTCN PAM
ggcugaggagcuucaagggg

SEQ ID NO: 13811 - RNA, 20 nt, Artificial Sequence
  targeting sequence with CTCN PAM
gccagaggcugacgagccuu

SEQ ID NO: 13812 - RNA, 20 nt, Artificial Sequence
  targeting sequence with CTCN PAM
ucagccagaggcugacgagc

SEQ ID NO: 13813 - RNA, 20 nt, Artificial Sequence
  targeting sequence with CTCN PAM
ggggcccccuugaagcuccu

SEQ ID NO: 13814 - RNA, 20 nt, Artificial Sequence
  targeting sequence with CTCN PAM
gaaacugcccaccaggcccu

SEQ ID NO: 13815 - RNA, 20 nt, Artificial Sequence
  targeting sequence with CTCN PAM
gggaagggugugcagacaga

SEQ ID NO: 13816 - RNA, 20 nt, Artificial Sequence
  targeting sequence with CTCN PAM
gucugcacacccuuccccga

SEQ ID NO: 13817 - RNA, 20 nt, Artificial Sequence
  targeting sequence with CTCN PAM
gagcaggguugaggguggcu

SEQ ID NO: 13818 - RNA, 20 nt, Artificial Sequence
  targeting sequence with CTCN PAM
gaggccccuggguguacccc

SEQ ID NO: 13819 - RNA, 20 nt, Artificial Sequence
  targeting sequence with CTCN PAM
acccugcucugaggccccug

SEQ ID NO: 13820 - RNA, 20 nt, Artificial Sequence
  targeting sequence with CTCN PAM
ccagggagucuggaccaggc

SEQ ID NO: 13821 - RNA, 20 nt, Artificial Sequence
  targeting sequence with CTCN PAM
cuggggagccacccucaacc

SEQ ID NO: 13822 - RNA, 20 nt, Artificial Sequence
  targeting sequence with CTCN PAM
cccugccagguggggccugg

SEQ ID NO: 13823 - RNA, 20 nt, Artificial Sequence
  targeting sequence with CTCN PAM
cacccugccagguggggccu

SEQ ID NO: 13824 - RNA, 20 nt, Artificial Sequence
  targeting sequence with CTCN PAM
gcucucacccugccaggugg

SEQ ID NO: 13825 - RNA, 20 nt, Artificial Sequence
  targeting sequence with CTCN PAM
uaggaugccuggcacaaagg

SEQ ID NO: 13826 - RNA, 20 nt, Artificial Sequence
  targeting sequence with CTCN PAM
ccaaaccugccagccaggcc

SEQ ID NO: 13827 - RNA, 20 nt, Artificial Sequence
  targeting sequence with CTCN PAM
uccugccucaccaaaccugc

SEQ ID NO: 13828 - RNA, 20 nt, Artificial Sequence
  targeting sequence with CTCN PAM
ucuuauacccugacuaggcc

SEQ ID NO: 13829 - RNA, 20 nt, Artificial Sequence
  targeting sequence with CTCN PAM
gggccugcugauggcucauc

SEQ ID NO: 13830 - RNA, 20 nt, Artificial Sequence
  targeting sequence with CTCN PAM
gauggcaaggcccaggaauu

SEQ ID NO: 13831 - RNA, 20 nt, Artificial Sequence
  targeting sequence with CTCN PAM
ccucucacaagcgcacagag

SEQ ID NO: 13832 - RNA, 20 nt, Artificial Sequence
  targeting sequence with CTCN PAM
cacaagcgcacagagccuuc

SEQ ID NO: 13833 - RNA, 20 nt, Artificial Sequence
  targeting sequence with CTCN PAM
caagcgcacagagccuuccu

SEQ ID NO: 13834 - RNA, 20 nt, Artificial Sequence
  targeting sequence with CTCN PAM
gugcgcuugugagaggugag

SEQ ID NO: 13835 - RNA, 20 nt, Artificial Sequence
  targeting sequence with CTCN PAM
cggucuuuccucugccuucc

SEQ ID NO: 13836 - RNA, 20 nt, Artificial Sequence
  targeting sequence with CTCN PAM
gccuucccggcaccagcaca

SEQ ID NO: 13837 - RNA, 20 nt, Artificial Sequence
  targeting sequence with CTCN PAM
cuccaaggacaggcagugcc

SEQ ID NO: 13838 - RNA, 20 nt, Artificial Sequence
  targeting sequence with CTCN PAM
aaggacaggcagugccagcu

SEQ ID NO: 13839 - RNA, 20 nt, Artificial Sequence
  targeting sequence with CTCN PAM
ugggccugguguugccccug

SEQ ID NO: 13840 - RNA, 20 nt, Artificial Sequence
  targeting sequence with CTCN PAM
ucaccuuggccaagcagagc

SEQ ID NO: 13841 - RNA, 20 nt, Artificial Sequence
  targeting sequence with CTCN PAM
gcuuggccaaggugaagagu

SEQ ID NO: 13842 - RNA, 20 nt, Artificial Sequence
  targeting sequence with CTCN PAM
gugccuacaggcuggcccgg

SEQ ID NO: 13843 - RNA, 20 nt, Artificial Sequence
  targeting sequence with CTCN PAM
auggacuuuuggaaucuggc

SEQ ID NO: 13844 - RNA, 20 nt, Artificial Sequence
  targeting sequence with CTCN PAM
cugucguggaagggcuuggc

SEQ ID NO: 13845 - RNA, 20 nt, Artificial Sequence
  targeting sequence with CTCN PAM
ccucacugucguggaagggc

SEQ ID NO: 13846 - RNA, 20 nt, Artificial Sequence
  targeting sequence with CTCN PAM
ucucccuugaggccaucuca

SEQ ID NO: 13847 - RNA, 20 nt, Artificial Sequence
  targeting sequence with CTCN PAM
cccuugaggccaucucaugc

SEQ ID NO: 13848 - RNA, 20 nt, Artificial Sequence
  targeting sequence with CTCN PAM
cuugaggccaucucaugccu

SEQ ID NO: 13849 - RNA, 20 nt, Artificial Sequence
  targeting sequence with CTCN PAM
agggagaggagaagccaccu

SEQ ID NO: 13850 - RNA, 20 nt, Artificial Sequence
  targeting sequence with CTCN PAM
ugccuucuugccuggccugg

SEQ ID NO: 13851 - RNA, 20 nt, Artificial Sequence
  targeting sequence with CTCN PAM
ucaaacggaacccaggccag

SEQ ID NO: 13852 - RNA, 20 nt, Artificial Sequence
  targeting sequence with CTCN PAM
cuucaaacggaacccaggcc

SEQ ID NO: 13853 - RNA, 20 nt, Artificial Sequence
  targeting sequence with CTCN PAM
cucuaggcucugugcccccu

SEQ ID NO: 13854 - RNA, 20 nt, Artificial Sequence
  targeting sequence with CTCN PAM
aggcucugugcccccugcuc

SEQ ID NO: 13855 - RNA, 20 nt, Artificial Sequence
  targeting sequence with CTCN PAM
gugcccccugcucaagccug

SEQ ID NO: 13856 - RNA, 20 nt, Artificial Sequence
  targeting sequence with CTCN PAM
agccuggccaugccagcucc

SEQ ID NO: 13857 - RNA, 20 nt, Artificial Sequence
  targeting sequence with CTCN PAM
ccugugcuucccuguccacc

SEQ ID NO: 13858 - RNA, 20 nt, Artificial Sequence
  targeting sequence with CTCN PAM
uguucuccccgcaguccacc

SEQ ID NO: 13859 - RNA, 20 nt, Artificial Sequence
  targeting sequence with CTCN PAM
ccgcaguccaccuggcgccc

SEQ ID NO: 13860 - RNA, 20 nt, Artificial Sequence
  targeting sequence with CTCN PAM
cagcccccggccccggccuc

SEQ ID NO: 13861 - RNA, 20 nt, Artificial Sequence
  targeting sequence with CTCN PAM
gcccucagccuggccucccu

SEQ ID NO: 13862 - RNA, 20 nt, Artificial Sequence
  targeting sequence with CTCN PAM
gccuggccucccuugcuccu

SEQ ID NO: 13863 - RNA, 20 nt, Artificial Sequence
  targeting sequence with CTCN PAM
cuugcuccuugcccuccccu

SEQ ID NO: 13864 - RNA, 20 nt, Artificial Sequence
  targeting sequence with CTCN PAM
uugcccuccccuaggcaagc

SEQ ID NO: 13865 - RNA, 20 nt, Artificial Sequence
  targeting sequence with CTCN PAM
ccuaggcaagccccacaccu

SEQ ID NO: 13866 - RNA, 20 nt, Artificial Sequence
  targeting sequence with CTCN PAM
gugcccagguggcucugccu

SEQ ID NO: 13867 - RNA, 20 nt, Artificial Sequence
  targeting sequence with CTCN PAM
gccuuuaccccaggccuggc

SEQ ID NO: 13868 - RNA, 20 nt, Artificial Sequence
  targeting sequence with CTCN PAM
ggggccaggccugggguaaa

SEQ ID NO: 13869 - RNA, 20 nt, Artificial Sequence
  targeting sequence with CTCN PAM
uacucuagaaaccucugccc

SEQ ID NO: 13870 - RNA, 20 nt, Artificial Sequence
  targeting sequence with CTCN PAM
agaaaccucugcccuuucug

SEQ ID NO: 13871 - RNA, 20 nt, Artificial Sequence
  targeting sequence with CTCN PAM
gcccuuucuggaaccaggcu

SEQ ID NO: 13872 - RNA, 20 nt, Artificial Sequence
  targeting sequence with CTCN PAM
agcaaaucuaccccacacuc

SEQ ID NO: 13873 - RNA, 20 nt, Artificial Sequence
  targeting sequence with CTCN PAM
caacccacauuccuucaacc

SEQ ID NO: 13874 - RNA, 20 nt, Artificial Sequence
  targeting sequence with CTCN PAM
cucaagcucagagcaaggac

SEQ ID NO: 13875 - RNA, 20 nt, Artificial Sequence
  targeting sequence with CTCN PAM
agcucagagcaaggacuugg

SEQ ID NO: 13876 - RNA, 20 nt, Artificial Sequence
  targeting sequence with CTCN PAM
gagcaaggacuugguucaga

SEQ ID NO: 13877 - RNA, 20 nt, Artificial Sequence
  targeting sequence with CTCN PAM
gagcuugagggaggaugugu

SEQ ID NO: 13878 - RNA, 20 nt, Artificial Sequence
  targeting sequence with CTCN PAM
acccucuccuagcucugucu

SEQ ID NO: 13879 - RNA, 20 nt, Artificial Sequence
  targeting sequence with CTCN PAM
ccuagcucugucuccaucuu

SEQ ID NO: 13880 - RNA, 20 nt, Artificial Sequence
  targeting sequence with CTCN PAM
uagcucugucuccaucuuuc

SEQ ID NO: 13881 - RNA, 20 nt, Artificial Sequence
  targeting sequence with CTCN PAM
gucuccaucuuucugcaccu

SEQ ID NO: 13882 - RNA, 20 nt, Artificial Sequence
  targeting sequence with CTCN PAM
aucuuucugcaccuuggguu

SEQ ID NO: 13883 - RNA, 20 nt, Artificial Sequence
  targeting sequence with CTCN PAM
caacuaccugugggaaaggg

SEQ ID NO: 13884 - RNA, 20 nt, Artificial Sequence
  targeting sequence with CTCN PAM
uuuagccucacaacuaccug

SEQ ID NO: 13885 - RNA, 20 nt, Artificial Sequence
  targeting sequence with CTCN PAM
gcacggugcccggagcaugg

SEQ ID NO: 13886 - RNA, 20 nt, Artificial Sequence
  targeting sequence with CTCN PAM
gggcaccgugcggagcacgu

SEQ ID NO: 13887 - RNA, 20 nt, Artificial Sequence
  targeting sequence with CTCN PAM
acggcacuuuuccccuggca

SEQ ID NO: 13888 - RNA, 20 nt, Artificial Sequence
  targeting sequence with CTCN PAM
augccauggggaagcaggau

SEQ ID NO: 13889 - RNA, 20 nt, Artificial Sequence
  targeting sequence with CTCN PAM
ugggcccggcgccccuuccc

SEQ ID NO: 13890 - RNA, 20 nt, Artificial Sequence
  targeting sequence with CTCN PAM
uggcagccaggccccagggg

SEQ ID NO: 13891 - RNA, 20 nt, Artificial Sequence
  targeting sequence with CTCN PAM
ggcuucaggccccuggggcc

SEQ ID NO: 13892 - RNA, 20 nt, Artificial Sequence
  targeting sequence with CTCN PAM
cccuggacucuggcuucagg

SEQ ID NO: 13893 - RNA, 20 nt, Artificial Sequence
  targeting sequence with CTCN PAM
ucccccuggacucuggcuuc

SEQ ID NO: 13894 - RNA, 20 nt, Artificial Sequence
  targeting sequence with CTCN PAM
ggaguccguggcuguuuugu

SEQ ID NO: 13895 - RNA, 20 nt, Artificial Sequence
  targeting sequence with CTCN PAM
cgaggggccggggcaggcac

SEQ ID NO: 13896 - RNA, 20 nt, Artificial Sequence
  targeting sequence with CTCN PAM
uacaaaacagccacggacuc

SEQ ID NO: 13897 - RNA, 20 nt, Artificial Sequence
  targeting sequence with CTCN PAM
accaacaacccgcugcucaa

SEQ ID NO: 13898 - RNA, 20 nt, Artificial Sequence
  targeting sequence with CTCN PAM
acaaccugggcaacgucugc

SEQ ID NO: 13899 - RNA, 20 nt, Artificial Sequence
  targeting sequence with CTCN PAM
gccucuuccuacggugaguc

SEQ ID NO: 13900 - RNA, 20 nt, Artificial Sequence
  targeting sequence with CTCN PAM
uccuacggugagucccugca

SEQ ID NO: 13901 - RNA, 20 nt, Artificial Sequence
  targeting sequence with CTCN PAM
ccguaggaagaggcggagaa

SEQ ID NO: 13902 - RNA, 20 nt, Artificial Sequence
  targeting sequence with CTCN PAM
ggaugcagggacucaccgua

SEQ ID NO: 13903 - RNA, 20 nt, Artificial Sequence
  targeting sequence with CTCN PAM
cuccacugcucucuggccuc

SEQ ID NO: 13904 - RNA, 20 nt, Artificial Sequence
  targeting sequence with CTCN PAM
acugcucucuggccucagga

SEQ ID NO: 13905 - RNA, 20 nt, Artificial Sequence
  targeting sequence with CTCN PAM
cuggccucaggacguugggc

SEQ ID NO: 13906 - RNA, 20 nt, Artificial Sequence
  targeting sequence with CTCN PAM
ggccucaggacguugggcaa

SEQ ID NO: 13907 - RNA, 20 nt, Artificial Sequence
  targeting sequence with CTCN PAM
ggacguugggcaagggccaa

SEQ ID NO: 13908 - RNA, 20 nt, Artificial Sequence
  targeting sequence with CTCN PAM
gaaugucccuguuuaugaaa

SEQ ID NO: 13909 - RNA, 20 nt, Artificial Sequence
  targeting sequence with CTCN PAM
uuucauaaacagggacauuc

SEQ ID NO: 13910 - RNA, 20 nt, Artificial Sequence
  targeting sequence with CTCN PAM
gacgcccaccuaccugacac

SEQ ID NO: 13911 - RNA, 20 nt, Artificial Sequence
  targeting sequence with CTCN PAM
uugugucagguaggugggcg

SEQ ID NO: 13912 - RNA, 20 nt, Artificial Sequence
  targeting sequence with CTCN PAM
gggaacaccgacagugacuc

SEQ ID NO: 13913 - RNA, 20 nt, Artificial Sequence
  targeting sequence with CTCN PAM
gggaaccuggcgcagggcuu

SEQ ID NO: 13914 - RNA, 20 nt, Artificial Sequence
  targeting sequence with CTCN PAM
uucuggggcauuugguuaug

SEQ ID NO: 13915 - RNA, 20 nt, Artificial Sequence
  targeting sequence with CTCN PAM
cuuucuggggcauuugguua

SEQ ID NO: 13916 - RNA, 20 nt, Artificial Sequence
  targeting sequence with CTCN PAM
uggucugaaugcaaagccau

SEQ ID NO: 13917 - RNA, 20 nt, Artificial Sequence
  targeting sequence with CTCN PAM
gccuccuggucugaaugcaa

SEQ ID NO: 13918 - RNA, 20 nt, Artificial Sequence
  targeting sequence with CTCN PAM
uuugauguugacagaggauc

SEQ ID NO: 13919 - RNA, 20 nt, Artificial Sequence
  targeting sequence with CTCN PAM
gucaacaucaaaggagcugg

SEQ ID NO: 13920 - RNA, 20 nt, Artificial Sequence
  targeting sequence with CTCN PAM
ugggaaggggcuucugaucc

SEQ ID NO: 13921 - RNA, 20 nt, Artificial Sequence
  targeting sequence with CTCN PAM
gcuccugggaaggggcuucu

SEQ ID NO: 13922 - RNA, 20 nt, Artificial Sequence
  targeting sequence with CTCN PAM
gcucagcuccugggaagggg

SEQ ID NO: 13923 - RNA, 20 nt, Artificial Sequence
  targeting sequence with CTCN PAM
ugcacacacacacacagacu

SEQ ID NO: 13924 - RNA, 20 nt, Artificial Sequence
  targeting sequence with CTCN PAM
gugugugcaggggcagucug

SEQ ID NO: 13925 - RNA, 20 nt, Artificial Sequence
  targeting sequence with CTCN PAM
gugugugugugcaggggcag

SEQ ID NO: 13926 - RNA, 20 nt, Artificial Sequence
  targeting sequence with CTCN PAM
gugugugugcaggggcgguu

SEQ ID NO: 13927 - RNA, 20 nt, Artificial Sequence
  targeting sequence with CTCN PAM
gcacacacacacagacugcc

SEQ ID NO: 13928 - RNA, 20 nt, Artificial Sequence
  targeting sequence with CTCN PAM
ugcacacacacacacacaca

SEQ ID NO: 13929 - RNA, 20 nt, Artificial Sequence
  targeting sequence with CTCN PAM
gugugugugugugugugugu

SEQ ID NO: 13930 - RNA, 20 nt, Artificial Sequence
  targeting sequence with CTCN PAM
gugugugugcaggggcaguc

SEQ ID NO: 13931 - RNA, 20 nt, Artificial Sequence
  targeting sequence with CTCN PAM
gugugugugugcaggggcag

SEQ ID NO: 13932 - RNA, 20 nt, Artificial Sequence
  targeting sequence with CTCN PAM
gugugugugugcaggggcag

SEQ ID NO: 13933 - RNA, 20 nt, Artificial Sequence
  targeting sequence with CTCN PAM
ugcacacacauacagagacu

SEQ ID NO: 13934 - RNA, 20 nt, Artificial Sequence
  targeting sequence with CTCN PAM
guaugugugugcaggagcag

SEQ ID NO: 13935 - RNA, 20 nt, Artificial Sequence
  targeting sequence with CTCN PAM
gugugugugggcaggggcag

SEQ ID NO: 13936 - RNA, 20 nt, Artificial Sequence
  targeting sequence with CTCN PAM
augugugugugcaggggcgg

SEQ ID NO: 13937 - RNA, 20 nt, Artificial Sequence
  targeting sequence with CTCN PAM
augugugugugcaggggcag

SEQ ID NO: 13938 - RNA, 20 nt, Artificial Sequence
  targeting sequence with CTCN PAM
gugugugcacgcaggggcag

SEQ ID NO: 13939 - RNA, 20 nt, Artificial Sequence
  targeting sequence with CTCN PAM
ugcacacacacacacacaga

SEQ ID NO: 13940 - RNA, 20 nt, Artificial Sequence
  targeting sequence with CTCN PAM
gugugugugugugugcagga

SEQ ID NO: 13941 - RNA, 20 nt, Artificial Sequence
  targeting sequence with CTCN PAM
cugugugugugugugugcag

SEQ ID NO: 13942 - RNA, 20 nt, Artificial Sequence
  targeting sequence with CTCN PAM
gugugugugcaggggcaguc

SEQ ID NO: 13943 - RNA, 20 nt, Artificial Sequence
  targeting sequence with CTCN PAM
gugugugugugugugugcag

SEQ ID NO: 13944 - RNA, 20 nt, Artificial Sequence
  targeting sequence with CTCN PAM
ugcacacacacacacacaca

SEQ ID NO: 13945 - RNA, 20 nt, Artificial Sequence
  targeting sequence with CTCN PAM
gugugugugugugugugugu

SEQ ID NO: 13946 - RNA, 20 nt, Artificial Sequence
  targeting sequence with CTCN PAM
cugugugugugugugugugu

SEQ ID NO: 13947 - RNA, 20 nt, Artificial Sequence
  targeting sequence with CTCN PAM
gugugucugugugcaggggc

SEQ ID NO: 13948 - RNA, 20 nt, Artificial Sequence
  targeting sequence with CTCN PAM
ugcacacacacagagacugc

SEQ ID NO: 13949 - RNA, 20 nt, Artificial Sequence
  targeting sequence with CTCN PAM
gugugugugcaggagcgguc

SEQ ID NO: 13950 - RNA, 20 nt, Artificial Sequence
  targeting sequence with CTCN PAM
gugugugugugcaggggcag

SEQ ID NO: 13951 - RNA, 20 nt, Artificial Sequence
  targeting sequence with CTCN PAM
gugugugugugugugcaggg

SEQ ID NO: 13952 - RNA, 20 nt, Artificial Sequence
  targeting sequence with CTCN PAM
ugcacacagacacacagaga

SEQ ID NO: 13953 - RNA, 20 nt, Artificial Sequence
  targeting sequence with CTCN PAM
gugugucugugugcaggagc

SEQ ID NO: 13954 - RNA, 20 nt, Artificial Sequence
  targeting sequence with CTCN PAM
ugcacacacacggagacugc

SEQ ID NO: 13955 - RNA, 20 nt, Artificial Sequence
  targeting sequence with CTCN PAM
gugugugugcaggagcgguc

SEQ ID NO: 13956 - RNA, 20 nt, Artificial Sequence
  targeting sequence with CTCN PAM
gugugugugcaggggcaguc

SEQ ID NO: 13957 - RNA, 20 nt, Artificial Sequence
  targeting sequence with CTCN PAM
ugcacacacacacacacaca

SEQ ID NO: 13958 - RNA, 20 nt, Artificial Sequence
  targeting sequence with CTCN PAM
gugugugugugcaggggcag

SEQ ID NO: 13959 - RNA, 20 nt, Artificial Sequence
  targeting sequence with CTCN PAM
gugugucugugugcaggggc

SEQ ID NO: 13960 - RNA, 20 nt, Artificial Sequence
  targeting sequence with CTCN PAM
ugcacacacacauggagacu

SEQ ID NO: 13961 - RNA, 20 nt, Artificial Sequence
  targeting sequence with CTCN PAM
augugugugugcaggagcgg

SEQ ID NO: 13962 - RNA, 20 nt, Artificial Sequence
  targeting sequence with CTCN PAM
gugugugugcaggggcaguc

SEQ ID NO: 13963 - RNA, 20 nt, Artificial Sequence
  targeting sequence with CTCN PAM
gcacacacacagagacugcc

SEQ ID NO: 13964 - RNA, 20 nt, Artificial Sequence
  targeting sequence with CTCN PAM
gugugugugcagaggcaguc

SEQ ID NO: 13965 - RNA, 20 nt, Artificial Sequence
  targeting sequence with CTCN PAM
ugcacacacacacacacaca

SEQ ID NO: 13966 - RNA, 20 nt, Artificial Sequence
  targeting sequence with CTCN PAM
gugugugugugugugugugu

SEQ ID NO: 13967 - RNA, 20 nt, Artificial Sequence
  targeting sequence with CTCN PAM
ugcacacacauacagagacu

SEQ ID NO: 13968 - RNA, 20 nt, Artificial Sequence
  targeting sequence with CTCN PAM
guaugugugugcaggagcag

SEQ ID NO: 13969 - RNA, 20 nt, Artificial Sequence
  targeting sequence with CTCN PAM
ucuugcuuuuggugaagcug

SEQ ID NO: 13970 - RNA, 20 nt, Artificial Sequence
  targeting sequence with CTCN PAM
acccacuggcagcuucacca

SEQ ID NO: 13971 - RNA, 20 nt, Artificial Sequence
  targeting sequence with CTCN PAM
guggucaccccaccugccug

SEQ ID NO: 13972 - RNA, 20 nt, Artificial Sequence
  targeting sequence with CTCN PAM
agcccccucagcccuuucuc

SEQ ID NO: 13973 - RNA, 20 nt, Artificial Sequence
  targeting sequence with CTCN PAM
gcccuuucucuaugcccucc

SEQ ID NO: 13974 - RNA, 20 nt, Artificial Sequence
  targeting sequence with CTCN PAM
augcccuccagacgugcuac

SEQ ID NO: 13975 - RNA, 20 nt, Artificial Sequence
  targeting sequence with CTCN PAM
agacgugcuacaccugguug

SEQ ID NO: 13976 - RNA, 20 nt, Artificial Sequence
  targeting sequence with CTCN PAM
accagguguagcacgucugg

SEQ ID NO: 13977 - RNA, 20 nt, Artificial Sequence
  targeting sequence with CTCN PAM
agguagaacucaaccaggug

SEQ ID NO: 13978 - RNA, 20 nt, Artificial Sequence
  targeting sequence with CTCN PAM
cucaucgaccuggaggugcu

SEQ ID NO: 13979 - RNA, 20 nt, Artificial Sequence
  targeting sequence with CTCN PAM
ucgaccuggaggugcugaga

SEQ ID NO: 13980 - RNA, 20 nt, Artificial Sequence
  targeting sequence with CTCN PAM
aggucgaugagggagauggc

SEQ ID NO: 13981 - RNA, 20 nt, Artificial Sequence
  targeting sequence with CTCN PAM
gcaccuccaggucgaugagg

SEQ ID NO: 13982 - RNA, 20 nt, Artificial Sequence
  targeting sequence with CTCN PAM
agcugucugucaucccgcuu

SEQ ID NO: 13983 - RNA, 20 nt, Artificial Sequence
  targeting sequence with CTCN PAM
ggccaagggcauggauacug

SEQ ID NO: 13984 - RNA, 20 nt, Artificial Sequence
  targeting sequence with CTCN PAM
cacagccgcacacacaggcu

SEQ ID NO: 13985 - RNA, 20 nt, Artificial Sequence
  targeting sequence with CTCN PAM
uacuucccgccuguccccag

SEQ ID NO: 13986 - RNA, 20 nt, Artificial Sequence
  targeting sequence with CTCN PAM
gcauggcccgcgauccccug

SEQ ID NO: 13987 - RNA, 20 nt, Artificial Sequence
  targeting sequence with CTCN PAM
gggaacacagggccaggcuc

SEQ ID NO: 13988 - RNA, 20 nt, Artificial Sequence
  targeting sequence with CTCN PAM
cugggaacacagggccaggc

SEQ ID NO: 13989 - RNA, 20 nt, Artificial Sequence
  targeting sequence with CTCN PAM
aaucucucugggaacacagg

SEQ ID NO: 13990 - RNA, 20 nt, Artificial Sequence
  targeting sequence with CTCN PAM
ccaaucucucugggaacaca

SEQ ID NO: 13991 - RNA, 20 nt, Artificial Sequence
  targeting sequence with CTCN PAM
gaucccugucccugucccau

SEQ ID NO: 13992 - RNA, 20 nt, Artificial Sequence
  targeting sequence with CTCN PAM
cacccuccccugaccccuaa

SEQ ID NO: 13993 - RNA, 20 nt, Artificial Sequence
  targeting sequence with CTCN PAM
ccugaccccuaaaaggcacu

SEQ ID NO: 13994 - RNA, 20 nt, Artificial Sequence
  targeting sequence with CTCN PAM
gucugugcauagcuccugca

SEQ ID NO: 13995 - RNA, 20 nt, Artificial Sequence
  targeting sequence with CTCN PAM
ugcauagccaacaugggaca

SEQ ID NO: 13996 - RNA, 20 nt, Artificial Sequence
  targeting sequence with CTCN PAM
uccacucaagucacuuucgc

SEQ ID NO: 13997 - RNA, 20 nt, Artificial Sequence
  targeting sequence with CTCN PAM
agucacuuucgcaugcaagu

SEQ ID NO: 13998 - RNA, 20 nt, Artificial Sequence
  targeting sequence with CTCN PAM
gucacuugcaugcgaaagug

SEQ ID NO: 13999 - RNA, 20 nt, Artificial Sequence
  targeting sequence with CTCN PAM
ugcuuggggcuuccuugcac

SEQ ID NO: 14000 - RNA, 20 nt, Artificial Sequence
  targeting sequence with CTCN PAM
ccugcuuggggcuuccuugc

SEQ ID NO: 14001 - RNA, 20 nt, Artificial Sequence
  targeting sequence with CTCN PAM
gucuggucggucacaggcug

SEQ ID NO: 14002 - RNA, 20 nt, Artificial Sequence
  targeting sequence with CTCN PAM
gccucucuuggccgcacugu

SEQ ID NO: 14003 - RNA, 20 nt, Artificial Sequence
  targeting sequence with CTCN PAM
cuuggccgcacuguccucug

SEQ ID NO: 14004 - RNA, 20 nt, Artificial Sequence
  targeting sequence with CTCN PAM
uggccgcacuguccucuggg

SEQ ID NO: 14005 - RNA, 20 nt, Artificial Sequence
  targeting sequence with CTCN PAM
gggcaacuucauucuuuggc

SEQ ID NO: 14006 - RNA, 20 nt, Artificial Sequence
  targeting sequence with CTCN PAM
guguuaugggggcaccacgg

SEQ ID NO: 14007 - RNA, 20 nt, Artificial Sequence
  targeting sequence with CTCN PAM
ugacaucucuguguuauggg

SEQ ID NO: 14008 - RNA, 20 nt, Artificial Sequence
  targeting sequence with CTCN PAM
gccuuauagcccccagaaac

SEQ ID NO: 14009 - RNA, 20 nt, Artificial Sequence
  targeting sequence with CTCN PAM
cagcuguggcagugaaagcc

SEQ ID NO: 14010 - RNA, 20 nt, Artificial Sequence
  targeting sequence with CTCN PAM
gcuguggcagugaaagcccc

SEQ ID NO: 14011 - RNA, 20 nt, Artificial Sequence
  targeting sequence with CTCN PAM
gccugccccuuggccaggag

SEQ ID NO: 14012 - RNA, 20 nt, Artificial Sequence
  targeting sequence with CTCN PAM
uggccaaggggcaggcugag

SEQ ID NO: 14013 - RNA, 20 nt, Artificial Sequence
  targeting sequence with CTCN PAM
cauguccagccugcaagugu

SEQ ID NO: 14014 - RNA, 20 nt, Artificial Sequence
  targeting sequence with CTCN PAM
ggccacgugugugcuguucc

SEQ ID NO: 14015 - RNA, 20 nt, Artificial Sequence
  targeting sequence with CTCN PAM
cucccuugcacugacugagu

SEQ ID NO: 14016 - RNA, 20 nt, Artificial Sequence
  targeting sequence with CTCN PAM
cuugcacugacugagucugc

SEQ ID NO: 14017 - RNA, 20 nt, Artificial Sequence
  targeting sequence with CTCN PAM
gucagugcaagggagcgagg

SEQ ID NO: 14018 - RNA, 20 nt, Artificial Sequence
  targeting sequence with CTCN PAM
caggugcugccacccccagg

SEQ ID NO: 14019 - RNA, 20 nt, Artificial Sequence
  targeting sequence with CTCN PAM
caguguggccccugggggug

SEQ ID NO: 14020 - RNA, 20 nt, Artificial Sequence
  targeting sequence with CTCN PAM
ucccaguguggccccugggg

SEQ ID NO: 14021 - RNA, 20 nt, Artificial Sequence
  targeting sequence with CTCN PAM
gagagcugcuugcugaagga

SEQ ID NO: 14022 - RNA, 20 nt, Artificial Sequence
  targeting sequence with CTCN PAM
gagcuucccuccucccagug

SEQ ID NO: 14023 - RNA, 20 nt, Artificial Sequence
  targeting sequence with CTCN PAM
cugagcuucccuccucccag

SEQ ID NO: 14024 - RNA, 20 nt, Artificial Sequence
  targeting sequence with CTCN PAM
gccacccaggcucccucagg

SEQ ID NO: 14025 - RNA, 20 nt, Artificial Sequence
  targeting sequence with CTCN PAM
cucaggugccacagaugaua

SEQ ID NO: 14026 - RNA, 20 nt, Artificial Sequence
  targeting sequence with CTCN PAM
ggugccacagaugauaugug

SEQ ID NO: 14027 - RNA, 20 nt, Artificial Sequence
  targeting sequence with CTCN PAM
aacuugguaccagcaguccc

SEQ ID NO: 14028 - RNA, 20 nt, Artificial Sequence
  targeting sequence with CTCN PAM
cugcaggaccccugcuggcc

SEQ ID NO: 14029 - RNA, 20 nt, Artificial Sequence
  targeting sequence with CTCN PAM
guuaccagccccaccacugu

SEQ ID NO: 14030 - RNA, 20 nt, Artificial Sequence
  targeting sequence with CTCN PAM
cacagugguggggcugguaa

SEQ ID NO: 14031 - RNA, 20 nt, Artificial Sequence
  targeting sequence with CTCN PAM
cccacagugguggggcuggu

SEQ ID NO: 14032 - RNA, 20 nt, Artificial Sequence
  targeting sequence with CTCN PAM
aggugagucugacccgcccu

SEQ ID NO: 14033 - RNA, 20 nt, Artificial Sequence
  targeting sequence with CTCN PAM
ccuggaggucccuggaaacc

SEQ ID NO: 14034 - RNA, 20 nt, Artificial Sequence
  targeting sequence with CTCN PAM
cgccccugucugcuccauca

SEQ ID NO: 14035 - RNA, 20 nt, Artificial Sequence
  targeting sequence with CTCN PAM
ccccugucugcuccaucaca

SEQ ID NO: 14036 - RNA, 20 nt, Artificial Sequence
  targeting sequence with CTCN PAM
aucacaagugcccgcagacc

SEQ ID NO: 14037 - RNA, 20 nt, Artificial Sequence
  targeting sequence with CTCN PAM
aggaucccugggcccauccc

SEQ ID NO: 14038 - RNA, 20 nt, Artificial Sequence
  targeting sequence with CTCN PAM
gugccuacccgcaguggcuc

SEQ ID NO: 14039 - RNA, 20 nt, Artificial Sequence
  targeting sequence with CTCN PAM
cagggcccgcaugugcuucc

SEQ ID NO: 14040 - RNA, 20 nt, Artificial Sequence
  targeting sequence with CTCN PAM
cagggccagugggaagcaca

SEQ ID NO: 14041 - RNA, 20 nt, Artificial Sequence
  targeting sequence with CTCN PAM
caggccacacacaccauagc

SEQ ID NO: 14042 - RNA, 20 nt, Artificial Sequence
  targeting sequence with CTCN PAM
cccauuccccucgcaggcca

SEQ ID NO: 14043 - RNA, 20 nt, Artificial Sequence
  targeting sequence with CTCN PAM
gcuggcccugcugcccucac

SEQ ID NO: 14044 - RNA, 20 nt, Artificial Sequence
  targeting sequence with CTCN PAM
ggccaaggaaucagaaggaa

SEQ ID NO: 14045 - RNA, 20 nt, Artificial Sequence
  targeting sequence with CTCN PAM
guuccuccaccuggaaaacu

SEQ ID NO: 14046 - RNA, 20 nt, Artificial Sequence
  targeting sequence with CTCN PAM
accuggaaaacucuuccacu

SEQ ID NO: 14047 - RNA, 20 nt, Artificial Sequence
  targeting sequence with CTCN PAM
uccacuggucuggcugcccu

SEQ ID NO: 14048 - RNA, 20 nt, Artificial Sequence
  targeting sequence with CTCN PAM
agggcagccagaccagugga

SEQ ID NO: 14049 - RNA, 20 nt, Artificial Sequence
  targeting sequence with CTCN PAM
cagggguguaggguggaggc

SEQ ID NO: 14050 - RNA, 20 nt, Artificial Sequence
  targeting sequence with CTCN PAM
acccuacaccccugugagaa

SEQ ID NO: 14051 - RNA, 20 nt, Artificial Sequence
  targeting sequence with CTCN PAM
aucucugcuucugauuccau

SEQ ID NO: 14052 - RNA, 20 nt, Artificial Sequence
  targeting sequence with CTCN PAM
gcuucugauuccauccuuga

SEQ ID NO: 14053 - RNA, 20 nt, Artificial Sequence
  targeting sequence with CTCN PAM
aggcucccagauucugcggc

SEQ ID NO: 14054 - RNA, 20 nt, Artificial Sequence
  targeting sequence with CTCN PAM
cagauucugcggcuagugga

SEQ ID NO: 14055 - RNA, 20 nt, Artificial Sequence
  targeting sequence with CTCN PAM
acuagccgcagaaucuggga

SEQ ID NO: 14056 - RNA, 20 nt, Artificial Sequence
  targeting sequence with CTCN PAM
aucggagaugaggacccguu

SEQ ID NO: 14057 - RNA, 20 nt, Artificial Sequence
  targeting sequence with CTCN PAM
gauggaguccuuggucucca

SEQ ID NO: 14058 - RNA, 20 nt, Artificial Sequence
  targeting sequence with CTCN PAM
ucuccgauggaguccuuggu

SEQ ID NO: 14059 - RNA, 20 nt, Artificial Sequence
  targeting sequence with CTCN PAM
gcuuagcugugaacgggucc

SEQ ID NO: 14060 - RNA, 20 nt, Artificial Sequence
  targeting sequence with CTCN PAM
aagcucagcuuagcugugaa

SEQ ID NO: 14061 - RNA, 20 nt, Artificial Sequence
  targeting sequence with CTCN PAM
ccucaaagcucagcuuagcu

SEQ ID NO: 14062 - RNA, 20 nt, Artificial Sequence
  targeting sequence with CTCN PAM
cugggugaccugcaggaggg

SEQ ID NO: 14063 - RNA, 20 nt, Artificial Sequence
  targeting sequence with CTCN PAM
gggugaccugcaggagggca

SEQ ID NO: 14064 - RNA, 20 nt, Artificial Sequence
  targeting sequence with CTCN PAM
ugcaggucacccagagaggc

SEQ ID NO: 14065 - RNA, 20 nt, Artificial Sequence
  targeting sequence with CTCN PAM
aucccuucuccugugcacau

SEQ ID NO: 14066 - RNA, 20 nt, Artificial Sequence
  targeting sequence with CTCN PAM
ugugcacauggggacccuca

SEQ ID NO: 14067 - RNA, 20 nt, Artificial Sequence
  targeting sequence with CTCN PAM
gcuagcgcagugguggagga

SEQ ID NO: 14068 - RNA, 20 nt, Artificial Sequence
  targeting sequence with CTCN PAM
accacugcgcuagcugaggg

SEQ ID NO: 14069 - RNA, 20 nt, Artificial Sequence
  targeting sequence with CTCN PAM
uccaccacugcgcuagcuga

SEQ ID NO: 14070 - RNA, 20 nt, Artificial Sequence
  targeting sequence with CTCN PAM
uucgugccaccacaucugga

SEQ ID NO: 14071 - RNA, 20 nt, Artificial Sequence
  targeting sequence with CTCN PAM
cacaccccacaggaaggggu

SEQ ID NO: 14072 - RNA, 20 nt, Artificial Sequence
  targeting sequence with CTCN PAM
ggggcagccauggcucccac

SEQ ID NO: 14073 - RNA, 20 nt, Artificial Sequence
  targeting sequence with CTCN PAM
cuguccacagaccugcgccc

SEQ ID NO: 14074 - RNA, 20 nt, Artificial Sequence
  targeting sequence with CTCN PAM
ggugggaggagcuugccacu

SEQ ID NO: 14075 - RNA, 20 nt, Artificial Sequence
  targeting sequence with CTCN PAM
caccagagcugaagcugccu

SEQ ID NO: 14076 - RNA, 20 nt, Artificial Sequence
  targeting sequence with CTCN PAM
ucccaccagagcugaagcug

SEQ ID NO: 14077 - RNA, 20 nt, Artificial Sequence
  targeting sequence with CTCN PAM
cucaccacugccaaagauuc

SEQ ID NO: 14078 - RNA, 20 nt, Artificial Sequence
  targeting sequence with CTCN PAM
caccacugccaaagauucca

SEQ ID NO: 14079 - RNA, 20 nt, Artificial Sequence
  targeting sequence with CTCN PAM
ccacugccaaagauuccagg

SEQ ID NO: 14080 - RNA, 20 nt, Artificial Sequence
  targeting sequence with CTCN PAM
cuguggcugagugaggacac

SEQ ID NO: 14081 - RNA, 20 nt, Artificial Sequence
  targeting sequence with CTCN PAM
gccacagugagacaucugug

SEQ ID NO: 14082 - RNA, 20 nt, Artificial Sequence
  targeting sequence with CTCN PAM
cucagccacagugagacauc

SEQ ID NO: 14083 - RNA, 20 nt, Artificial Sequence
  targeting sequence with CTCN PAM
uucccgcccacccugcagca

SEQ ID NO: 14084 - RNA, 20 nt, Artificial Sequence
  targeting sequence with CTCN PAM
gaguucgugccagugguggu

SEQ ID NO: 14085 - RNA, 20 nt, Artificial Sequence
  targeting sequence with CTCN PAM
gagccaccuugcugcagggu

SEQ ID NO: 14086 - RNA, 20 nt, Artificial Sequence
  targeting sequence with CTCN PAM
ccaccacuggcacgaacucu

SEQ ID NO: 14087 - RNA, 20 nt, Artificial Sequence
  targeting sequence with CTCN PAM
augagccgccgggauguccu

SEQ ID NO: 14088 - RNA, 20 nt, Artificial Sequence
  targeting sequence with CTCN PAM
uggagcgcagcaccagccgg

SEQ ID NO: 14089 - RNA, 20 nt, Artificial Sequence
  targeting sequence with CTCN PAM
ucaagcgauggcccccaccc

SEQ ID NO: 14090 - RNA, 20 nt, Artificial Sequence
  targeting sequence with CTCN PAM
ggggugggggccaucgcuug

SEQ ID NO: 14091 - RNA, 20 nt, Artificial Sequence
  targeting sequence with CTCN PAM
cugcugccugacgccuccau

SEQ ID NO: 14092 - RNA, 20 nt, Artificial Sequence
  targeting sequence with CTCN PAM
auuaccaugugccccuccug

SEQ ID NO: 14093 - RNA, 20 nt, Artificial Sequence
  targeting sequence with CTCN PAM
ugcuuccagguagguggcca

SEQ ID NO: 14094 - RNA, 20 nt, Artificial Sequence
  targeting sequence with CTCN PAM
caugugcuucucuuggccac

SEQ ID NO: 14095 - RNA, 20 nt, Artificial Sequence
  targeting sequence with CTCN PAM
uggccacuuuucccuugccc

SEQ ID NO: 14096 - RNA, 20 nt, Artificial Sequence
  targeting sequence with CTCN PAM
gggaggcguggccccuggga

SEQ ID NO: 14097 - RNA, 20 nt, Artificial Sequence
  targeting sequence with CTCN PAM
cagagggacauuugggcaag

SEQ ID NO: 14098 - RNA, 20 nt, Artificial Sequence
  targeting sequence with CTCN PAM
caggggccacgccucccaga

SEQ ID NO: 14099 - RNA, 20 nt, Artificial Sequence
  targeting sequence with CTCN PAM
ucccaggggccacgccuccc

SEQ ID NO: 14100 - RNA, 20 nt, Artificial Sequence
  targeting sequence with CTCN PAM
aaguugggacagaggcuugu

SEQ ID NO: 14101 - RNA, 20 nt, Artificial Sequence
  targeting sequence with CTCN PAM
gucccaacuuggagccaugg

SEQ ID NO: 14102 - RNA, 20 nt, Artificial Sequence
  targeting sequence with CTCN PAM
ccccugcuugcauuccaugu

SEQ ID NO: 14103 - RNA, 20 nt, Artificial Sequence
  targeting sequence with CTCN PAM
ccugcuugcauuccaugugc

SEQ ID NO: 14104 - RNA, 20 nt, Artificial Sequence
  targeting sequence with CTCN PAM
ccaaauccugggggcccagc

SEQ ID NO: 14105 - RNA, 20 nt, Artificial Sequence
  targeting sequence with CTCN PAM
gaaaacaagaaaccccacag

SEQ ID NO: 14106 - RNA, 20 nt, Artificial Sequence
  targeting sequence with CTCN PAM
caucuccccuuccagcccuc

SEQ ID NO: 14107 - RNA, 20 nt, Artificial Sequence
  targeting sequence with CTCN PAM
ccuuccagcccucaaacaaa

SEQ ID NO: 14108 - RNA, 20 nt, Artificial Sequence
  targeting sequence with CTCN PAM
aacaaaggugcugcaggucu

SEQ ID NO: 14109 - RNA, 20 nt, Artificial Sequence
  targeting sequence with CTCN PAM
ccuugagaggcagugcgucc

SEQ ID NO: 14110 - RNA, 20 nt, Artificial Sequence
  targeting sequence with CTCN PAM
aggggagggggcuuggcagu

SEQ ID NO: 14111 - RNA, 20 nt, Artificial Sequence
  targeting sequence with CTCN PAM
caaggggagggggcuuggca

SEQ ID NO: 14112 - RNA, 20 nt, Artificial Sequence
  targeting sequence with CTCN PAM
ucagcccuacgccuggggcc

SEQ ID NO: 14113 - RNA, 20 nt, Artificial Sequence
  targeting sequence with CTCN PAM
gaauggaacaucuaagggaa

SEQ ID NO: 14114 - RNA, 20 nt, Artificial Sequence
  targeting sequence with CTCN PAM
uaguccucagaauggaacau

SEQ ID NO: 14115 - RNA, 20 nt, Artificial Sequence
  targeting sequence with CTCN PAM
gcccgccuuggggucugcug

SEQ ID NO: 14116 - RNA, 20 nt, Artificial Sequence
  targeting sequence with CTCN PAM
uucacagcccagcagacccc

SEQ ID NO: 14117 - RNA, 20 nt, Artificial Sequence
  targeting sequence with CTCN PAM
uuauucuccuucacagccca

SEQ ID NO: 14118 - RNA, 20 nt, Artificial Sequence
  targeting sequence with CTCN PAM
uggugcuauuuacaaggcau

SEQ ID NO: 14119 - RNA, 20 nt, Artificial Sequence
  targeting sequence with CTCN PAM
ucuccuggugcuauuuacaa

SEQ ID NO: 14120 - RNA, 20 nt, Artificial Sequence
  targeting sequence with CTCN PAM
uccucaucuccuggugcuau

SEQ ID NO: 14121 - RNA, 20 nt, Artificial Sequence
  targeting sequence with CTCN PAM
gaguuguucguggcagccug

SEQ ID NO: 14122 - RNA, 20 nt, Artificial Sequence
  targeting sequence with CTCN PAM
gagccguucugaaaguaaca

SEQ ID NO: 14123 - RNA, 20 nt, Artificial Sequence
  targeting sequence with CTCN PAM
agcaggcugccacgaacaac

SEQ ID NO: 14124 - RNA, 20 nt, Artificial Sequence
  targeting sequence with CTCN PAM
auaaugacaaaagggcuccu

SEQ ID NO: 14125 - RNA, 20 nt, Artificial Sequence
  targeting sequence with CTCN PAM
uuauuuucaucagcaucuac

SEQ ID NO: 14126 - RNA, 20 nt, Artificial Sequence
  targeting sequence with CTCN PAM
uaacauuuaaucaaaauggc

SEQ ID NO: 14127 - RNA, 20 nt, Artificial Sequence
  targeting sequence with CTCN PAM
cccaccccuuucuauauugc

SEQ ID NO: 14128 - RNA, 20 nt, Artificial Sequence
  targeting sequence with CTCN PAM
ugucaagauggauccccauu

SEQ ID NO: 14129 - RNA, 20 nt, Artificial Sequence
  targeting sequence with CTCN PAM
ugccaucuucuuuggaccca

SEQ ID NO: 14130 - RNA, 20 nt, Artificial Sequence
  targeting sequence with CTCN PAM
uguuugguagcccagucaag

SEQ ID NO: 14131 - RNA, 20 nt, Artificial Sequence
  targeting sequence with CTCN PAM
uguccaggcucuggagccgc

SEQ ID NO: 14132 - RNA, 20 nt, Artificial Sequence
  targeting sequence with CTCN PAM
ggagccgcccucuuccaucc

SEQ ID NO: 14133 - RNA, 20 nt, Artificial Sequence
  targeting sequence with CTCN PAM
agagccuggacaggagccuu

SEQ ID NO: 14134 - RNA, 20 nt, Artificial Sequence
  targeting sequence with CTCN PAM
uccauccaccuuccccagcc

SEQ ID NO: 14135 - RNA, 20 nt, Artificial Sequence
  targeting sequence with CTCN PAM
guggggcuggggaaggugga

SEQ ID NO: 14136 - RNA, 20 nt, Artificial Sequence
  targeting sequence with CTCN PAM
auugggcuggggcugcucug

SEQ ID NO: 14137 - RNA, 20 nt, Artificial Sequence
  targeting sequence with CTCN PAM
ucccuuuggaacagcuccuu

SEQ ID NO: 14138 - RNA, 20 nt, Artificial Sequence
  targeting sequence with CTCN PAM
uuaagcaggggguuuccguu

SEQ ID NO: 14139 - RNA, 20 nt, Artificial Sequence
  targeting sequence with CTCN PAM
aacggaaacccccugcuuaa

SEQ ID NO: 14140 - RNA, 20 nt, Artificial Sequence
  targeting sequence with CTCN PAM
ggcaucacugguguccaguc

SEQ ID NO: 14141 - RNA, 20 nt, Artificial Sequence
  targeting sequence with CTCN PAM
agcuguuggacuggacacca

SEQ ID NO: 14142 - RNA, 20 nt, Artificial Sequence
  targeting sequence with CTCN PAM
uuagcuucugugugcuguuc

SEQ ID NO: 14143 - RNA, 20 nt, Artificial Sequence
  targeting sequence with CTCN PAM
cauguaugggggacguuuuu

SEQ ID NO: 14144 - RNA, 20 nt, Artificial Sequence
  targeting sequence with CTCN PAM
ggccucucagcagcccugug

SEQ ID NO: 14145 - RNA, 20 nt, Artificial Sequence
  targeting sequence with CTCN PAM
cagcagcccugugaaggaag

SEQ ID NO: 14146 - RNA, 20 nt, Artificial Sequence
  targeting sequence with CTCN PAM
gcagcccugugaaggaagag

SEQ ID NO: 14147 - RNA, 20 nt, Artificial Sequence
  targeting sequence with CTCN PAM
uccuucacagggcugcugag

SEQ ID NO: 14148 - RNA, 20 nt, Artificial Sequence
  targeting sequence with CTCN PAM
agcccugggaggggcggccc

SEQ ID NO: 14149 - RNA, 20 nt, Artificial Sequence
  targeting sequence with CTCN PAM
cagggcuggaggcagccccu

SEQ ID NO: 14150 - RNA, 20 nt, Artificial Sequence
  targeting sequence with CTCN PAM
ggcagguggacuggggguga

SEQ ID NO: 14151 - RNA, 20 nt, Artificial Sequence
  targeting sequence with CTCN PAM
ugccugugccagcuguucuu

SEQ ID NO: 14152 - RNA, 20 nt, Artificial Sequence
  targeting sequence with CTCN PAM
ccugccugugccagcuguuc

SEQ ID NO: 14153 - RNA, 20 nt, Artificial Sequence
  targeting sequence with CTCN PAM
cuccugccugugccagcugu

SEQ ID NO: 14154 - RNA, 20 nt, Artificial Sequence
  targeting sequence with CTCN PAM
ccucgugcugcaguauugau

SEQ ID NO: 14155 - RNA, 20 nt, Artificial Sequence
  targeting sequence with CTCN PAM
ugcugcaguauugauuccuu

SEQ ID NO: 14156 - RNA, 20 nt, Artificial Sequence
  targeting sequence with CTCN PAM
agugggcauauuugcccugc

SEQ ID NO: 14157 - RNA, 20 nt, Artificial Sequence
  targeting sequence with CTCN PAM
gugucugcgucccuccagug

SEQ ID NO: 14158 - RNA, 20 nt, Artificial Sequence
  targeting sequence with CTCN PAM
uuggggucucagugucugcg

SEQ ID NO: 14159 - RNA, 20 nt, Artificial Sequence
  targeting sequence with CTCN PAM
ccuuggggucucagugucug

SEQ ID NO: 14160 - RNA, 20 nt, Artificial Sequence
  targeting sequence with CTCN PAM
gcagccacucuccuuggggu

SEQ ID NO: 14161 - RNA, 20 nt, Artificial Sequence
  targeting sequence with CTCN PAM
gacacuucccacugggggcc

SEQ ID NO: 14162 - RNA, 20 nt, Artificial Sequence
  targeting sequence with CTCN PAM
agcuccgacacuucccacug

SEQ ID NO: 14163 - RNA, 20 nt, Artificial Sequence
  targeting sequence with CTCN PAM
gggauggggcucuagcuccg

SEQ ID NO: 14164 - RNA, 20 nt, Artificial Sequence
  targeting sequence with CTCN PAM
ucccugccucccuccgcauc

SEQ ID NO: 14165 - RNA, 20 nt, Artificial Sequence
  targeting sequence with CTCN PAM
cugccucccuccgcaucucu

SEQ ID NO: 14166 - RNA, 20 nt, Artificial Sequence
  targeting sequence with CTCN PAM
cuccgcaucucucuggagau

SEQ ID NO: 14167 - RNA, 20 nt, Artificial Sequence
  targeting sequence with CTCN PAM
gcaucucucuggagaugaug

SEQ ID NO: 14168 - RNA, 20 nt, Artificial Sequence
  targeting sequence with CTCN PAM
cuggagaugauggaggaaaa

SEQ ID NO: 14169 - RNA, 20 nt, Artificial Sequence
  targeting sequence with CTCN PAM
ggagaugauggaggaaaaua

SEQ ID NO: 14170 - RNA, 20 nt, Artificial Sequence
  targeting sequence with CTCN PAM
agagagaugcggagggaggc

SEQ ID NO: 14171 - RNA, 20 nt, Artificial Sequence
  targeting sequence with CTCN PAM
aucaucuccagagagaugcg

SEQ ID NO: 14172 - RNA, 20 nt, Artificial Sequence
  targeting sequence with CTCN PAM
cuuucuuuauuuuccuccau

SEQ ID NO: 14173 - RNA, 20 nt, Artificial Sequence
  targeting sequence with CTCN PAM
uccgucgagugucuaauuac

SEQ ID NO: 14174 - RNA, 20 nt, Artificial Sequence
  targeting sequence with CTCN PAM
gucgagugucuaauuacuua

SEQ ID NO: 14175 - RNA, 20 nt, Artificial Sequence
  targeting sequence with CTCN PAM
acggaggaguucuguuggca

SEQ ID NO: 14176 - RNA, 20 nt, Artificial Sequence
  targeting sequence with CTCN PAM
cucacuaaacauuuauuaau

SEQ ID NO: 14177 - RNA, 20 nt, Artificial Sequence
  targeting sequence with CTCN PAM
cacuaaacauuuauuaaugu

SEQ ID NO: 14178 - RNA, 20 nt, Artificial Sequence
  targeting sequence with CTCN PAM
cuaaacauuuauuaaugugu

SEQ ID NO: 14179 - RNA, 20 nt, Artificial Sequence
  targeting sequence with CTCN PAM
ccuuuuucccagccauaugc

SEQ ID NO: 14180 - RNA, 20 nt, Artificial Sequence
  targeting sequence with CTCN PAM
ccccuuuuucccagccauau

SEQ ID NO: 14181 - RNA, 20 nt, Artificial Sequence
  targeting sequence with CTCN PAM
cucuccccuuuuucccagcc

SEQ ID NO: 14182 - RNA, 20 nt, Artificial Sequence
  targeting sequence with CTCN PAM
agcuacccagcagucaauca

SEQ ID NO: 14183 - RNA, 20 nt, Artificial Sequence
  targeting sequence with CTCN PAM
agccagggaccaucugaucu

SEQ ID NO: 14184 - RNA, 20 nt, Artificial Sequence
  targeting sequence with CTCN PAM
ccugccuccagccagggacc

SEQ ID NO: 14185 - RNA, 20 nt, Artificial Sequence
  targeting sequence with CTCN PAM
gcuggaacccuccccugccu

SEQ ID NO: 14186 - RNA, 20 nt, Artificial Sequence
  targeting sequence with CTCN PAM
agcaugcauccccucagccg

SEQ ID NO: 14187 - RNA, 20 nt, Artificial Sequence
  targeting sequence with CTCN PAM
gccgaagaacacaaaaauga

SEQ ID NO: 14188 - RNA, 20 nt, Artificial Sequence
  targeting sequence with CTCN PAM
uuuuuguguucuucggcuga

SEQ ID NO: 14189 - RNA, 20 nt, Artificial Sequence
  targeting sequence with CTCN PAM
gcugccccaggaagcucagc

SEQ ID NO: 14190 - RNA, 20 nt, Artificial Sequence
  targeting sequence with CTCN PAM
gcucuagaggccugaguagg

SEQ ID NO: 14191 - RNA, 20 nt, Artificial Sequence
  targeting sequence with CTCN PAM
agaggccugaguaggacccc

SEQ ID NO: 14192 - RNA, 20 nt, Artificial Sequence
  targeting sequence with CTCN PAM
agagcugagcuuccuggggc

SEQ ID NO: 14193 - RNA, 20 nt, Artificial Sequence
  targeting sequence with CTCN PAM
ggccucuagagcugagcuuc

SEQ ID NO: 14194 - RNA, 20 nt, Artificial Sequence
  targeting sequence with CTCN PAM
gugucaucaccuguguaaua

SEQ ID NO: 14195 - RNA, 20 nt, Artificial Sequence
  targeting sequence with CTCN PAM
gucauguuauuuuucauuca

SEQ ID NO: 14196 - RNA, 20 nt, Artificial Sequence
  targeting sequence with CTCN PAM
cucagccugaucugggucug

SEQ ID NO: 14197 - RNA, 20 nt, Artificial Sequence
  targeting sequence with CTCN PAM
cagccugaucugggucugaa

SEQ ID NO: 14198 - RNA, 20 nt, Artificial Sequence
  targeting sequence with CTCN PAM
gccugaucugggucugaacc

SEQ ID NO: 14199 - RNA, 20 nt, Artificial Sequence
  targeting sequence with CTCN PAM
aaggcuguuuccccaucugc

SEQ ID NO: 14200 - RNA, 20 nt, Artificial Sequence
  targeting sequence with CTCN PAM
agcucugacucugagguucc

SEQ ID NO: 14201 - RNA, 20 nt, Artificial Sequence
  targeting sequence with CTCN PAM
gacucugagguuccagccuc

SEQ ID NO: 14202 - RNA, 20 nt, Artificial Sequence
  targeting sequence with CTCN PAM
gagguuccagccucagucug

SEQ ID NO: 14203 - RNA, 20 nt, Artificial Sequence
  targeting sequence with CTCN PAM
gagucagagcuggagggggc

SEQ ID NO: 14204 - RNA, 20 nt, Artificial Sequence
  targeting sequence with CTCN PAM
gucugcgucugugaacagcg

SEQ ID NO: 14205 - RNA, 20 nt, Artificial Sequence
  targeting sequence with CTCN PAM
agugccugugacaaggaagg

SEQ ID NO: 14206 - RNA, 20 nt, Artificial Sequence
  targeting sequence with CTCN PAM
uaguucaaugggcaucacca

SEQ ID NO: 14207 - RNA, 20 nt, Artificial Sequence
  targeting sequence with CTCN PAM
guguccucuuaguucaaugg

SEQ ID NO: 14208 - RNA, 20 nt, Artificial Sequence
  targeting sequence with CTCN PAM
ggccucaguguccucuuagu

SEQ ID NO: 14209 - RNA, 20 nt, Artificial Sequence
  targeting sequence with CTCN PAM
cuggccucaguguccucuua

SEQ ID NO: 14210 - RNA, 20 nt, Artificial Sequence
  targeting sequence with CTCN PAM
ucucuggccucaguguccuc

SEQ ID NO: 14211 - RNA, 20 nt, Artificial Sequence
  targeting sequence with CTCN PAM
ggaggcugagguggaaggau

SEQ ID NO: 14212 - RNA, 20 nt, Artificial Sequence
  targeting sequence with CTCN PAM
ugaguaguugggacuacagg

SEQ ID NO: 14213 - RNA, 20 nt, Artificial Sequence
  targeting sequence with CTCN PAM
gccuccugaguaguugggac

SEQ ID NO: 14214 - RNA, 20 nt, Artificial Sequence
  targeting sequence with CTCN PAM
auugauccuuccaccucagc

SEQ ID NO: 14215 - RNA, 20 nt, Artificial Sequence
  targeting sequence with CTCN PAM
agccugggcaacagagcaac

SEQ ID NO: 14216 - RNA, 20 nt, Artificial Sequence
  targeting sequence with CTCN PAM
guugcccaggcuggagugca

SEQ ID NO: 14217 - RNA, 20 nt, Artificial Sequence
  targeting sequence with CTCN PAM
aaacaacauuuaaaaauugu

SEQ ID NO: 14218 - RNA, 20 nt, Artificial Sequence
  targeting sequence with CTCN PAM
uuugucuucuuaaaacaauu

SEQ ID NO: 14219 - RNA, 20 nt, Artificial Sequence
  targeting sequence with CTCN PAM
caccuguaaucucagcacuu

SEQ ID NO: 14220 - RNA, 20 nt, Artificial Sequence
  targeting sequence with CTCN PAM
gcacuuugggaggccaaggc

SEQ ID NO: 14221 - RNA, 20 nt, Artificial Sequence
  targeting sequence with CTCN PAM
caaagugcugagauuacagg

SEQ ID NO: 14222 - RNA, 20 nt, Artificial Sequence
  targeting sequence with CTCN PAM
ugccuuggccucccaaagug

SEQ ID NO: 14223 - RNA, 20 nt, Artificial Sequence
  targeting sequence with CTCN PAM
agcgauccuccugccuuggc

SEQ ID NO: 14224 - RNA, 20 nt, Artificial Sequence
  targeting sequence with CTCN PAM
cggcucaagcgauccuccug

SEQ ID NO: 14225 - RNA, 20 nt, Artificial Sequence
  targeting sequence with CTCN PAM
aacucccggcucaagcgauc

SEQ ID NO: 14226 - RNA, 20 nt, Artificial Sequence
  targeting sequence with CTCN PAM
gacaauauagggagacccca

SEQ ID NO: 14227 - RNA, 20 nt, Artificial Sequence
  targeting sequence with CTCN PAM
cuauauugucugagcugguc

SEQ ID NO: 14228 - RNA, 20 nt, Artificial Sequence
  targeting sequence with CTCN PAM
caucuccaagugcucaacau

SEQ ID NO: 14229 - RNA, 20 nt, Artificial Sequence
  targeting sequence with CTCN PAM
ucuccaagugcucaacauug

SEQ ID NO: 14230 - RNA, 20 nt, Artificial Sequence
  targeting sequence with CTCN PAM
aagugcucaacauugugccc

SEQ ID NO: 14231 - RNA, 20 nt, Artificial Sequence
  targeting sequence with CTCN PAM
acauugugcccauguucuug

SEQ ID NO: 14232 - RNA, 20 nt, Artificial Sequence
  targeting sequence with CTCN PAM
uuccaagaacaugggcacaa

SEQ ID NO: 14233 - RNA, 20 nt, Artificial Sequence
  targeting sequence with CTCN PAM
cuuacuuccuccuuccaaga

SEQ ID NO: 14234 - RNA, 20 nt, Artificial Sequence
  targeting sequence with CTCN PAM
cccuuacuuccuccuuccaa

SEQ ID NO: 14235 - RNA, 20 nt, Artificial Sequence
  targeting sequence with CTCN PAM
gucuaccucucccuuacuuc

SEQ ID NO: 14236 - RNA, 20 nt, Artificial Sequence
  targeting sequence with CTCN PAM
gguggaccugacuggagacg

SEQ ID NO: 14237 - RNA, 20 nt, Artificial Sequence
  targeting sequence with CTCN PAM
agucagguccaccugaggcu

SEQ ID NO: 14238 - RNA, 20 nt, Artificial Sequence
  targeting sequence with CTCN PAM
ggcagcuggagguccccggg

SEQ ID NO: 14239 - RNA, 20 nt, Artificial Sequence
  targeting sequence with CTCN PAM
agcugccugaggugcgucuc

SEQ ID NO: 14240 - RNA, 20 nt, Artificial Sequence
  targeting sequence with CTCN PAM
uagcuucacagccuugcugg

SEQ ID NO: 14241 - RNA, 20 nt, Artificial Sequence
  targeting sequence with CTCN PAM
gcccaccugugugacagcca

SEQ ID NO: 14242 - RNA, 20 nt, Artificial Sequence
  targeting sequence with CTCN PAM
uccaaggucgcucugugucu

SEQ ID NO: 14243 - RNA, 20 nt, Artificial Sequence
  targeting sequence with CTCN PAM
aaggucgcucugugucucuu

SEQ ID NO: 14244 - RNA, 20 nt, Artificial Sequence
  targeting sequence with CTCN PAM
gugucucuucccuggcuugg

SEQ ID NO: 14245 - RNA, 20 nt, Artificial Sequence
  targeting sequence with CTCN PAM
ucccuggcuuggagucugug

SEQ ID NO: 14246 - RNA, 20 nt, Artificial Sequence
  targeting sequence with CTCN PAM
aagccagggaagagacacag

SEQ ID NO: 14247 - RNA, 20 nt, Artificial Sequence
  targeting sequence with CTCN PAM
gcugugggcacacagacucc

SEQ ID NO: 14248 - RNA, 20 nt, Artificial Sequence
  targeting sequence with CTCN PAM
ggguaagcacccugcccagu

SEQ ID NO: 14249 - RNA, 20 nt, Artificial Sequence
  targeting sequence with CTCN PAM
cugauucucccccugcagau

SEQ ID NO: 14250 - RNA, 20 nt, Artificial Sequence
  targeting sequence with CTCN PAM
cccugcagauccagaacacu

SEQ ID NO: 14251 - RNA, 20 nt, Artificial Sequence
  targeting sequence with CTCN PAM
auaccaggccaguguucugg

SEQ ID NO: 14252 - RNA, 20 nt, Artificial Sequence
  targeting sequence with CTCN PAM
ucauggcccucccugcuugc

SEQ ID NO: 14253 - RNA, 20 nt, Artificial Sequence
  targeting sequence with CTCN PAM
cugcuugccacccgcaguag

SEQ ID NO: 14254 - RNA, 20 nt, Artificial Sequence
  targeting sequence with CTCN PAM
auccccagcacgccacccug

SEQ ID NO: 14255 - RNA, 20 nt, Artificial Sequence
  targeting sequence with CTCN PAM
aggcccagcuggcccucccu

SEQ ID NO: 14256 - RNA, 20 nt, Artificial Sequence
  targeting sequence with CTCN PAM
cuaccugcccugcuugggag

SEQ ID NO: 14257 - RNA, 20 nt, Artificial Sequence
  targeting sequence with CTCN PAM
caagcagggcagguagggag

SEQ ID NO: 14258 - RNA, 20 nt, Artificial Sequence
  targeting sequence with CTCN PAM
uuugacccuccugguccacc

SEQ ID NO: 14259 - RNA, 20 nt, Artificial Sequence
  targeting sequence with CTCN PAM
ugguccaccuuuugcuccuc

SEQ ID NO: 14260 - RNA, 20 nt, Artificial Sequence
  targeting sequence with CTCN PAM
ucugggcucccacagcacug

SEQ ID NO: 14261 - RNA, 20 nt, Artificial Sequence
  targeting sequence with CTCN PAM
gggcucccacagcacuggga

SEQ ID NO: 14262 - RNA, 20 nt, Artificial Sequence
  targeting sequence with CTCN PAM
cacagcacugggacugggag

SEQ ID NO: 14263 - RNA, 20 nt, Artificial Sequence
  targeting sequence with CTCN PAM
cagucccagugcugugggag

SEQ ID NO: 14264 - RNA, 20 nt, Artificial Sequence
  targeting sequence with CTCN PAM
ucucucauguuuaguuuccg

SEQ ID NO: 14265 - RNA, 20 nt, Artificial Sequence
  targeting sequence with CTCN PAM
cauguuuaguuuccgaucag

SEQ ID NO: 14266 - RNA, 20 nt, Artificial Sequence
  targeting sequence with CTCN PAM
uguuuaguuuccgaucagua

SEQ ID NO: 14267 - RNA, 20 nt, Artificial Sequence
  targeting sequence with CTCN PAM
ggggguacugaucggaaacu

SEQ ID NO: 14268 - RNA, 20 nt, Artificial Sequence
  targeting sequence with CTCN PAM
cagucucaggggguacugau

SEQ ID NO: 14269 - RNA, 20 nt, Artificial Sequence
  targeting sequence with CTCN PAM
gcguccccagggccuggcgc

SEQ ID NO: 14270 - RNA, 20 nt, Artificial Sequence
  targeting sequence with CTCN PAM
uuauaugcgccaggcccugg

SEQ ID NO: 14271 - RNA, 20 nt, Artificial Sequence
  targeting sequence with CTCN PAM
uuucuacccuagcauuugcc

SEQ ID NO: 14272 - RNA, 20 nt, Artificial Sequence
  targeting sequence with CTCN PAM
uucucuuuucuacccuagca

SEQ ID NO: 14273 - RNA, 20 nt, Artificial Sequence
  targeting sequence with CTCN PAM
uuccucuuucucuuuucuac

SEQ ID NO: 14274 - RNA, 20 nt, Artificial Sequence
  targeting sequence with CTCN PAM
uucccuccuuccucuuucuc

SEQ ID NO: 14275 - RNA, 20 nt, Artificial Sequence
  targeting sequence with CTCN PAM
cauucccuccuuccucuuuc

SEQ ID NO: 14276 - RNA, 20 nt, Artificial Sequence
  targeting sequence with CTCN PAM
cucccuuauucccccuugau

SEQ ID NO: 14277 - RNA, 20 nt, Artificial Sequence
  targeting sequence with CTCN PAM
cuuauucccccuugaugcuc

SEQ ID NO: 14278 - RNA, 20 nt, Artificial Sequence
  targeting sequence with CTCN PAM
caguaccgcugaaggccuca

SEQ ID NO: 14279 - RNA, 20 nt, Artificial Sequence
  targeting sequence with CTCN PAM
guaccgcugaaggccucaug

SEQ ID NO: 14280 - RNA, 20 nt, Artificial Sequence
  targeting sequence with CTCN PAM
uguagccuuggugacgcagc

SEQ ID NO: 14281 - RNA, 20 nt, Artificial Sequence
  targeting sequence with CTCN PAM
gccccaccaggcugcgucac

SEQ ID NO: 14282 - RNA, 20 nt, Artificial Sequence
  targeting sequence with CTCN PAM
uggucccccacauggcucag

SEQ ID NO: 14283 - RNA, 20 nt, Artificial Sequence
  targeting sequence with CTCN PAM
uccuuggcuuucuuucuccu

SEQ ID NO: 14284 - RNA, 20 nt, Artificial Sequence
  targeting sequence with CTCN PAM
ucuuccuuggcuuucuuucu

SEQ ID NO: 14285 - RNA, 20 nt, Artificial Sequence
  targeting sequence with CTCN PAM
uccucuuccuuggcuuucuu

SEQ ID NO: 14286 - RNA, 20 nt, Artificial Sequence
  targeting sequence with CTCN PAM
uccuccucuuccuuggcuuu

SEQ ID NO: 14287 - RNA, 20 nt, Artificial Sequence
  targeting sequence with CTCN PAM
uccuccuccucuuccuuggc

SEQ ID NO: 14288 - RNA, 20 nt, Artificial Sequence
  targeting sequence with CTCN PAM
uccuccuccuccucuuccuu

SEQ ID NO: 14289 - RNA, 20 nt, Artificial Sequence
  targeting sequence with CTCN PAM
uucuccuccuccuccuccuc

SEQ ID NO: 14290 - RNA, 20 nt, Artificial Sequence
  targeting sequence with CTCN PAM
uccuucuccuccuccuccuc

SEQ ID NO: 14291 - RNA, 20 nt, Artificial Sequence
  targeting sequence with CTCN PAM
ucucacagcagcuccucucu

SEQ ID NO: 14292 - RNA, 20 nt, Artificial Sequence
  targeting sequence with CTCN PAM
cacagcagcuccucucuugc

SEQ ID NO: 14293 - RNA, 20 nt, Artificial Sequence
  targeting sequence with CTCN PAM
cagcagcuccucucuugcag

SEQ ID NO: 14294 - RNA, 20 nt, Artificial Sequence
  targeting sequence with CTCN PAM
ucucuugcagaggcugaaga

SEQ ID NO: 14295 - RNA, 20 nt, Artificial Sequence
  targeting sequence with CTCN PAM
cuugcagaggcugaagagcg

SEQ ID NO: 14296 - RNA, 20 nt, Artificial Sequence
  targeting sequence with CTCN PAM
ugcagaggcugaagagcgau

SEQ ID NO: 14297 - RNA, 20 nt, Artificial Sequence
  targeting sequence with CTCN PAM
gcaagagaggagcugcugug

SEQ ID NO: 14298 - RNA, 20 nt, Artificial Sequence
  targeting sequence with CTCN PAM
ucagccucugcaagagagga

SEQ ID NO: 14299 - RNA, 20 nt, Artificial Sequence
  targeting sequence with CTCN PAM
guggauuaggggcuuagcuu

SEQ ID NO: 14300 - RNA, 20 nt, Artificial Sequence
  targeting sequence with CTCN PAM
cgagggcugggacucgggug

SEQ ID NO: 14301 - RNA, 20 nt, Artificial Sequence
  targeting sequence with CTCN PAM
ggagcccggcuaggggcuuu

SEQ ID NO: 14302 - RNA, 20 nt, Artificial Sequence
  targeting sequence with CTCN PAM
ggugccccaagauggcugca

SEQ ID NO: 14303 - RNA, 20 nt, Artificial Sequence
  targeting sequence with CTCN PAM
ggacugcccgacacaaggug

SEQ ID NO: 14304 - RNA, 20 nt, Artificial Sequence
  targeting sequence with CTCN PAM
gcagaggaacuuugacccug

SEQ ID NO: 14305 - RNA, 20 nt, Artificial Sequence
  targeting sequence with CTCN PAM
gcagagcugggauuugaaca

SEQ ID NO: 14306 - RNA, 20 nt, Artificial Sequence
  targeting sequence with CTCN PAM
guggucaguggggaguuaga

SEQ ID NO: 14307 - RNA, 20 nt, Artificial Sequence
  targeting sequence with CTCN PAM
ccacugaccacugaggaauc

SEQ ID NO: 14308 - RNA, 20 nt, Artificial Sequence
  targeting sequence with CTCN PAM
ucauagggggcaggaggagu

SEQ ID NO: 14309 - RNA, 20 nt, Artificial Sequence
  targeting sequence with CTCN PAM
ugcccccuaugaagaggguc

SEQ ID NO: 14310 - RNA, 20 nt, Artificial Sequence
  targeting sequence with CTCN PAM
uccugcccccuaugaagagg

SEQ ID NO: 14311 - RNA, 20 nt, Artificial Sequence
  targeting sequence with CTCN PAM
uauggguugugagcucagag

SEQ ID NO: 14312 - RNA, 20 nt, Artificial Sequence
  targeting sequence with CTCN PAM
caacccauaggagguguuca

SEQ ID NO: 14313 - RNA, 20 nt, Artificial Sequence
  targeting sequence with CTCN PAM
gaggcagcgaugaacaggcc

SEQ ID NO: 14314 - RNA, 20 nt, Artificial Sequence
  targeting sequence with CTCN PAM
gagcucacaacccauaggag

SEQ ID NO: 14315 - RNA, 20 nt, Artificial Sequence
  targeting sequence with CTCN PAM
uuugucuacuuauugacuga

SEQ ID NO: 14316 - RNA, 20 nt, Artificial Sequence
  targeting sequence with CTCN PAM
ggaugcugagguaggaggau

SEQ ID NO: 14317 - RNA, 20 nt, Artificial Sequence
  targeting sequence with CTCN PAM
gcaucccgaguaacuggguc

SEQ ID NO: 14318 - RNA, 20 nt, Artificial Sequence
  targeting sequence with CTCN PAM
uaccucagcaucccgaguaa

SEQ ID NO: 14319 - RNA, 20 nt, Artificial Sequence
  targeting sequence with CTCN PAM
agugauccuccuaccucagc

SEQ ID NO: 14320 - RNA, 20 nt, Artificial Sequence
  targeting sequence with CTCN PAM
agccugggcaacagagcaag

SEQ ID NO: 14321 - RNA, 20 nt, Artificial Sequence
  targeting sequence with CTCN PAM
guugcccaggcuggagugca

SEQ ID NO: 14322 - RNA, 20 nt, Artificial Sequence
  targeting sequence with CTCN PAM
ucucuaaaaaacauuuaaaa

SEQ ID NO: 14323 - RNA, 20 nt, Artificial Sequence
  targeting sequence with CTCN PAM
aaaaaacauuuaaaaauugu

SEQ ID NO: 14324 - RNA, 20 nt, Artificial Sequence
  targeting sequence with CTCN PAM
uuugucuucuuaaaacaauu

SEQ ID NO: 14325 - RNA, 20 nt, Artificial Sequence
  targeting sequence with CTCN PAM
caccuauaaucucagcacuu

SEQ ID NO: 14326 - RNA, 20 nt, Artificial Sequence
  targeting sequence with CTCN PAM
gcacuuugggaggcugagau

SEQ ID NO: 14327 - RNA, 20 nt, Artificial Sequence
  targeting sequence with CTCN PAM
caaagugcugagauuauagg

SEQ ID NO: 14328 - RNA, 20 nt, Artificial Sequence
  targeting sequence with CTCN PAM
gccucccaaagugcugagau

SEQ ID NO: 14329 - RNA, 20 nt, Artificial Sequence
  targeting sequence with CTCN PAM
caaguggcucccaaggcagg

SEQ ID NO: 14330 - RNA, 20 nt, Artificial Sequence
  targeting sequence with CTCN PAM
caaggcaggaggaucacuug

SEQ ID NO: 14331 - RNA, 20 nt, Artificial Sequence
  targeting sequence with CTCN PAM
ugccuugggagccacuuggg

SEQ ID NO: 14332 - RNA, 20 nt, Artificial Sequence
  targeting sequence with CTCN PAM
agugauccuccugccuuggg

SEQ ID NO: 14333 - RNA, 20 nt, Artificial Sequence
  targeting sequence with CTCN PAM
caggcucaagugauccuccu

SEQ ID NO: 14334 - RNA, 20 nt, Artificial Sequence
  targeting sequence with CTCN PAM
aacucccaggcucaagugau

SEQ ID NO: 14335 - RNA, 20 nt, Artificial Sequence
  targeting sequence with CTCN PAM
cuauauuguccaagcuguuc

SEQ ID NO: 14336 - RNA, 20 nt, Artificial Sequence
  targeting sequence with CTCN PAM
cccuauauuguccaagcugu

SEQ ID NO: 14337 - RNA, 20 nt, Artificial Sequence
  targeting sequence with CTCN PAM
acaaaaaugaaaauaaauua

SEQ ID NO: 14338 - RNA, 20 nt, Artificial Sequence
  targeting sequence with CTCN PAM
gggguugaggugguggaccg

SEQ ID NO: 14339 - RNA, 20 nt, Artificial Sequence
  targeting sequence with CTCN PAM
accccugaguagcugggacc

SEQ ID NO: 14340 - RNA, 20 nt, Artificial Sequence
  targeting sequence with CTCN PAM
agcgguccaccaccucaacc

SEQ ID NO: 14341 - RNA, 20 nt, Artificial Sequence
  targeting sequence with CTCN PAM
ugggcucaagcgguccacca

SEQ ID NO: 14342 - RNA, 20 nt, Artificial Sequence
  targeting sequence with CTCN PAM
accuccugggcucaagcggu

SEQ ID NO: 14343 - RNA, 20 nt, Artificial Sequence
  targeting sequence with CTCN PAM
cugcagccucaaccuccugg

SEQ ID NO: 14344 - RNA, 20 nt, Artificial Sequence
  targeting sequence with CTCN PAM
aaccugagucacagagugau

SEQ ID NO: 14345 - RNA, 20 nt, Artificial Sequence
  targeting sequence with CTCN PAM
gguuggagugcagcggcaug

SEQ ID NO: 14346 - RNA, 20 nt, Artificial Sequence
  targeting sequence with CTCN PAM
gugacucagguuggagugca

SEQ ID NO: 14347 - RNA, 20 nt, Artificial Sequence
  targeting sequence with CTCN PAM
aaaaacaauaggccaggugu

SEQ ID NO: 14348 - RNA, 20 nt, Artificial Sequence
  targeting sequence with CTCN PAM
cgccuguaaccccagcacuu

SEQ ID NO: 14349 - RNA, 20 nt, Artificial Sequence
  targeting sequence with CTCN PAM
caaagugcugggguuacagg

SEQ ID NO: 14350 - RNA, 20 nt, Artificial Sequence
  targeting sequence with CTCN PAM
gccucccaaagugcuggggu

SEQ ID NO: 14351 - RNA, 20 nt, Artificial Sequence
  targeting sequence with CTCN PAM
agugauccauccgccucggc

SEQ ID NO: 14352 - RNA, 20 nt, Artificial Sequence
  targeting sequence with CTCN PAM
ugaucucaagugauccaucc

SEQ ID NO: 14353 - RNA, 20 nt, Artificial Sequence
  targeting sequence with CTCN PAM
aacuccugaucucaagugau

SEQ ID NO: 14354 - RNA, 20 nt, Artificial Sequence
  targeting sequence with CTCN PAM
caaguaaccaggacuacagg

SEQ ID NO: 14355 - RNA, 20 nt, Artificial Sequence
  targeting sequence with CTCN PAM
ugccuuagccucccaaguaa

SEQ ID NO: 14356 - RNA, 20 nt, Artificial Sequence
  targeting sequence with CTCN PAM
uccuggguucaagcgauucu

SEQ ID NO: 14357 - RNA, 20 nt, Artificial Sequence
  targeting sequence with CTCN PAM
ucuuccuggguucaagcgau

SEQ ID NO: 14358 - RNA, 20 nt, Artificial Sequence
  targeting sequence with CTCN PAM
cugcaaccuccucuuccugg

SEQ ID NO: 14359 - RNA, 20 nt, Artificial Sequence
  targeting sequence with CTCN PAM
agcuugggugacagagugag

SEQ ID NO: 14360 - RNA, 20 nt, Artificial Sequence
  targeting sequence with CTCN PAM
gucacccaagcuggagugca

SEQ ID NO: 14361 - RNA, 20 nt, Artificial Sequence
  targeting sequence with CTCN PAM
cucugucacccaagcuggag

SEQ ID NO: 14362 - RNA, 20 nt, Artificial Sequence
  targeting sequence with CTCN PAM
aaacagcuaaaccugguggg

SEQ ID NO: 14363 - RNA, 20 nt, Artificial Sequence
  targeting sequence with CTCN PAM
ccaaggacaugagugugagc

SEQ ID NO: 14364 - RNA, 20 nt, Artificial Sequence
  targeting sequence with CTCN PAM
aaggacaugagugugagcgg

SEQ ID NO: 14365 - RNA, 20 nt, Artificial Sequence
  targeting sequence with CTCN PAM
uguccuuggagagaccaccc

SEQ ID NO: 14366 - RNA, 20 nt, Artificial Sequence
  targeting sequence with CTCN PAM
cacucauguccuuggagaga

SEQ ID NO: 14367 - RNA, 20 nt, Artificial Sequence
  targeting sequence with CTCN PAM
gcucacacucauguccuugg

SEQ ID NO: 14368 - RNA, 20 nt, Artificial Sequence
  targeting sequence with CTCN PAM
uucaggucuccgcucacacu

SEQ ID NO: 14369 - RNA, 20 nt, Artificial Sequence
  targeting sequence with CTCN PAM
ggaagagauuaauacuguca

SEQ ID NO: 14370 - RNA, 20 nt, Artificial Sequence
  targeting sequence with CTCN PAM
uccugagucuccuucagguc

SEQ ID NO: 14371 - RNA, 20 nt, Artificial Sequence
  targeting sequence with CTCN PAM
caauaauccuauuagguagg

SEQ ID NO: 14372 - RNA, 20 nt, Artificial Sequence
  targeting sequence with CTCN PAM
guaaaaugggaaugauaaua

SEQ ID NO: 14373 - RNA, 20 nt, Artificial Sequence
  targeting sequence with CTCN PAM
acucuguaaaaugggaauga

SEQ ID NO: 14374 - RNA, 20 nt, Artificial Sequence
  targeting sequence with CTCN PAM
cgggagggcgggguagcugg

SEQ ID NO: 14375 - RNA, 20 nt, Artificial Sequence
  targeting sequence with CTCN PAM
ggagggcgggguagcuggcu

SEQ ID NO: 14376 - RNA, 20 nt, Artificial Sequence
  targeting sequence with CTCN PAM
cgagagugugcuucgguucu

SEQ ID NO: 14377 - RNA, 20 nt, Artificial Sequence
  targeting sequence with CTCN PAM
guccagauguaagggugggu

SEQ ID NO: 14378 - RNA, 20 nt, Artificial Sequence
  targeting sequence with CTCN PAM
uuuccacccacccuuacauc

SEQ ID NO: 14379 - RNA, 20 nt, Artificial Sequence
  targeting sequence with CTCN PAM
uugggcaaggcucuuuucca

SEQ ID NO: 14380 - RNA, 20 nt, Artificial Sequence
  targeting sequence with CTCN PAM
cucauugggcaaggcucuuu

SEQ ID NO: 14381 - RNA, 20 nt, Artificial Sequence
  targeting sequence with CTCN PAM
cauggagaaagcaggugagg

SEQ ID NO: 14382 - RNA, 20 nt, Artificial Sequence
  targeting sequence with CTCN PAM
uggagaaagcaggugagguu

SEQ ID NO: 14383 - RNA, 20 nt, Artificial Sequence
  targeting sequence with CTCN PAM
augagagccugguucgugaa

SEQ ID NO: 14384 - RNA, 20 nt, Artificial Sequence
  targeting sequence with CTCN PAM
ccugcuuucuccaugagagc

SEQ ID NO: 14385 - RNA, 20 nt, Artificial Sequence
  targeting sequence with CTCN PAM
gugugggguaggggcacacc

SEQ ID NO: 14386 - RNA, 20 nt, Artificial Sequence
  targeting sequence with CTCN PAM
ucugagcaaacugaggccca

SEQ ID NO: 14387 - RNA, 20 nt, Artificial Sequence
  targeting sequence with CTCN PAM
gacgaggaagccucagugug

SEQ ID NO: 14388 - RNA, 20 nt, Artificial Sequence
  targeting sequence with CTCN PAM
guuugcucagacgaggaagc

SEQ ID NO: 14389 - RNA, 20 nt, Artificial Sequence
  targeting sequence with CTCN PAM
gggccucaguuugcucagac

SEQ ID NO: 14390 - RNA, 20 nt, Artificial Sequence
  targeting sequence with CTCN PAM
cugggccucaguuugcucag

SEQ ID NO: 14391 - RNA, 20 nt, Artificial Sequence
  targeting sequence with CTCN PAM
aagaccagcuagaauccagc

SEQ ID NO: 14392 - RNA, 20 nt, Artificial Sequence
  targeting sequence with CTCN PAM
ucuccucgaggcuuccacug

SEQ ID NO: 14393 - RNA, 20 nt, Artificial Sequence
  targeting sequence with CTCN PAM
ccucgaggcuuccacugccc

SEQ ID NO: 14394 - RNA, 20 nt, Artificial Sequence
  targeting sequence with CTCN PAM
ucgaggcuuccacugcccca

SEQ ID NO: 14395 - RNA, 20 nt, Artificial Sequence
  targeting sequence with CTCN PAM
aggcuuccacugccccacgc

SEQ ID NO: 14396 - RNA, 20 nt, Artificial Sequence
  targeting sequence with CTCN PAM
aggagaggaggcuggauucu

SEQ ID NO: 14397 - RNA, 20 nt, Artificial Sequence
  targeting sequence with CTCN PAM
gucuagggccuuuccauuac

SEQ ID NO: 14398 - RNA, 20 nt, Artificial Sequence
  targeting sequence with CTCN PAM
ggaaagaccagccagccauu

SEQ ID NO: 14399 - RNA, 20 nt, Artificial Sequence
  targeting sequence with CTCN PAM
caggaaagaccagccagcca

SEQ ID NO: 14400 - RNA, 20 nt, Artificial Sequence
  targeting sequence with CTCN PAM
ucaaagauagcucucaggaa

SEQ ID NO: 14401 - RNA, 20 nt, Artificial Sequence
  targeting sequence with CTCN PAM
ccucaucaaagauagcucuc

SEQ ID NO: 14402 - RNA, 20 nt, Artificial Sequence
  targeting sequence with CTCN PAM
cuccccucaucaaagauagc

SEQ ID NO: 14403 - RNA, 20 nt, Artificial Sequence
  targeting sequence with CTCN PAM
ggucccguuacaaaucagug

SEQ ID NO: 14404 - RNA, 20 nt, Artificial Sequence
  targeting sequence with CTCN PAM
gcagagcuaggccucagucu

SEQ ID NO: 14405 - RNA, 20 nt, Artificial Sequence
  targeting sequence with CTCN PAM
gcagaguugcucaggucccg

SEQ ID NO: 14406 - RNA, 20 nt, Artificial Sequence
  targeting sequence with CTCN PAM
gucuuuucaucugcaaaaug

SEQ ID NO: 14407 - RNA, 20 nt, Artificial Sequence
  targeting sequence with CTCN PAM
gcuauauccauuuugcagau

SEQ ID NO: 14408 - RNA, 20 nt, Artificial Sequence
  targeting sequence with CTCN PAM
gaccaucucugcuauaucca

SEQ ID NO: 14409 - RNA, 20 nt, Artificial Sequence
  targeting sequence with CTCN PAM
cuaugagucuguuuuccuga

SEQ ID NO: 14410 - RNA, 20 nt, Artificial Sequence
  targeting sequence with CTCN PAM
uagugagcuggaagggucau

SEQ ID NO: 14411 - RNA, 20 nt, Artificial Sequence
  targeting sequence with CTCN PAM
uuguucaggaaaacagacuc

SEQ ID NO: 14412 - RNA, 20 nt, Artificial Sequence
  targeting sequence with CTCN PAM
uauaauccuggcacuuuggg

SEQ ID NO: 14413 - RNA, 20 nt, Artificial Sequence
  targeting sequence with CTCN PAM
caaagugccaggauuauagg

SEQ ID NO: 14414 - RNA, 20 nt, Artificial Sequence
  targeting sequence with CTCN PAM
gccucccaaagugccaggau

SEQ ID NO: 14415 - RNA, 20 nt, Artificial Sequence
  targeting sequence with CTCN PAM
ucggccucccaaagugccag

SEQ ID NO: 14416 - RNA, 20 nt, Artificial Sequence
  targeting sequence with CTCN PAM
agcgauccacccuccucggc

SEQ ID NO: 14417 - RNA, 20 nt, Artificial Sequence
  targeting sequence with CTCN PAM
uggcucaagcgauccacccu

SEQ ID NO: 14418 - RNA, 20 nt, Artificial Sequence
  targeting sequence with CTCN PAM
cuauguugcccaggcugguc

SEQ ID NO: 14419 - RNA, 20 nt, Artificial Sequence
  targeting sequence with CTCN PAM
accccuacaaaaaauacaaa

SEQ ID NO: 14420 - RNA, 20 nt, Artificial Sequence
  targeting sequence with CTCN PAM
ggaggcugaggugagaggau

SEQ ID NO: 14421 - RNA, 20 nt, Artificial Sequence
  targeting sequence with CTCN PAM
ugaguagcugggaccacaag

SEQ ID NO: 14422 - RNA, 20 nt, Artificial Sequence
  targeting sequence with CTCN PAM
gccuccugaguagcugggac

SEQ ID NO: 14423 - RNA, 20 nt, Artificial Sequence
  targeting sequence with CTCN PAM
ccucagccuccugaguagcu

SEQ ID NO: 14424 - RNA, 20 nt, Artificial Sequence
  targeting sequence with CTCN PAM
caccucagccuccugaguag

SEQ ID NO: 14425 - RNA, 20 nt, Artificial Sequence
  targeting sequence with CTCN PAM
agcgauccucucaccucagc

SEQ ID NO: 14426 - RNA, 20 nt, Artificial Sequence
  targeting sequence with CTCN PAM
ugggcucaagcgauccucuc

SEQ ID NO: 14427 - RNA, 20 nt, Artificial Sequence
  targeting sequence with CTCN PAM
gccuccugggcucaagcgau

SEQ ID NO: 14428 - RNA, 20 nt, Artificial Sequence
  targeting sequence with CTCN PAM
cuguagccucugccuccugg

SEQ ID NO: 14429 - RNA, 20 nt, Artificial Sequence
  targeting sequence with CTCN PAM
agccugggcgacagagaccu

SEQ ID NO: 14430 - RNA, 20 nt, Artificial Sequence
  targeting sequence with CTCN PAM
gucgcccaggcuggagugca

SEQ ID NO: 14431 - RNA, 20 nt, Artificial Sequence
  targeting sequence with CTCN PAM
aaacuuuuuuuuucuucguc

SEQ ID NO: 14432 - RNA, 20 nt, Artificial Sequence
  targeting sequence with CTCN PAM
uuauucuguaaagcuugacg

SEQ ID NO: 14433 - RNA, 20 nt, Artificial Sequence
  targeting sequence with CTCN PAM
gugauggcuguuaguucccc

SEQ ID NO: 14434 - RNA, 20 nt, Artificial Sequence
  targeting sequence with CTCN PAM
augagguugcaauugugaaa

SEQ ID NO: 14435 - RNA, 20 nt, Artificial Sequence
  targeting sequence with CTCN PAM
uggagcccuggugaugggga

SEQ ID NO: 14436 - RNA, 20 nt, Artificial Sequence
  targeting sequence with CTCN PAM
caaaggaggaaccugagaca

SEQ ID NO: 14437 - RNA, 20 nt, Artificial Sequence
  targeting sequence with CTCN PAM
uuugugaguuucacaauugc

SEQ ID NO: 14438 - RNA, 20 nt, Artificial Sequence
  targeting sequence with CTCN PAM
gguuccuccuuugugaguuu

SEQ ID NO: 14439 - RNA, 20 nt, Artificial Sequence
  targeting sequence with CTCN PAM
gucucagguuccuccuuugu

SEQ ID NO: 14440 - RNA, 20 nt, Artificial Sequence
  targeting sequence with CTCN PAM
cugucucagguuccuccuuu

SEQ ID NO: 14441 - RNA, 20 nt, Artificial Sequence
  targeting sequence with CTCN PAM
guacuuccccucucugucuc

SEQ ID NO: 14442 - RNA, 20 nt, Artificial Sequence
  targeting sequence with CTCN PAM
cucguucauucaacaaauau

SEQ ID NO: 14443 - RNA, 20 nt, Artificial Sequence
  targeting sequence with CTCN PAM
uucauucaacaaauauucag

SEQ ID NO: 14444 - RNA, 20 nt, Artificial Sequence
  targeting sequence with CTCN PAM
ugaauauuuguugaaugaac

SEQ ID NO: 14445 - RNA, 20 nt, Artificial Sequence
  targeting sequence with CTCN PAM
agggccuggcaccuagaagg

SEQ ID NO: 14446 - RNA, 20 nt, Artificial Sequence
  targeting sequence with CTCN PAM
uuccacuacaggccaagcac

SEQ ID NO: 14447 - RNA, 20 nt, Artificial Sequence
  targeting sequence with CTCN PAM
gggaacccuguugugagcaa

SEQ ID NO: 14448 - RNA, 20 nt, Artificial Sequence
  targeting sequence with CTCN PAM
caacaggguucccagagacc

SEQ ID NO: 14449 - RNA, 20 nt, Artificial Sequence
  targeting sequence with CTCN PAM
uguuacaggcagggagacgg

SEQ ID NO: 14450 - RNA, 20 nt, Artificial Sequence
  targeting sequence with CTCN PAM
cugccuguaacaugagucca

SEQ ID NO: 14451 - RNA, 20 nt, Artificial Sequence
  targeting sequence with CTCN PAM
gcaucuugcuuuuugcauag

SEQ ID NO: 14452 - RNA, 20 nt, Artificial Sequence
  targeting sequence with CTCN PAM
gcccggccagggaggggcca

SEQ ID NO: 14453 - RNA, 20 nt, Artificial Sequence
  targeting sequence with CTCN PAM
cuggccgggcugagccccca

SEQ ID NO: 14454 - RNA, 20 nt, Artificial Sequence
  targeting sequence with CTCN PAM
uucuggccaugaggguccac

SEQ ID NO: 14455 - RNA, 20 nt, Artificial Sequence
  targeting sequence with CTCN PAM
uggccagaaggagggugucc

SEQ ID NO: 14456 - RNA, 20 nt, Artificial Sequence
  targeting sequence with CTCN PAM
ccuuaaccucauuagcguug

SEQ ID NO: 14457 - RNA, 20 nt, Artificial Sequence
  targeting sequence with CTCN PAM
uuagcguugggcauaaucac

SEQ ID NO: 14458 - RNA, 20 nt, Artificial Sequence
  targeting sequence with CTCN PAM
uaguuuaaggcgcuuggccu

SEQ ID NO: 14459 - RNA, 20 nt, Artificial Sequence
  targeting sequence with CTCN PAM
cguaguuuaaggcgcuuggc

SEQ ID NO: 14460 - RNA, 20 nt, Artificial Sequence
  targeting sequence with CTCN PAM
agcccccuaccuggccuggg

SEQ ID NO: 14461 - RNA, 20 nt, Artificial Sequence
  targeting sequence with CTCN PAM
ucugagcagacagaucuggg

SEQ ID NO: 14462 - RNA, 20 nt, Artificial Sequence
  targeting sequence with CTCN PAM
gaagagugcccccuucccug

SEQ ID NO: 14463 - RNA, 20 nt, Artificial Sequence
  targeting sequence with CTCN PAM
ucccacccaggauucccaga

SEQ ID NO: 14464 - RNA, 20 nt, Artificial Sequence
  targeting sequence with CTCN PAM
cuucccacccaggauuccca

SEQ ID NO: 14465 - RNA, 20 nt, Artificial Sequence
  targeting sequence with CTCN PAM
cugucucucuucccacccag

SEQ ID NO: 14466 - RNA, 20 nt, Artificial Sequence
  targeting sequence with CTCN PAM
cacugucucucuucccaccc

SEQ ID NO: 14467 - RNA, 20 nt, Artificial Sequence
  targeting sequence with CTCN PAM
cucacugucucucuucccac

SEQ ID NO: 14468 - RNA, 20 nt, Artificial Sequence
  targeting sequence with CTCN PAM
cucucacugucucucuuccc

SEQ ID NO: 14469 - RNA, 20 nt, Artificial Sequence
  targeting sequence with CTCN PAM
cagggguccuuccgccugga

SEQ ID NO: 14470 - RNA, 20 nt, Artificial Sequence
  targeting sequence with CTCN PAM
gggguccuuccgccuggaug

SEQ ID NO: 14471 - RNA, 20 nt, Artificial Sequence
  targeting sequence with CTCN PAM
uguuguuccguucucagcuc

SEQ ID NO: 14472 - RNA, 20 nt, Artificial Sequence
  targeting sequence with CTCN PAM
gcucaagcuccagcuucuca

SEQ ID NO: 14473 - RNA, 20 nt, Artificial Sequence
  targeting sequence with CTCN PAM
agcuccagcuucucagagaa

SEQ ID NO: 14474 - RNA, 20 nt, Artificial Sequence
  targeting sequence with CTCN PAM
agcuucucagagaagccucc

SEQ ID NO: 14475 - RNA, 20 nt, Artificial Sequence
  targeting sequence with CTCN PAM
gagaagccuccuguguuggg

SEQ ID NO: 14476 - RNA, 20 nt, Artificial Sequence
  targeting sequence with CTCN PAM
gagaagcuggagcuugagcu

SEQ ID NO: 14477 - RNA, 20 nt, Artificial Sequence
  targeting sequence with CTCN PAM
uguguugggaguggcugcga

SEQ ID NO: 14478 - RNA, 20 nt, Artificial Sequence
  targeting sequence with CTCN PAM
caacacaggaggcuucucug

SEQ ID NO: 14479 - RNA, 20 nt, Artificial Sequence
  targeting sequence with CTCN PAM
ucuauuuguuuguggucccu

SEQ ID NO: 14480 - RNA, 20 nt, Artificial Sequence
  targeting sequence with CTCN PAM
ccccacaaaaacacuggcuu

SEQ ID NO: 14481 - RNA, 20 nt, Artificial Sequence
  targeting sequence with CTCN PAM
caagaagccaguguuuuugu

SEQ ID NO: 14482 - RNA, 20 nt, Artificial Sequence
  targeting sequence with CTCN PAM
ugcucacaagaagccagugu

SEQ ID NO: 14483 - RNA, 20 nt, Artificial Sequence
  targeting sequence with CTCN PAM
uucguguacccugugugucc

SEQ ID NO: 14484 - RNA, 20 nt, Artificial Sequence
  targeting sequence with CTCN PAM
auacacauguuggcuggaca

SEQ ID NO: 14485 - RNA, 20 nt, Artificial Sequence
  targeting sequence with CTCN PAM
gugaccacuguccagccaac

SEQ ID NO: 14486 - RNA, 20 nt, Artificial Sequence
  targeting sequence with CTCN PAM
cagcacuugcacaggccgcc

SEQ ID NO: 14487 - RNA, 20 nt, Artificial Sequence
  targeting sequence with CTCN PAM
gcacuugcacaggccgcccc

SEQ ID NO: 14488 - RNA, 20 nt, Artificial Sequence
  targeting sequence with CTCN PAM
caggaaugaagugggguguc

SEQ ID NO: 14489 - RNA, 20 nt, Artificial Sequence
  targeting sequence with CTCN PAM
ccgucguccaagcaacauga

SEQ ID NO: 14490 - RNA, 20 nt, Artificial Sequence
  targeting sequence with CTCN PAM
ccccgucguccaagcaacau

SEQ ID NO: 14491 - RNA, 20 nt, Artificial Sequence
  targeting sequence with CTCN PAM
auuuucccccagucaucugc

SEQ ID NO: 14492 - RNA, 20 nt, Artificial Sequence
  targeting sequence with CTCN PAM
gacuacuuucuuucucacgg

SEQ ID NO: 14493 - RNA, 20 nt, Artificial Sequence
  targeting sequence with CTCN PAM
cgguacauccugcuauucug

SEQ ID NO: 14494 - RNA, 20 nt, Artificial Sequence
  targeting sequence with CTCN PAM
uggggccaccugguacaugg

SEQ ID NO: 14495 - RNA, 20 nt, Artificial Sequence
  targeting sequence with CTCN PAM
aaugccauguaccagguggc

SEQ ID NO: 14496 - RNA, 20 nt, Artificial Sequence
  targeting sequence with CTCN PAM
uggcugauuaggccuccccc

SEQ ID NO: 14497 - RNA, 20 nt, Artificial Sequence
  targeting sequence with CTCN PAM
cccaacagugcccugucugc

SEQ ID NO: 14498 - RNA, 20 nt, Artificial Sequence
  targeting sequence with CTCN PAM
agggccagccuccccuucag

SEQ ID NO: 14499 - RNA, 20 nt, Artificial Sequence
  targeting sequence with CTCN PAM
ccuucagacuggaguccccu

SEQ ID NO: 14500 - RNA, 20 nt, Artificial Sequence
  targeting sequence with CTCN PAM
agucugaaggggaggcuggc

SEQ ID NO: 14501 - RNA, 20 nt, Artificial Sequence
  targeting sequence with CTCN PAM
ccugcucugguagcccccuc

SEQ ID NO: 14502 - RNA, 20 nt, Artificial Sequence
  targeting sequence with CTCN PAM
gguagcccccuccauccucc

SEQ ID NO: 14503 - RNA, 20 nt, Artificial Sequence
  targeting sequence with CTCN PAM
auccucccucccuccacucc

SEQ ID NO: 14504 - RNA, 20 nt, Artificial Sequence
  targeting sequence with CTCN PAM
cucccuccacuccaucuuug

SEQ ID NO: 14505 - RNA, 20 nt, Artificial Sequence
  targeting sequence with CTCN PAM
cuccacuccaucuuuggggg

SEQ ID NO: 14506 - RNA, 20 nt, Artificial Sequence
  targeting sequence with CTCN PAM
acuccaucuuugggggcauu

SEQ ID NO: 14507 - RNA, 20 nt, Artificial Sequence
  targeting sequence with CTCN PAM
aucuuugggggcauuugagu

SEQ ID NO: 14508 - RNA, 20 nt, Artificial Sequence
  targeting sequence with CTCN PAM
aaugcccccaaagauggagu

SEQ ID NO: 14509 - RNA, 20 nt, Artificial Sequence
  targeting sequence with CTCN PAM
cuuuccucuggauaaagcca

SEQ ID NO: 14510 - RNA, 20 nt, Artificial Sequence
  targeting sequence with CTCN PAM
ggauaaagccagguuccccg

SEQ ID NO: 14511 - RNA, 20 nt, Artificial Sequence
  targeting sequence with CTCN PAM
uucucucaaaggcccaaaca

SEQ ID NO: 14512 - RNA, 20 nt, Artificial Sequence
  targeting sequence with CTCN PAM
caaaggcccaaacauggccu

SEQ ID NO: 14513 - RNA, 20 nt, Artificial Sequence
  targeting sequence with CTCN PAM
aaggcccaaacauggccucc

SEQ ID NO: 14514 - RNA, 20 nt, Artificial Sequence
  targeting sequence with CTCN PAM
cagacugcaacccccaggca

SEQ ID NO: 14515 - RNA, 20 nt, Artificial Sequence
  targeting sequence with CTCN PAM
acaaccucacagccacccug

SEQ ID NO: 14516 - RNA, 20 nt, Artificial Sequence
  targeting sequence with CTCN PAM
cagccacccuggacggaauc

SEQ ID NO: 14517 - RNA, 20 nt, Artificial Sequence
  targeting sequence with CTCN PAM
aaugugggaagaagcagauu

SEQ ID NO: 14518 - RNA, 20 nt, Artificial Sequence
  targeting sequence with CTCN PAM
ucagccccugagcuccucug

SEQ ID NO: 14519 - RNA, 20 nt, Artificial Sequence
  targeting sequence with CTCN PAM
gccccugagcuccucugggc

SEQ ID NO: 14520 - RNA, 20 nt, Artificial Sequence
  targeting sequence with CTCN PAM
ggggcugaggaggacucaaa

SEQ ID NO: 14521 - RNA, 20 nt, Artificial Sequence
  targeting sequence with CTCN PAM
ucugggcagggcuguuucuu

SEQ ID NO: 14522 - RNA, 20 nt, Artificial Sequence
  targeting sequence with CTCN PAM
gggcagggcuguuucuuucc

SEQ ID NO: 14523 - RNA, 20 nt, Artificial Sequence
  targeting sequence with CTCN PAM
uguucguucauuaaacauuu

SEQ ID NO: 14524 - RNA, 20 nt, Artificial Sequence
  targeting sequence with CTCN PAM
cuuguucguucauuaaacau

SEQ ID NO: 14525 - RNA, 20 nt, Artificial Sequence
  targeting sequence with CTCN PAM
ugggcccuaggcuauguguc

SEQ ID NO: 14526 - RNA, 20 nt, Artificial Sequence
  targeting sequence with CTCN PAM
uggagcuccuccugucagag

SEQ ID NO: 14527 - RNA, 20 nt, Artificial Sequence
  targeting sequence with CTCN PAM
augagggcaggggcugcaac

SEQ ID NO: 14528 - RNA, 20 nt, Artificial Sequence
  targeting sequence with CTCN PAM
uccugucagaggaguguggg

SEQ ID NO: 14529 - RNA, 20 nt, Artificial Sequence
  targeting sequence with CTCN PAM
ugucagaggaguguggggac

SEQ ID NO: 14530 - RNA, 20 nt, Artificial Sequence
  targeting sequence with CTCN PAM
gacaggaggagcuccaugag

SEQ ID NO: 14531 - RNA, 20 nt, Artificial Sequence
  targeting sequence with CTCN PAM
ucugacaggaggagcuccau

SEQ ID NO: 14532 - RNA, 20 nt, Artificial Sequence
  targeting sequence with CTCN PAM
agagguaacuugugggggaa

SEQ ID NO: 14533 - RNA, 20 nt, Artificial Sequence
  targeting sequence with CTCN PAM
ggagucauccaguccccaca

SEQ ID NO: 14534 - RNA, 20 nt, Artificial Sequence
  targeting sequence with CTCN PAM
ucacacagccccuuaccugu

SEQ ID NO: 14535 - RNA, 20 nt, Artificial Sequence
  targeting sequence with CTCN PAM
ucucgucacacagccccuua

SEQ ID NO: 14536 - RNA, 20 nt, Artificial Sequence
  targeting sequence with CTCN PAM
caucucgucacacagccccu

SEQ ID NO: 14537 - RNA, 20 nt, Artificial Sequence
  targeting sequence with CTCN PAM
cagucucucaucucgucaca

SEQ ID NO: 14538 - RNA, 20 nt, Artificial Sequence
  targeting sequence with CTCN PAM
agcuguccagaggacauagc

SEQ ID NO: 14539 - RNA, 20 nt, Artificial Sequence
  targeting sequence with CTCN PAM
ggacagcuagagacuuucug

SEQ ID NO: 14540 - RNA, 20 nt, Artificial Sequence
  targeting sequence with CTCN PAM
gugcuauguccucuggacag

SEQ ID NO: 14541 - RNA, 20 nt, Artificial Sequence
  targeting sequence with CTCN PAM
gucugguggccuggguuuga

SEQ ID NO: 14542 - RNA, 20 nt, Artificial Sequence
  targeting sequence with CTCN PAM
ucccuuuuccuggauccuga

SEQ ID NO: 14543 - RNA, 20 nt, Artificial Sequence
  targeting sequence with CTCN PAM
cuuuuccuggauccugagua

SEQ ID NO: 14544 - RNA, 20 nt, Artificial Sequence
  targeting sequence with CTCN PAM
ggauccaggaaaagggagga

SEQ ID NO: 14545 - RNA, 20 nt, Artificial Sequence
  targeting sequence with CTCN PAM
ccucccugaccucaggcuuc

SEQ ID NO: 14546 - RNA, 20 nt, Artificial Sequence
  targeting sequence with CTCN PAM
ucccugaccucaggcuuccu

SEQ ID NO: 14547 - RNA, 20 nt, Artificial Sequence
  targeting sequence with CTCN PAM
cugaccucaggcuuccuccu

SEQ ID NO: 14548 - RNA, 20 nt, Artificial Sequence
  targeting sequence with CTCN PAM
ggcuuccuccuagugucacc

SEQ ID NO: 14549 - RNA, 20 nt, Artificial Sequence
  targeting sequence with CTCN PAM
uagugucaccuuggccccuc

SEQ ID NO: 14550 - RNA, 20 nt, Artificial Sequence
  targeting sequence with CTCN PAM
uagaagccaauuaggcccuc

SEQ ID NO: 14551 - RNA, 20 nt, Artificial Sequence
  targeting sequence with CTCN PAM
guuucugcagcggggauuaa

SEQ ID NO: 14552 - RNA, 20 nt, Artificial Sequence
  targeting sequence with CTCN PAM
cagaugcugauucagccagg

SEQ ID NO: 14553 - RNA, 20 nt, Artificial Sequence
  targeting sequence with CTCN PAM
uggcugaaucagcaucuggg

SEQ ID NO: 14554 - RNA, 20 nt, Artificial Sequence
  targeting sequence with CTCN PAM
uaagcuccuggcugaaucag

SEQ ID NO: 14555 - RNA, 20 nt, Artificial Sequence
  targeting sequence with CTCN PAM
cccuccuaagcuccuggcug

SEQ ID NO: 14556 - RNA, 20 nt, Artificial Sequence
  targeting sequence with CTCN PAM
ggguucugacccccccagac

SEQ ID NO: 14557 - RNA, 20 nt, Artificial Sequence
  targeting sequence with CTCN PAM
agcuggaugacucuggguuc

SEQ ID NO: 14558 - RNA, 20 nt, Artificial Sequence
  targeting sequence with CTCN PAM
gggcuccagcuggaugacuc

SEQ ID NO: 14559 - RNA, 20 nt, Artificial Sequence
  targeting sequence with CTCN PAM
gccacucagggcuccagcug

SEQ ID NO: 14560 - RNA, 20 nt, Artificial Sequence
  targeting sequence with CTCN PAM
ggccuucgcagcauucuugg

SEQ ID NO: 14561 - RNA, 20 nt, Artificial Sequence
  targeting sequence with CTCN PAM
cacccaagaaugcugcgaag

SEQ ID NO: 14562 - RNA, 20 nt, Artificial Sequence
  targeting sequence with CTCN PAM
aaugcgacgggugugguacg

SEQ ID NO: 14563 - RNA, 20 nt, Artificial Sequence
  targeting sequence with CTCN PAM
aaggggcugcguaccacacc

SEQ ID NO: 14564 - RNA, 20 nt, Artificial Sequence
  targeting sequence with CTCN PAM
gccagguaguacugugggua

SEQ ID NO: 14565 - RNA, 20 nt, Artificial Sequence
  targeting sequence with CTCN PAM
augcuggccgccuacauguu

SEQ ID NO: 14566 - RNA, 20 nt, Artificial Sequence
  targeting sequence with CTCN PAM
cgcucuacgucaccguccag

SEQ ID NO: 14567 - RNA, 20 nt, Artificial Sequence
  targeting sequence with CTCN PAM
acgucaccguccagcacaag

SEQ ID NO: 14568 - RNA, 20 nt, Artificial Sequence
  targeting sequence with CTCN PAM
caacuacauccugcucaacc

SEQ ID NO: 14569 - RNA, 20 nt, Artificial Sequence
  targeting sequence with CTCN PAM
acuacauccugcucaaccua

SEQ ID NO: 14570 - RNA, 20 nt, Artificial Sequence
  targeting sequence with CTCN PAM
accuagccguggcugaccuc

SEQ ID NO: 14571 - RNA, 20 nt, Artificial Sequence
  targeting sequence with CTCN PAM
ucaugguccuagguggcuuc

SEQ ID NO: 14572 - RNA, 20 nt, Artificial Sequence
  targeting sequence with CTCN PAM
acaccucucugcauggauac

SEQ ID NO: 14573 - RNA, 20 nt, Artificial Sequence
  targeting sequence with CTCN PAM
cugcauggauacuucgucuu

SEQ ID NO: 14574 - RNA, 20 nt, Artificial Sequence
  targeting sequence with CTCN PAM
gcauggauacuucgucuucg

SEQ ID NO: 14575 - RNA, 20 nt, Artificial Sequence
  targeting sequence with CTCN PAM
aaauugcauccugugggccc

SEQ ID NO: 14576 - RNA, 20 nt, Artificial Sequence
  targeting sequence with CTCN PAM
uaccgcccaggguggcaaag

SEQ ID NO: 14577 - RNA, 20 nt, Artificial Sequence
  targeting sequence with CTCN PAM
ugcacaccccacccacaccc

SEQ ID NO: 14578 - RNA, 20 nt, Artificial Sequence
  targeting sequence with CTCN PAM
cgggcuccugcacaccccac

SEQ ID NO: 14579 - RNA, 20 nt, Artificial Sequence
  targeting sequence with CTCN PAM
augcucccgggcuccugcac

SEQ ID NO: 14580 - RNA, 20 nt, Artificial Sequence
  targeting sequence with CTCN PAM
cagaccccuccaugcucccg

SEQ ID NO: 14581 - RNA, 20 nt, Artificial Sequence
  targeting sequence with CTCN PAM
cccagaccccuccaugcucc

SEQ ID NO: 14582 - RNA, 20 nt, Artificial Sequence
  targeting sequence with CTCN PAM
gccaccaccgccaagcccgg

SEQ ID NO: 14583 - RNA, 20 nt, Artificial Sequence
  targeting sequence with CTCN PAM
cagccaccaccgccaagccc

SEQ ID NO: 14584 - RNA, 20 nt, Artificial Sequence
  targeting sequence with CTCN PAM
cuucuccuguccugucaaug

SEQ ID NO: 14585 - RNA, 20 nt, Artificial Sequence
  targeting sequence with CTCN PAM
uguccugucaauguuaucca

SEQ ID NO: 14586 - RNA, 20 nt, Artificial Sequence
  targeting sequence with CTCN PAM
uauauucagucaacaaacac

SEQ ID NO: 14587 - RNA, 20 nt, Artificial Sequence
  targeting sequence with CTCN PAM
aaauaagaucaaggcagugu

SEQ ID NO: 14588 - RNA, 20 nt, Artificial Sequence
  targeting sequence with CTCN PAM
guuuucuugcugugaaauua

SEQ ID NO: 14589 - RNA, 20 nt, Artificial Sequence
  targeting sequence with CTCN PAM
gcucaguuuucuugcuguga

SEQ ID NO: 14590 - RNA, 20 nt, Artificial Sequence
  targeting sequence with CTCN PAM
aagaagucaagcgcccugcu

SEQ ID NO: 14591 - RNA, 20 nt, Artificial Sequence
  targeting sequence with CTCN PAM
gcacccgucccugugugacg

SEQ ID NO: 14592 - RNA, 20 nt, Artificial Sequence
  targeting sequence with CTCN PAM
acucugcacccgucccugug

SEQ ID NO: 14593 - RNA, 20 nt, Artificial Sequence
  targeting sequence with CTCN PAM
ggccauguuugcagcaccaa

SEQ ID NO: 14594 - RNA, 20 nt, Artificial Sequence
  targeting sequence with CTCN PAM
guuucccuuggagcagcugu

SEQ ID NO: 14595 - RNA, 20 nt, Artificial Sequence
  targeting sequence with CTCN PAM
aagggaaacagaggcuuggu

SEQ ID NO: 14596 - RNA, 20 nt, Artificial Sequence
  targeting sequence with CTCN PAM
gcacagcugcuccaagggaa

SEQ ID NO: 14597 - RNA, 20 nt, Artificial Sequence
  targeting sequence with CTCN PAM
gugcccagccugggucugac

SEQ ID NO: 14598 - RNA, 20 nt, Artificial Sequence
  targeting sequence with CTCN PAM
cucagugcccagccuggguc

SEQ ID NO: 14599 - RNA, 20 nt, Artificial Sequence
  targeting sequence with CTCN PAM
cccucagugcccagccuggg

SEQ ID NO: 14600 - RNA, 20 nt, Artificial Sequence
  targeting sequence with CTCN PAM
ucucugggggcccaagcuca

SEQ ID NO: 14601 - RNA, 20 nt, Artificial Sequence
  targeting sequence with CTCN PAM
cugggggcccaagcucaggg

SEQ ID NO: 14602 - RNA, 20 nt, Artificial Sequence
  targeting sequence with CTCN PAM
gggggcccaagcucagggug

SEQ ID NO: 14603 - RNA, 20 nt, Artificial Sequence
  targeting sequence with CTCN PAM
gggugggaaguggauuuucc

SEQ ID NO: 14604 - RNA, 20 nt, Artificial Sequence
  targeting sequence with CTCN PAM
agucauugggucuucccugu

SEQ ID NO: 14605 - RNA, 20 nt, Artificial Sequence
  targeting sequence with CTCN PAM
guccccucuggcauccucug

SEQ ID NO: 14606 - RNA, 20 nt, Artificial Sequence
  targeting sequence with CTCN PAM
ggcauccucugccuccccuc

SEQ ID NO: 14607 - RNA, 20 nt, Artificial Sequence
  targeting sequence with CTCN PAM
gccuccccucucagccccug

SEQ ID NO: 14608 - RNA, 20 nt, Artificial Sequence
  targeting sequence with CTCN PAM
ccucucagccccuguccuca

SEQ ID NO: 14609 - RNA, 20 nt, Artificial Sequence
  targeting sequence with CTCN PAM
cagccccuguccucaggugc

SEQ ID NO: 14610 - RNA, 20 nt, Artificial Sequence
  targeting sequence with CTCN PAM
gccccuguccucaggugccc

SEQ ID NO: 14611 - RNA, 20 nt, Artificial Sequence
  targeting sequence with CTCN PAM
ggugccccuccagccucccu

SEQ ID NO: 14612 - RNA, 20 nt, Artificial Sequence
  targeting sequence with CTCN PAM
agccucccugccgcguucca

SEQ ID NO: 14613 - RNA, 20 nt, Artificial Sequence
  targeting sequence with CTCN PAM
cugccgcguuccaagucucc

SEQ ID NO: 14614 - RNA, 20 nt, Artificial Sequence
  targeting sequence with CTCN PAM
ugguguugagaaccgcaagc

SEQ ID NO: 14615 - RNA, 20 nt, Artificial Sequence
  targeting sequence with CTCN PAM
acaccaggagacuuggaacg

SEQ ID NO: 14616 - RNA, 20 nt, Artificial Sequence
  targeting sequence with CTCN PAM
gaagcaguuccuuuuugcuu

SEQ ID NO: 14617 - RNA, 20 nt, Artificial Sequence
  targeting sequence with CTCN PAM
guuaagugggaucuguuauc

SEQ ID NO: 14618 - RNA, 20 nt, Artificial Sequence
  targeting sequence with CTCN PAM
cuguuaagugggaucuguua

SEQ ID NO: 14619 - RNA, 20 nt, Artificial Sequence
  targeting sequence with CTCN PAM
guuuuccucucuguuaagug

SEQ ID NO: 14620 - RNA, 20 nt, Artificial Sequence
  targeting sequence with CTCN PAM
cugccucaguuuuccucucu

SEQ ID NO: 14621 - RNA, 20 nt, Artificial Sequence
  targeting sequence with CTCN PAM
cccugccucaguuuuccucu

SEQ ID NO: 14622 - RNA, 20 nt, Artificial Sequence
  targeting sequence with CTCN PAM
uccccucucccugccucagu

SEQ ID NO: 14623 - RNA, 20 nt, Artificial Sequence
  targeting sequence with CTCN PAM
uuuagggauguggccaggca

SEQ ID NO: 14624 - RNA, 20 nt, Artificial Sequence
  targeting sequence with CTCN PAM
uguugcugccuggccacauc

SEQ ID NO: 14625 - RNA, 20 nt, Artificial Sequence
  targeting sequence with CTCN PAM
uggcugugauccaggaauau

SEQ ID NO: 14626 - RNA, 20 nt, Artificial Sequence
  targeting sequence with CTCN PAM
gcugagaugcaggaggagac

SEQ ID NO: 14627 - RNA, 20 nt, Artificial Sequence
  targeting sequence with CTCN PAM
gcagagauauuccuggauca

SEQ ID NO: 14628 - RNA, 20 nt, Artificial Sequence
  targeting sequence with CTCN PAM
ugcaucucagcagagauauu

SEQ ID NO: 14629 - RNA, 20 nt, Artificial Sequence
  targeting sequence with CTCN PAM
uccugcaucucagcagagau

SEQ ID NO: 14630 - RNA, 20 nt, Artificial Sequence
  targeting sequence with CTCN PAM
ccgucacccagcuuugcaau

SEQ ID NO: 14631 - RNA, 20 nt, Artificial Sequence
  targeting sequence with CTCN PAM
ccccgucacccagcuuugca

SEQ ID NO: 14632 - RNA, 20 nt, Artificial Sequence
  targeting sequence with CTCN PAM
cugccagccuugcccugucu

SEQ ID NO: 14633 - RNA, 20 nt, Artificial Sequence
  targeting sequence with CTCN PAM
gccagccuugcccugucucc

SEQ ID NO: 14634 - RNA, 20 nt, Artificial Sequence
  targeting sequence with CTCN PAM
cccauguccaggcugcugcc

SEQ ID NO: 14635 - RNA, 20 nt, Artificial Sequence
  targeting sequence with CTCN PAM
gucccauucucagggaaucu

SEQ ID NO: 14636 - RNA, 20 nt, Artificial Sequence
  targeting sequence with CTCN PAM
gggaaucucuggccauuguu

SEQ ID NO: 14637 - RNA, 20 nt, Artificial Sequence
  targeting sequence with CTCN PAM
ggccauuguuggguguuugu

SEQ ID NO: 14638 - RNA, 20 nt, Artificial Sequence
  targeting sequence with CTCN PAM
guucuggccagaaggugggu

SEQ ID NO: 14639 - RNA, 20 nt, Artificial Sequence
  targeting sequence with CTCN PAM
gcagggucagucccaguuua

SEQ ID NO: 14640 - RNA, 20 nt, Artificial Sequence
  targeting sequence with CTCN PAM
cccuauggaacuucaugggg

SEQ ID NO: 14641 - RNA, 20 nt, Artificial Sequence
  targeting sequence with CTCN PAM
cuauggaacuucauggggug

SEQ ID NO: 14642 - RNA, 20 nt, Artificial Sequence
  targeting sequence with CTCN PAM
ccaccccaugaaguuccaua

SEQ ID NO: 14643 - RNA, 20 nt, Artificial Sequence
  targeting sequence with CTCN PAM
gggcaaaacauugcacauug

SEQ ID NO: 14644 - RNA, 20 nt, Artificial Sequence
  targeting sequence with CTCN PAM
uaggagaggcccccacaugu

SEQ ID NO: 14645 - RNA, 20 nt, Artificial Sequence
  targeting sequence with CTCN PAM
uaggagccaugaagcaaugu

SEQ ID NO: 14646 - RNA, 20 nt, Artificial Sequence
  targeting sequence with CTCN PAM
ccuaggagccaugaagcaau

SEQ ID NO: 14647 - RNA, 20 nt, Artificial Sequence
  targeting sequence with CTCN PAM
ggaaaugaaauaacccggac

SEQ ID NO: 14648 - RNA, 20 nt, Artificial Sequence
  targeting sequence with CTCN PAM
cuucucgggaaaugaaauaa

SEQ ID NO: 14649 - RNA, 20 nt, Artificial Sequence
  targeting sequence with CTCN PAM
cccuucucgggaaaugaaau

SEQ ID NO: 14650 - RNA, 20 nt, Artificial Sequence
  targeting sequence with CTCN PAM
cucucccuucucgggaaaug

SEQ ID NO: 14651 - RNA, 20 nt, Artificial Sequence
  targeting sequence with CTCN PAM
gcauuccuucccaacaagga

SEQ ID NO: 14652 - RNA, 20 nt, Artificial Sequence
  targeting sequence with CTCN PAM
gccccacauuaggaugcauu

SEQ ID NO: 14653 - RNA, 20 nt, Artificial Sequence
  targeting sequence with CTCN PAM
cuaccggguucccaguucaa

SEQ ID NO: 14654 - RNA, 20 nt, Artificial Sequence
  targeting sequence with CTCN PAM
gggcccauaagggacacgaa

SEQ ID NO: 14655 - RNA, 20 nt, Artificial Sequence
  targeting sequence with CTCN PAM
ccucagcguguggucccucu

SEQ ID NO: 14656 - RNA, 20 nt, Artificial Sequence
  targeting sequence with CTCN PAM
ucagcguguggucccucugc

SEQ ID NO: 14657 - RNA, 20 nt, Artificial Sequence
  targeting sequence with CTCN PAM
gcguguggucccucugcccc

SEQ ID NO: 14658 - RNA, 20 nt, Artificial Sequence
  targeting sequence with CTCN PAM
gccccuucccccuccuccca

SEQ ID NO: 14659 - RNA, 20 nt, Artificial Sequence
  targeting sequence with CTCN PAM
ucccagcaccaagcucucuc

SEQ ID NO: 14660 - RNA, 20 nt, Artificial Sequence
  targeting sequence with CTCN PAM
cagcaccaagcucucuccuu

SEQ ID NO: 14661 - RNA, 20 nt, Artificial Sequence
  targeting sequence with CTCN PAM
cuccuuccccaaggccuccu

SEQ ID NO: 14662 - RNA, 20 nt, Artificial Sequence
  targeting sequence with CTCN PAM
ccuuccccaaggccuccuca

SEQ ID NO: 14663 - RNA, 20 nt, Artificial Sequence
  targeting sequence with CTCN PAM
uuccccaaggccuccucaaa

SEQ ID NO: 14664 - RNA, 20 nt, Artificial Sequence
  targeting sequence with CTCN PAM
ucaaaucccucucccacucc

SEQ ID NO: 14665 - RNA, 20 nt, Artificial Sequence
  targeting sequence with CTCN PAM
aaucccucucccacuccugg

SEQ ID NO: 14666 - RNA, 20 nt, Artificial Sequence
  targeting sequence with CTCN PAM
cccacuccugguugccuucc

SEQ ID NO: 14667 - RNA, 20 nt, Artificial Sequence
  targeting sequence with CTCN PAM
cacuccugguugccuuccua

SEQ ID NO: 14668 - RNA, 20 nt, Artificial Sequence
  targeting sequence with CTCN PAM
ugguugccuuccuagcuacc

SEQ ID NO: 14669 - RNA, 20 nt, Artificial Sequence
  targeting sequence with CTCN PAM
cccugucuaggggggagugc

SEQ ID NO: 14670 - RNA, 20 nt, Artificial Sequence
  targeting sequence with CTCN PAM
cugucuaggggggagugcac

SEQ ID NO: 14671 - RNA, 20 nt, Artificial Sequence
  targeting sequence with CTCN PAM
ccccuagacagggagagggu

SEQ ID NO: 14672 - RNA, 20 nt, Artificial Sequence
  targeting sequence with CTCN PAM
uuaggcaguggggucugugc

SEQ ID NO: 14673 - RNA, 20 nt, Artificial Sequence
  targeting sequence with CTCN PAM
auggccaggaccaccaagga

SEQ ID NO: 14674 - RNA, 20 nt, Artificial Sequence
  targeting sequence with CTCN PAM
ugggcuuacacaccaccacg

SEQ ID NO: 14675 - RNA, 20 nt, Artificial Sequence
  targeting sequence with CTCN PAM
ccgaagcggaaguugcucau

SEQ ID NO: 14676 - RNA, 20 nt, Artificial Sequence
  targeting sequence with CTCN PAM
ccggcugguccagguaaugg

SEQ ID NO: 14677 - RNA, 20 nt, Artificial Sequence
  targeting sequence with CTCN PAM
gugccauuaccuggaccagc

SEQ ID NO: 14678 - RNA, 20 nt, Artificial Sequence
  targeting sequence with CTCN PAM
gggggcucuuuguagggucc

SEQ ID NO: 14679 - RNA, 20 nt, Artificial Sequence
  targeting sequence with CTCN PAM
uuguaggguccuccagucag

SEQ ID NO: 14680 - RNA, 20 nt, Artificial Sequence
  targeting sequence with CTCN PAM
agucaggacucaaacccagu

SEQ ID NO: 14681 - RNA, 20 nt, Artificial Sequence
  targeting sequence with CTCN PAM
aacccaguagugucugguuc

SEQ ID NO: 14682 - RNA, 20 nt, Artificial Sequence
  targeting sequence with CTCN PAM
uggcccaaaugcccacucag

SEQ ID NO: 14683 - RNA, 20 nt, Artificial Sequence
  targeting sequence with CTCN PAM
ggguagggguguagggcaga

SEQ ID NO: 14684 - RNA, 20 nt, Artificial Sequence
  targeting sequence with CTCN PAM
aauguugcuacaagggcugg

SEQ ID NO: 14685 - RNA, 20 nt, Artificial Sequence
  targeting sequence with CTCN PAM
ugagccccaugucaaacaga

SEQ ID NO: 14686 - RNA, 20 nt, Artificial Sequence
  targeting sequence with CTCN PAM
ggagaugggaccagcccuug

SEQ ID NO: 14687 - RNA, 20 nt, Artificial Sequence
  targeting sequence with CTCN PAM
acuaagcuaggcgcaaauuc

SEQ ID NO: 14688 - RNA, 20 nt, Artificial Sequence
  targeting sequence with CTCN PAM
uuggucuaguaccccggggg

SEQ ID NO: 14689 - RNA, 20 nt, Artificial Sequence
  targeting sequence with CTCN PAM
aaccuugggccucagcagca

SEQ ID NO: 14690 - RNA, 20 nt, Artificial Sequence
  targeting sequence with CTCN PAM
gcagcaggggaggccacacc

SEQ ID NO: 14691 - RNA, 20 nt, Artificial Sequence
  targeting sequence with CTCN PAM
ccugcugcugaggcccaagg

SEQ ID NO: 14692 - RNA, 20 nt, Artificial Sequence
  targeting sequence with CTCN PAM
gccucuaggcgauugucucc

SEQ ID NO: 14693 - RNA, 20 nt, Artificial Sequence
  targeting sequence with CTCN PAM
aggcgauugucuccuaaugg

SEQ ID NO: 14694 - RNA, 20 nt, Artificial Sequence
  targeting sequence with CTCN PAM
uaauggggcugagaugagac

SEQ ID NO: 14695 - RNA, 20 nt, Artificial Sequence
  targeting sequence with CTCN PAM
gccccauuaggagacaaucg

SEQ ID NO: 14696 - RNA, 20 nt, Artificial Sequence
  targeting sequence with CTCN PAM
ucucagccccauuaggagac

SEQ ID NO: 14697 - RNA, 20 nt, Artificial Sequence
  targeting sequence with CTCN PAM
gguccccagaggccucaugu

SEQ ID NO: 14698 - RNA, 20 nt, Artificial Sequence
  targeting sequence with CTCN PAM
ggggaccagagucaccaguc

SEQ ID NO: 14699 - RNA, 20 nt, Artificial Sequence
  targeting sequence with CTCN PAM
ugucccucugucuccagaaa

SEQ ID NO: 14700 - RNA, 20 nt, Artificial Sequence
  targeting sequence with CTCN PAM
gucuccagaaaauucccacu

SEQ ID NO: 14701 - RNA, 20 nt, Artificial Sequence
  targeting sequence with CTCN PAM
agaaaauucccacucucacu

SEQ ID NO: 14702 - RNA, 20 nt, Artificial Sequence
  targeting sequence with CTCN PAM
cacuucccuuuccuccucag

SEQ ID NO: 14703 - RNA, 20 nt, Artificial Sequence
  targeting sequence with CTCN PAM
cuucccuuuccuccucaguc

SEQ ID NO: 14704 - RNA, 20 nt, Artificial Sequence
  targeting sequence with CTCN PAM
ucagucuugcuaggguccau

SEQ ID NO: 14705 - RNA, 20 nt, Artificial Sequence
  targeting sequence with CTCN PAM
gucuugcuaggguccauuuc

SEQ ID NO: 14706 - RNA, 20 nt, Artificial Sequence
  targeting sequence with CTCN PAM
aauucagcaagggguaagaa

SEQ ID NO: 14707 - RNA, 20 nt, Artificial Sequence
  targeting sequence with CTCN PAM
aaucuggccuaguucuaucc

SEQ ID NO: 14708 - RNA, 20 nt, Artificial Sequence
  targeting sequence with CTCN PAM
ggaagcagagccgcuggacg

SEQ ID NO: 14709 - RNA, 20 nt, Artificial Sequence
  targeting sequence with CTCN PAM
gcuuccagaggauagaacua

SEQ ID NO: 14710 - RNA, 20 nt, Artificial Sequence
  targeting sequence with CTCN PAM
ggguuuccugaggcccgucc

SEQ ID NO: 14711 - RNA, 20 nt, Artificial Sequence
  targeting sequence with CTCN PAM
ggaaacccagagcguccagc

SEQ ID NO: 14712 - RNA, 20 nt, Artificial Sequence
  targeting sequence with CTCN PAM
aguuuccagaagcugcacaa

SEQ ID NO: 14713 - RNA, 20 nt, Artificial Sequence
  targeting sequence with CTCN PAM
guguguccaucuuuggccug

SEQ ID NO: 14714 - RNA, 20 nt, Artificial Sequence
  targeting sequence with CTCN PAM
cacccuggggcuaggaagac

SEQ ID NO: 14715 - RNA, 20 nt, Artificial Sequence
  targeting sequence with CTCN PAM
cccuggggcuaggaagaccu

SEQ ID NO: 14716 - RNA, 20 nt, Artificial Sequence
  targeting sequence with CTCN PAM
guuuguacaaacuuccucaa

SEQ ID NO: 14717 - RNA, 20 nt, Artificial Sequence
  targeting sequence with CTCN PAM
aaugcagagccugagggcuc

SEQ ID NO: 14718 - RNA, 20 nt, Artificial Sequence
  targeting sequence with CTCN PAM
gcauuugaggaaguuuguac

SEQ ID NO: 14719 - RNA, 20 nt, Artificial Sequence
  targeting sequence with CTCN PAM
ggcucugcauuugaggaagu

SEQ ID NO: 14720 - RNA, 20 nt, Artificial Sequence
  targeting sequence with CTCN PAM
ccccaccuccucaccaaccc

SEQ ID NO: 14721 - RNA, 20 nt, Artificial Sequence
  targeting sequence with CTCN PAM
ccaccuccucaccaacccuc

SEQ ID NO: 14722 - RNA, 20 nt, Artificial Sequence
  targeting sequence with CTCN PAM
ucaccaacccucugcguggc

SEQ ID NO: 14723 - RNA, 20 nt, Artificial Sequence
  targeting sequence with CTCN PAM
ccaacccucugcguggcaua

SEQ ID NO: 14724 - RNA, 20 nt, Artificial Sequence
  targeting sequence with CTCN PAM
gcguggcauagcccuagccu

SEQ ID NO: 14725 - RNA, 20 nt, Artificial Sequence
  targeting sequence with CTCN PAM
gcgggcaguggaugcugggg

SEQ ID NO: 14726 - RNA, 20 nt, Artificial Sequence
  targeting sequence with CTCN PAM
cugcaugcccagccccagca

SEQ ID NO: 14727 - RNA, 20 nt, Artificial Sequence
  targeting sequence with CTCN PAM
cccugcaugcccagccccag

SEQ ID NO: 14728 - RNA, 20 nt, Artificial Sequence
  targeting sequence with CTCN PAM
cuggaaaaggggaucauaaa

SEQ ID NO: 14729 - RNA, 20 nt, Artificial Sequence
  targeting sequence with CTCN PAM
gcagccaccuuggcuguucc

SEQ ID NO: 14730 - RNA, 20 nt, Artificial Sequence
  targeting sequence with CTCN PAM
caggcagggucucccuaccu

SEQ ID NO: 14731 - RNA, 20 nt, Artificial Sequence
  targeting sequence with CTCN PAM
cuaccugccuguccucaggu

SEQ ID NO: 14732 - RNA, 20 nt, Artificial Sequence
  targeting sequence with CTCN PAM
gguacauccccgagggccug

SEQ ID NO: 14733 - RNA, 20 nt, Artificial Sequence
  targeting sequence with CTCN PAM
gggauguaccugaggacagg

SEQ ID NO: 14734 - RNA, 20 nt, Artificial Sequence
  targeting sequence with CTCN PAM
uguggaaucgacuacuacac

SEQ ID NO: 14735 - RNA, 20 nt, Artificial Sequence
  targeting sequence with CTCN PAM
agccggaggucaacaacgag

SEQ ID NO: 14736 - RNA, 20 nt, Artificial Sequence
  targeting sequence with CTCN PAM
ggcuugagcguguaguaguc

SEQ ID NO: 14737 - RNA, 20 nt, Artificial Sequence
  targeting sequence with CTCN PAM
uuguugaccuccggcuugag

SEQ ID NO: 14738 - RNA, 20 nt, Artificial Sequence
  targeting sequence with CTCN PAM
ucuucaccgucaaggaggua

SEQ ID NO: 14739 - RNA, 20 nt, Artificial Sequence
  targeting sequence with CTCN PAM
uugacggugaagacgagcug

SEQ ID NO: 14740 - RNA, 20 nt, Artificial Sequence
  targeting sequence with CTCN PAM
cggcucugaggguccagccc

SEQ ID NO: 14741 - RNA, 20 nt, Artificial Sequence
  targeting sequence with CTCN PAM
gaggguccagcccccagcau

SEQ ID NO: 14742 - RNA, 20 nt, Artificial Sequence
  targeting sequence with CTCN PAM
gagccgugaggccgcccacc

SEQ ID NO: 14743 - RNA, 20 nt, Artificial Sequence
  targeting sequence with CTCN PAM
ugcucccuggaggagccaug

SEQ ID NO: 14744 - RNA, 20 nt, Artificial Sequence
  targeting sequence with CTCN PAM
cuggaggagccauggucugg

SEQ ID NO: 14745 - RNA, 20 nt, Artificial Sequence
  targeting sequence with CTCN PAM
agggagcaggagccgcagau

SEQ ID NO: 14746 - RNA, 20 nt, Artificial Sequence
  targeting sequence with CTCN PAM
uccagggagcaggagccgca

SEQ ID NO: 14747 - RNA, 20 nt, Artificial Sequence
  targeting sequence with CTCN PAM
ugcugcugggcagcggccug

SEQ ID NO: 14748 - RNA, 20 nt, Artificial Sequence
  targeting sequence with CTCN PAM
gccuucugugugguggcuga

SEQ ID NO: 14749 - RNA, 20 nt, Artificial Sequence
  targeting sequence with CTCN PAM
uucucugccuucuguguggu

SEQ ID NO: 14750 - RNA, 20 nt, Artificial Sequence
  targeting sequence with CTCN PAM
aacuucggucccaucuucau

SEQ ID NO: 14751 - RNA, 20 nt, Artificial Sequence
  targeting sequence with CTCN PAM
uggcaaagaacgcugggaug

SEQ ID NO: 14752 - RNA, 20 nt, Artificial Sequence
  targeting sequence with CTCN PAM
cacccgcaguaggcaccugc

SEQ ID NO: 14753 - RNA, 20 nt, Artificial Sequence
  targeting sequence with CTCN PAM
ccugcccugggaaguagcuu

SEQ ID NO: 14754 - RNA, 20 nt, Artificial Sequence
  targeting sequence with CTCN PAM
aucaggguuacuggcagcag

SEQ ID NO: 14755 - RNA, 20 nt, Artificial Sequence
  targeting sequence with CTCN PAM
ccauugggacugcugaccca

SEQ ID NO: 14756 - RNA, 20 nt, Artificial Sequence
  targeting sequence with CTCN PAM
cacacuccccauugggacug

SEQ ID NO: 14757 - RNA, 20 nt, Artificial Sequence
  targeting sequence with CTCN PAM
gaacugcugaaucucagggu

SEQ ID NO: 14758 - RNA, 20 nt, Artificial Sequence
  targeting sequence with CTCN PAM
gggugggcccaggaaccugc

SEQ ID NO: 14759 - RNA, 20 nt, Artificial Sequence
  targeting sequence with CTCN PAM
acagguggcucagaugcuca

SEQ ID NO: 14760 - RNA, 20 nt, Artificial Sequence
  targeting sequence with CTCN PAM
gaugcucacucaggugggag

SEQ ID NO: 14761 - RNA, 20 nt, Artificial Sequence
  targeting sequence with CTCN PAM
cucaggugggagaagcucca

SEQ ID NO: 14762 - RNA, 20 nt, Artificial Sequence
  targeting sequence with CTCN PAM
ggugggagaagcuccaguca

SEQ ID NO: 14763 - RNA, 20 nt, Artificial Sequence
  targeting sequence with CTCN PAM
caccugagugagcaucugag

SEQ ID NO: 14764 - RNA, 20 nt, Artificial Sequence
  targeting sequence with CTCN PAM
agucagcuaguucuggaagc

SEQ ID NO: 14765 - RNA, 20 nt, Artificial Sequence
  targeting sequence with CTCN PAM
auaaagcugaauaaggagcu

SEQ ID NO: 14766 - RNA, 20 nt, Artificial Sequence
  targeting sequence with CTCN PAM
uuauucagcuuuauggagac

SEQ ID NO: 14767 - RNA, 20 nt, Artificial Sequence
  targeting sequence with CTCN PAM
gaauaagacuuuuuagcucc

SEQ ID NO: 14768 - RNA, 20 nt, Artificial Sequence
  targeting sequence with CTCN PAM
gagagguaccuccgaggggu

SEQ ID NO: 14769 - RNA, 20 nt, Artificial Sequence
  targeting sequence with CTCN PAM
gaggaacccuuuaccccuuu

SEQ ID NO: 14770 - RNA, 20 nt, Artificial Sequence
  targeting sequence with CTCN PAM
ccgaggaacccuuuaccccu

SEQ ID NO: 14771 - RNA, 20 nt, Artificial Sequence
  targeting sequence with CTCN PAM
gagggguaaacaguugggua

SEQ ID NO: 14772 - RNA, 20 nt, Artificial Sequence
  targeting sequence with CTCN PAM
gagguaccucuccgaggaac

SEQ ID NO: 14773 - RNA, 20 nt, Artificial Sequence
  targeting sequence with CTCN PAM
gaagucagcucugccauuuu

SEQ ID NO: 14774 - RNA, 20 nt, Artificial Sequence
  targeting sequence with CTCN PAM
gccauuuucuagcuguaugg

SEQ ID NO: 14775 - RNA, 20 nt, Artificial Sequence
  targeting sequence with CTCN PAM
gugcuuugguuuccucaucc

SEQ ID NO: 14776 - RNA, 20 nt, Artificial Sequence
  targeting sequence with CTCN PAM
uccauagaaagguagaaagg

SEQ ID NO: 14777 - RNA, 20 nt, Artificial Sequence
  targeting sequence with CTCN PAM
uggauuacaagagauaauuu

SEQ ID NO: 14778 - RNA, 20 nt, Artificial Sequence
  targeting sequence with CTCN PAM
uguaauccaagaguuuggug

SEQ ID NO: 14779 - RNA, 20 nt, Artificial Sequence
  targeting sequence with CTCN PAM
gugugccaaggguguucugu

SEQ ID NO: 14780 - RNA, 20 nt, Artificial Sequence
  targeting sequence with CTCN PAM
gucccuggcaucucuagggg

SEQ ID NO: 14781 - RNA, 20 nt, Artificial Sequence
  targeting sequence with CTCN PAM
aggggugaggagcgucugcc

SEQ ID NO: 14782 - RNA, 20 nt, Artificial Sequence
  targeting sequence with CTCN PAM
ccccuagagaugccagggac

SEQ ID NO: 14783 - RNA, 20 nt, Artificial Sequence
  targeting sequence with CTCN PAM
ucaccccuagagaugccagg

SEQ ID NO: 14784 - RNA, 20 nt, Artificial Sequence
  targeting sequence with CTCN PAM
aggaagcuggauuugagugg

SEQ ID NO: 14785 - RNA, 20 nt, Artificial Sequence
  targeting sequence with CTCN PAM
aauccagcuuccuggaggga

SEQ ID NO: 14786 - RNA, 20 nt, Artificial Sequence
  targeting sequence with CTCN PAM
cgauuccagcgccccaucca

SEQ ID NO: 14787 - RNA, 20 nt, Artificial Sequence
  targeting sequence with CTCN PAM
cuaacgugccaguuccaagc

SEQ ID NO: 14788 - RNA, 20 nt, Artificial Sequence
  targeting sequence with CTCN PAM
agccucuugccuuccaguuc

SEQ ID NO: 14789 - RNA, 20 nt, Artificial Sequence
  targeting sequence with CTCN PAM
ugccuuccaguuccggaacu

SEQ ID NO: 14790 - RNA, 20 nt, Artificial Sequence
  targeting sequence with CTCN PAM
ccaccaucugcugcggcaag

SEQ ID NO: 14791 - RNA, 20 nt, Artificial Sequence
  targeting sequence with CTCN PAM
ucgucacccaguggguucuu

SEQ ID NO: 14792 - RNA, 20 nt, Artificial Sequence
  targeting sequence with CTCN PAM
gcuaccguguccaagacgga

SEQ ID NO: 14793 - RNA, 20 nt, Artificial Sequence
  targeting sequence with CTCN PAM
gucuuggacacgguagcaga

SEQ ID NO: 14794 - RNA, 20 nt, Artificial Sequence
  targeting sequence with CTCN PAM
ucuccgucuuggacacggua

SEQ ID NO: 14795 - RNA, 20 nt, Artificial Sequence
  targeting sequence with CTCN PAM
guggccgacuauaggcgucu

SEQ ID NO: 14796 - RNA, 20 nt, Artificial Sequence
  targeting sequence with CTCN PAM
cauccccuacaccuuccccc

SEQ ID NO: 14797 - RNA, 20 nt, Artificial Sequence
  targeting sequence with CTCN PAM
uggugggauggcuguggcug

SEQ ID NO: 14798 - RNA, 20 nt, Artificial Sequence
  targeting sequence with CTCN PAM
uuaauuuuuuuuuuuuuuuu

SEQ ID NO: 14799 - RNA, 20 nt, Artificial Sequence
  targeting sequence with CTCN PAM
uuaauuauuucuuaaaaaaa

SEQ ID NO: 14800 - RNA, 20 nt, Artificial Sequence
  targeting sequence with CTCN PAM
ucacucaccugggacagccu

SEQ ID NO: 14801 - RNA, 20 nt, Artificial Sequence
  targeting sequence with CTCN PAM
cucaccugggacagccugag

SEQ ID NO: 14802 - RNA, 20 nt, Artificial Sequence
  targeting sequence with CTCN PAM
ccugggacagccugagaagg

SEQ ID NO: 14803 - RNA, 20 nt, Artificial Sequence
  targeting sequence with CTCN PAM
ggcugucccaggugagugag

SEQ ID NO: 14804 - RNA, 20 nt, Artificial Sequence
  targeting sequence with CTCN PAM
agaucaguaggucuuggugg

SEQ ID NO: 14805 - RNA, 20 nt, Artificial Sequence
  targeting sequence with CTCN PAM
uccucccaacucaucuuuca

SEQ ID NO: 14806 - RNA, 20 nt, Artificial Sequence
  targeting sequence with CTCN PAM
ucccaacucaucuuucagga

SEQ ID NO: 14807 - RNA, 20 nt, Artificial Sequence
  targeting sequence with CTCN PAM
caacucaucuuucaggaaca

SEQ ID NO: 14808 - RNA, 20 nt, Artificial Sequence
  targeting sequence with CTCN PAM
ucuuucaggaacacgaggau

SEQ ID NO: 14809 - RNA, 20 nt, Artificial Sequence
  targeting sequence with CTCN PAM
uguuccugaaagaugaguug

SEQ ID NO: 14810 - RNA, 20 nt, Artificial Sequence
  targeting sequence with CTCN PAM
auuccuuccugcauccaucc

SEQ ID NO: 14811 - RNA, 20 nt, Artificial Sequence
  targeting sequence with CTCN PAM
cuucccauucauuccuccau

SEQ ID NO: 14812 - RNA, 20 nt, Artificial Sequence
  targeting sequence with CTCN PAM
cagacccucgcagcagcagc

SEQ ID NO: 14813 - RNA, 20 nt, Artificial Sequence
  targeting sequence with CTCN PAM
gacccucgcagcagcagcaa

SEQ ID NO: 14814 - RNA, 20 nt, Artificial Sequence
  targeting sequence with CTCN PAM
cagcagcagcaacucauacu

SEQ ID NO: 14815 - RNA, 20 nt, Artificial Sequence
  targeting sequence with CTCN PAM
uacuuggcuaaugauaugga

SEQ ID NO: 14816 - RNA, 20 nt, Artificial Sequence
  targeting sequence with CTCN PAM
auaucauuagccaaguauga

SEQ ID NO: 14817 - RNA, 20 nt, Artificial Sequence
  targeting sequence with CTCN PAM
cugggccucacuuucuucuc

SEQ ID NO: 14818 - RNA, 20 nt, Artificial Sequence
  targeting sequence with CTCN PAM
cuuucuucuccuauaaaaug

SEQ ID NO: 14819 - RNA, 20 nt, Artificial Sequence
  targeting sequence with CTCN PAM
uauaaaauggaaaucccaga

SEQ ID NO: 14820 - RNA, 20 nt, Artificial Sequence
  targeting sequence with CTCN PAM
guagcugcgugucggcagga

SEQ ID NO: 14821 - RNA, 20 nt, Artificial Sequence
  targeting sequence with CTCN PAM
uuuggucuucucaguagcug

SEQ ID NO: 14822 - RNA, 20 nt, Artificial Sequence
  targeting sequence with CTCN PAM
ugauagugaacauuuugaga

SEQ ID NO: 14823 - RNA, 20 nt, Artificial Sequence
  targeting sequence with CTCN PAM
aaauguucacuaucaggagg

SEQ ID NO: 14824 - RNA, 20 nt, Artificial Sequence
  targeting sequence with CTCN PAM
cccaguguuguuuuuucagg

SEQ ID NO: 14825 - RNA, 20 nt, Artificial Sequence
  targeting sequence with CTCN PAM
uugggaacuuggccuucacc

SEQ ID NO: 14826 - RNA, 20 nt, Artificial Sequence
  targeting sequence with CTCN PAM
cccucauugggaacuuggcc

SEQ ID NO: 14827 - RNA, 20 nt, Artificial Sequence
  targeting sequence with CTCN PAM
ccccuaguguggggccccag

SEQ ID NO: 14828 - RNA, 20 nt, Artificial Sequence
  targeting sequence with CTCN PAM
ccuucccaauguggccuaug

SEQ ID NO: 14829 - RNA, 20 nt, Artificial Sequence
  targeting sequence with CTCN PAM
auaggccacauugggaaggg

SEQ ID NO: 14830 - RNA, 20 nt, Artificial Sequence
  targeting sequence with CTCN PAM
ccauaggccacauugggaag

SEQ ID NO: 14831 - RNA, 20 nt, Artificial Sequence
  targeting sequence with CTCN PAM
cagccucuggaagccaccug

SEQ ID NO: 14832 - RNA, 20 nt, Artificial Sequence
  targeting sequence with CTCN PAM
gccucuggaagccaccugcu

SEQ ID NO: 14833 - RNA, 20 nt, Artificial Sequence
  targeting sequence with CTCN PAM
ggaagccaccugcucuuuug

SEQ ID NO: 14834 - RNA, 20 nt, Artificial Sequence
  targeting sequence with CTCN PAM
uuugcucuagcaccuggguc

SEQ ID NO: 14835 - RNA, 20 nt, Artificial Sequence
  targeting sequence with CTCN PAM
agcaccugggucccagcauc

SEQ ID NO: 14836 - RNA, 20 nt, Artificial Sequence
  targeting sequence with CTCN PAM
agaugcugggacccaggugc

SEQ ID NO: 14837 - RNA, 20 nt, Artificial Sequence
  targeting sequence with CTCN PAM
augcucuagaugcugggacc

SEQ ID NO: 14838 - RNA, 20 nt, Artificial Sequence
  targeting sequence with CTCN PAM
agaagccaugcucacccgcc

SEQ ID NO: 14839 - RNA, 20 nt, Artificial Sequence
  targeting sequence with CTCN PAM
cccgcccacauuuaauuaac

SEQ ID NO: 14840 - RNA, 20 nt, Artificial Sequence
  targeting sequence with CTCN PAM
gcuguuaauuaaaugugggc

SEQ ID NO: 14841 - RNA, 20 nt, Artificial Sequence
  targeting sequence with CTCN PAM
aagagcuuagaaacaaagag

SEQ ID NO: 14842 - RNA, 20 nt, Artificial Sequence
  targeting sequence with CTCN PAM
ucgagauaaggaugacauca

SEQ ID NO: 14843 - RNA, 20 nt, Artificial Sequence
  targeting sequence with CTCN PAM
uuguuucuaagcucuucgag

SEQ ID NO: 14844 - RNA, 20 nt, Artificial Sequence
  targeting sequence with CTCN PAM
auucuggagaaucugcucca

SEQ ID NO: 14845 - RNA, 20 nt, Artificial Sequence
  targeting sequence with CTCN PAM
agaauggagaauggacuagc

SEQ ID NO: 14846 - RNA, 20 nt, Artificial Sequence
  targeting sequence with CTCN PAM
aaaaagcuggccacaucucu

SEQ ID NO: 14847 - RNA, 20 nt, Artificial Sequence
  targeting sequence with CTCN PAM
gaggugucagaauuaagcug

SEQ ID NO: 14848 - RNA, 20 nt, Artificial Sequence
  targeting sequence with CTCN PAM
gagauguggccagcuuuuug

SEQ ID NO: 14849 - RNA, 20 nt, Artificial Sequence
  targeting sequence with CTCN PAM
guaacugcucccccuucucc

SEQ ID NO: 14850 - RNA, 20 nt, Artificial Sequence
  targeting sequence with CTCN PAM
cccuucuccauauaagcaaa

SEQ ID NO: 14851 - RNA, 20 nt, Artificial Sequence
  targeting sequence with CTCN PAM
auauaagcaaagccagaagc

SEQ ID NO: 14852 - RNA, 20 nt, Artificial Sequence
  targeting sequence with CTCN PAM
agcuuuacccagcucugccu

SEQ ID NO: 14853 - RNA, 20 nt, Artificial Sequence
  targeting sequence with CTCN PAM
gccuggagacuaaggcaaau

SEQ ID NO: 14854 - RNA, 20 nt, Artificial Sequence
  targeting sequence with CTCN PAM
aggcagagcuggguaaagcu

SEQ ID NO: 14855 - RNA, 20 nt, Artificial Sequence
  targeting sequence with CTCN PAM
gcuccuauguugguauuaac

SEQ ID NO: 14856 - RNA, 20 nt, Artificial Sequence
  targeting sequence with CTCN PAM
uauguugguauuaacggugg

SEQ ID NO: 14857 - RNA, 20 nt, Artificial Sequence
  targeting sequence with CTCN PAM
auccacaggauagauugaaa

SEQ ID NO: 14858 - RNA, 20 nt, Artificial Sequence
  targeting sequence with CTCN PAM
auccagccaucccaggguca

SEQ ID NO: 14859 - RNA, 20 nt, Artificial Sequence
  targeting sequence with CTCN PAM
uugcucaauccagccauccc

SEQ ID NO: 14860 - RNA, 20 nt, Artificial Sequence
  targeting sequence with CTCN PAM
gcucauugcucaauccagcc

SEQ ID NO: 14861 - RNA, 20 nt, Artificial Sequence
  targeting sequence with CTCN PAM
gugcugcuuggcucugcuca

SEQ ID NO: 14862 - RNA, 20 nt, Artificial Sequence
  targeting sequence with CTCN PAM
agccccaggggacucugugc

SEQ ID NO: 14863 - RNA, 20 nt, Artificial Sequence
  targeting sequence with CTCN PAM
accucuagccccaggggacu

SEQ ID NO: 14864 - RNA, 20 nt, Artificial Sequence
  targeting sequence with CTCN PAM
uccaccucuagccccagggg

SEQ ID NO: 14865 - RNA, 20 nt, Artificial Sequence
  targeting sequence with CTCN PAM
augaccccaaaguugggguu

SEQ ID NO: 14866 - RNA, 20 nt, Artificial Sequence
  targeting sequence with CTCN PAM
cagagcuuccuuaucugcaa

SEQ ID NO: 14867 - RNA, 20 nt, Artificial Sequence
  targeting sequence with CTCN PAM
gagcuuccuuaucugcaaaa

SEQ ID NO: 14868 - RNA, 20 nt, Artificial Sequence
  targeting sequence with CTCN PAM
gagaggugacaaagcuuguu

SEQ ID NO: 14869 - RNA, 20 nt, Artificial Sequence
  targeting sequence with CTCN PAM
caccucuaaucccagcacuu

SEQ ID NO: 14870 - RNA, 20 nt, Artificial Sequence
  targeting sequence with CTCN PAM
aaucccagcacuuugggagg

SEQ ID NO: 14871 - RNA, 20 nt, Artificial Sequence
  targeting sequence with CTCN PAM
caaagugcugggauuagagg

SEQ ID NO: 14872 - RNA, 20 nt, Artificial Sequence
  targeting sequence with CTCN PAM
ugaucugcccaccuuggccu

SEQ ID NO: 14873 - RNA, 20 nt, Artificial Sequence
  targeting sequence with CTCN PAM
ugaccucgugaucugcccac

SEQ ID NO: 14874 - RNA, 20 nt, Artificial Sequence
  targeting sequence with CTCN PAM
aacuccugaccucgugaucu

SEQ ID NO: 14875 - RNA, 20 nt, Artificial Sequence
  targeting sequence with CTCN PAM
acuaaaaauacaaaaaucag

SEQ ID NO: 14876 - RNA, 20 nt, Artificial Sequence
  targeting sequence with CTCN PAM
gcccacugaauagcugggau

SEQ ID NO: 14877 - RNA, 20 nt, Artificial Sequence
  targeting sequence with CTCN PAM
ugccucagcccacugaauag

SEQ ID NO: 14878 - RNA, 20 nt, Artificial Sequence
  targeting sequence with CTCN PAM
cagguucaagcgauucuccu

SEQ ID NO: 14879 - RNA, 20 nt, Artificial Sequence
  targeting sequence with CTCN PAM
accucccagguucaagcgau

SEQ ID NO: 14880 - RNA, 20 nt, Artificial Sequence
  targeting sequence with CTCN PAM
cugcaaccuccaccucccag

SEQ ID NO: 14881 - RNA, 20 nt, Artificial Sequence
  targeting sequence with CTCN PAM
gcucacugcaaccuccaccu

SEQ ID NO: 14882 - RNA, 20 nt, Artificial Sequence
  targeting sequence with CTCN PAM
agccugagcaacagagggac

SEQ ID NO: 14883 - RNA, 20 nt, Artificial Sequence
  targeting sequence with CTCN PAM
ggcuggagugcaguggcgca

SEQ ID NO: 14884 - RNA, 20 nt, Artificial Sequence
  targeting sequence with CTCN PAM
guugcucaggcuggagugca

SEQ ID NO: 14885 - RNA, 20 nt, Artificial Sequence
  targeting sequence with CTCN PAM
aaacaaaacaaaacaaacaa

SEQ ID NO: 14886 - RNA, 20 nt, Artificial Sequence
  targeting sequence with CTCN PAM
ucugcugcaugccaggcagu

SEQ ID NO: 14887 - RNA, 20 nt, Artificial Sequence
  targeting sequence with CTCN PAM
gagcuggccuuacuagagac

SEQ ID NO: 14888 - RNA, 20 nt, Artificial Sequence
  targeting sequence with CTCN PAM
gagcugaagcccaguauugc

SEQ ID NO: 14889 - RNA, 20 nt, Artificial Sequence
  targeting sequence with CTCN PAM
aguaaggccagcucugagcu

SEQ ID NO: 14890 - RNA, 20 nt, Artificial Sequence
  targeting sequence with CTCN PAM
auccuuuuccccuuugggac

SEQ ID NO: 14891 - RNA, 20 nt, Artificial Sequence
  targeting sequence with CTCN PAM
cgagagucacccccuccucc

SEQ ID NO: 14892 - RNA, 20 nt, Artificial Sequence
  targeting sequence with CTCN PAM
ggagcuuuagcuccauccuu

SEQ ID NO: 14893 - RNA, 20 nt, Artificial Sequence
  targeting sequence with CTCN PAM
cgggagcuuuagcuccaucc

SEQ ID NO: 14894 - RNA, 20 nt, Artificial Sequence
  targeting sequence with CTCN PAM
uccgaggugagaaaggaggg

SEQ ID NO: 14895 - RNA, 20 nt, Artificial Sequence
  targeting sequence with CTCN PAM
gaggugagaaaggagggcag

SEQ ID NO: 14896 - RNA, 20 nt, Artificial Sequence
  targeting sequence with CTCN PAM
gaggagggggugacucucgg

SEQ ID NO: 14897 - RNA, 20 nt, Artificial Sequence
  targeting sequence with CTCN PAM
ccucggaggagggggugacu

SEQ ID NO: 14898 - RNA, 20 nt, Artificial Sequence
  targeting sequence with CTCN PAM
uuucucaccucggaggaggg

SEQ ID NO: 14899 - RNA, 20 nt, Artificial Sequence
  targeting sequence with CTCN PAM
ugcccuccuuucucaccucg

SEQ ID NO: 14900 - RNA, 20 nt, Artificial Sequence
  targeting sequence with CTCN PAM
ugcuccugcccuccuuucuc

SEQ ID NO: 14901 - RNA, 20 nt, Artificial Sequence
  targeting sequence with CTCN PAM
gugccuuggugaggcugggg

SEQ ID NO: 14902 - RNA, 20 nt, Artificial Sequence
  targeting sequence with CTCN PAM
ccaaggcaccgaggaucggc

SEQ ID NO: 14903 - RNA, 20 nt, Artificial Sequence
  targeting sequence with CTCN PAM
aucauugucccucuuuacug

SEQ ID NO: 14904 - RNA, 20 nt, Artificial Sequence
  targeting sequence with CTCN PAM
uuacugugacucacuagaua

SEQ ID NO: 14905 - RNA, 20 nt, Artificial Sequence
  targeting sequence with CTCN PAM
cuagauaauaucagucagga

SEQ ID NO: 14906 - RNA, 20 nt, Artificial Sequence
  targeting sequence with CTCN PAM
uuugggcugaagcaaaaggg

SEQ ID NO: 14907 - RNA, 20 nt, Artificial Sequence
  targeting sequence with CTCN PAM
caugaacaaaaagcccgggg

SEQ ID NO: 14908 - RNA, 20 nt, Artificial Sequence
  targeting sequence with CTCN PAM
gucauggugauacccugugc

SEQ ID NO: 14909 - RNA, 20 nt, Artificial Sequence
  targeting sequence with CTCN PAM
uuuaugccugagguugcaau

SEQ ID NO: 14910 - RNA, 20 nt, Artificial Sequence
  targeting sequence with CTCN PAM
ggcauaaaugaguuacguau

SEQ ID NO: 14911 - RNA, 20 nt, Artificial Sequence
  targeting sequence with CTCN PAM
aggucaucgccaaggucuga

SEQ ID NO: 14912 - RNA, 20 nt, Artificial Sequence
  targeting sequence with CTCN PAM
cacaugcuuagcguuccaau

SEQ ID NO: 14913 - RNA, 20 nt, Artificial Sequence
  targeting sequence with CTCN PAM
gauuggucagaccuagguca

SEQ ID NO: 14914 - RNA, 20 nt, Artificial Sequence
  targeting sequence with CTCN PAM
cccugcagcccaagcaggcu

SEQ ID NO: 14915 - RNA, 20 nt, Artificial Sequence
  targeting sequence with CTCN PAM
ccauucagccugcuugggcu

SEQ ID NO: 14916 - RNA, 20 nt, Artificial Sequence
  targeting sequence with CTCN PAM
ccccauucagccugcuuggg

SEQ ID NO: 14917 - RNA, 20 nt, Artificial Sequence
  targeting sequence with CTCN PAM
uacuucagguaacagcaccu

SEQ ID NO: 14918 - RNA, 20 nt, Artificial Sequence
  targeting sequence with CTCN PAM
ugcccuccuacuucagguaa

SEQ ID NO: 14919 - RNA, 20 nt, Artificial Sequence
  targeting sequence with CTCN PAM
cccugccuccugcccuccua

SEQ ID NO: 14920 - RNA, 20 nt, Artificial Sequence
  targeting sequence with CTCN PAM
gcucacccugccuccugccc

SEQ ID NO: 14921 - RNA, 20 nt, Artificial Sequence
  targeting sequence with CTCN PAM
ggguugauguuggcucugcu

SEQ ID NO: 14922 - RNA, 20 nt, Artificial Sequence
  targeting sequence with CTCN PAM
cucccucaucaucucaggga

SEQ ID NO: 14923 - RNA, 20 nt, Artificial Sequence
  targeting sequence with CTCN PAM
cucaucaucucagggacaug

SEQ ID NO: 14924 - RNA, 20 nt, Artificial Sequence
  targeting sequence with CTCN PAM
ucaucucagggacaugaggg

SEQ ID NO: 14925 - RNA, 20 nt, Artificial Sequence
  targeting sequence with CTCN PAM
gggacaugagggagaagauu

SEQ ID NO: 14926 - RNA, 20 nt, Artificial Sequence
  targeting sequence with CTCN PAM
ugucccugagaugaugaggg

SEQ ID NO: 14927 - RNA, 20 nt, Artificial Sequence
  targeting sequence with CTCN PAM
cucaugucccugagaugaug

SEQ ID NO: 14928 - RNA, 20 nt, Artificial Sequence
  targeting sequence with CTCN PAM
cccuuuguuuuggaugcugu

SEQ ID NO: 14929 - RNA, 20 nt, Artificial Sequence
  targeting sequence with CTCN PAM
ccgccccaaccccaacccag

SEQ ID NO: 14930 - RNA, 20 nt, Artificial Sequence
  targeting sequence with CTCN PAM
gaaaaagugggcuggguugg

SEQ ID NO: 14931 - RNA, 20 nt, Artificial Sequence
  targeting sequence with CTCN PAM
uguccagaggaaaauuuuac

SEQ ID NO: 14932 - RNA, 20 nt, Artificial Sequence
  targeting sequence with CTCN PAM
ggacaugaggcuggggcaaa

SEQ ID NO: 14933 - RNA, 20 nt, Artificial Sequence
  targeting sequence with CTCN PAM
aacaccagaacauucucugg

SEQ ID NO: 14934 - RNA, 20 nt, Artificial Sequence
  targeting sequence with CTCN PAM
gguuuguccugauagacaag

SEQ ID NO: 14935 - RNA, 20 nt, Artificial Sequence
  targeting sequence with CTCN PAM
accuccuuaauuuacaaaug

SEQ ID NO: 14936 - RNA, 20 nt, Artificial Sequence
  targeting sequence with CTCN PAM
uuaauuuacaaaugacuuga

SEQ ID NO: 14937 - RNA, 20 nt, Artificial Sequence
  targeting sequence with CTCN PAM
uuauguaugcaagugcccac

SEQ ID NO: 14938 - RNA, 20 nt, Artificial Sequence
  targeting sequence with CTCN PAM
uucucuuuauguaugcaagu

SEQ ID NO: 14939 - RNA, 20 nt, Artificial Sequence
  targeting sequence with CTCN PAM
ucuccaggcagccagcagau

SEQ ID NO: 14940 - RNA, 20 nt, Artificial Sequence
  targeting sequence with CTCN PAM
aggcagccagcagauguaca

SEQ ID NO: 14941 - RNA, 20 nt, Artificial Sequence
  targeting sequence with CTCN PAM
guacaucugcuggcugccug

SEQ ID NO: 14942 - RNA, 20 nt, Artificial Sequence
  targeting sequence with CTCN PAM
uggguacaauggcagcucca

SEQ ID NO: 14943 - RNA, 20 nt, Artificial Sequence
  targeting sequence with CTCN PAM
auucaaccaaaccugagcaa

SEQ ID NO: 14944 - RNA, 20 nt, Artificial Sequence
  targeting sequence with CTCN PAM
gguuugguugaauggagcug

SEQ ID NO: 14945 - RNA, 20 nt, Artificial Sequence
  targeting sequence with CTCN PAM
gagaugaauuggagccuaga

SEQ ID NO: 14946 - RNA, 20 nt, Artificial Sequence
  targeting sequence with CTCN PAM
gaguccccagugcauucugg

SEQ ID NO: 14947 - RNA, 20 nt, Artificial Sequence
  targeting sequence with CTCN PAM
aauucaucuccgagucccca

SEQ ID NO: 14948 - RNA, 20 nt, Artificial Sequence
  targeting sequence with CTCN PAM
aggcuccaauucaucuccga

SEQ ID NO: 14949 - RNA, 20 nt, Artificial Sequence
  targeting sequence with CTCN PAM
aggcuaugaccugggcugcc

SEQ ID NO: 14950 - RNA, 20 nt, Artificial Sequence
  targeting sequence with CTCN PAM
cggccacagagcucugucac

SEQ ID NO: 14951 - RNA, 20 nt, Artificial Sequence
  targeting sequence with CTCN PAM
guggccgugaggcagcccag

SEQ ID NO: 14952 - RNA, 20 nt, Artificial Sequence
  targeting sequence with CTCN PAM
gucacgccaagggagagaug

SEQ ID NO: 14953 - RNA, 20 nt, Artificial Sequence
  targeting sequence with CTCN PAM
cuuggcgugacagagcucug

SEQ ID NO: 14954 - RNA, 20 nt, Artificial Sequence
  targeting sequence with CTCN PAM
cccuuggcgugacagagcuc

SEQ ID NO: 14955 - RNA, 20 nt, Artificial Sequence
  targeting sequence with CTCN PAM
ggcuuucaggggugcaucuc

SEQ ID NO: 14956 - RNA, 20 nt, Artificial Sequence
  targeting sequence with CTCN PAM
uuauggggcaccucaggcuu

SEQ ID NO: 14957 - RNA, 20 nt, Artificial Sequence
  targeting sequence with CTCN PAM
ccuuauggggcaccucaggc

SEQ ID NO: 14958 - RNA, 20 nt, Artificial Sequence
  targeting sequence with CTCN PAM
cuccuuauggggcaccucag

SEQ ID NO: 14959 - RNA, 20 nt, Artificial Sequence
  targeting sequence with CTCN PAM
uucuuucuuuuucuuucuuu

SEQ ID NO: 14960 - RNA, 20 nt, Artificial Sequence
  targeting sequence with CTCN PAM
uucuuucuuucuuucuuucu

SEQ ID NO: 14961 - RNA, 20 nt, Artificial Sequence
  targeting sequence with CTCN PAM
uuccuuccuuccuugcuucu

SEQ ID NO: 14962 - RNA, 20 nt, Artificial Sequence
  targeting sequence with CTCN PAM
aaaaaaaaaaagaaaagaaa

SEQ ID NO: 14963 - RNA, 20 nt, Artificial Sequence
  targeting sequence with CTCN PAM
cuuugucacccagacuggag

SEQ ID NO: 14964 - RNA, 20 nt, Artificial Sequence
  targeting sequence with CTCN PAM
agucugggugacaaagugag

SEQ ID NO: 14965 - RNA, 20 nt, Artificial Sequence
  targeting sequence with CTCN PAM
uagcucacuguagccucgac

SEQ ID NO: 14966 - RNA, 20 nt, Artificial Sequence
  targeting sequence with CTCN PAM
cuguagccucgacuucucag

SEQ ID NO: 14967 - RNA, 20 nt, Artificial Sequence
  targeting sequence with CTCN PAM
acuucucaguuucaagcaau

SEQ ID NO: 14968 - RNA, 20 nt, Artificial Sequence
  targeting sequence with CTCN PAM
guuucaagcaauccuucugu

SEQ ID NO: 14969 - RNA, 20 nt, Artificial Sequence
  targeting sequence with CTCN PAM
gccucucaaguagccaggac

SEQ ID NO: 14970 - RNA, 20 nt, Artificial Sequence
  targeting sequence with CTCN PAM
caaguagccaggaccacagg

SEQ ID NO: 14971 - RNA, 20 nt, Artificial Sequence
  targeting sequence with CTCN PAM
aguagccaggaccacaggca

SEQ ID NO: 14972 - RNA, 20 nt, Artificial Sequence
  targeting sequence with CTCN PAM
acaaaaaauaaaaaauaagu

SEQ ID NO: 14973 - RNA, 20 nt, Artificial Sequence
  targeting sequence with CTCN PAM
aucuccacaaaaaauaaaaa

SEQ ID NO: 14974 - RNA, 20 nt, Artificial Sequence
  targeting sequence with CTCN PAM
cuauguugcccaggcugguu

SEQ ID NO: 14975 - RNA, 20 nt, Artificial Sequence
  targeting sequence with CTCN PAM
aacgauccuccugccuuggc

SEQ ID NO: 14976 - RNA, 20 nt, Artificial Sequence
  targeting sequence with CTCN PAM
ugccuuggccucucaaagug

SEQ ID NO: 14977 - RNA, 20 nt, Artificial Sequence
  targeting sequence with CTCN PAM
caaagugcugcgacuacagg

SEQ ID NO: 14978 - RNA, 20 nt, Artificial Sequence
  targeting sequence with CTCN PAM
aagugcugcgacuacaggca

SEQ ID NO: 14979 - RNA, 20 nt, Artificial Sequence
  targeting sequence with CTCN PAM
ugccuguagucgcagcacuu

SEQ ID NO: 14980 - RNA, 20 nt, Artificial Sequence
  targeting sequence with CTCN PAM
aagacucaggccccucagcu

SEQ ID NO: 14981 - RNA, 20 nt, Artificial Sequence
  targeting sequence with CTCN PAM
ggccccucagcuauaaagga

SEQ ID NO: 14982 - RNA, 20 nt, Artificial Sequence
  targeting sequence with CTCN PAM
gcuauaaaggagagaauuau

SEQ ID NO: 14983 - RNA, 20 nt, Artificial Sequence
  targeting sequence with CTCN PAM
uuuauagcugaggggccuga

SEQ ID NO: 14984 - RNA, 20 nt, Artificial Sequence
  targeting sequence with CTCN PAM
ccuuuauagcugaggggccu

SEQ ID NO: 14985 - RNA, 20 nt, Artificial Sequence
  targeting sequence with CTCN PAM
gggaagggaauucacauuua

SEQ ID NO: 14986 - RNA, 20 nt, Artificial Sequence
  targeting sequence with CTCN PAM
gaacuuaguucaugucucug

SEQ ID NO: 14987 - RNA, 20 nt, Artificial Sequence
  targeting sequence with CTCN PAM
ucugaacuuaguucaugucu

SEQ ID NO: 14988 - RNA, 20 nt, Artificial Sequence
  targeting sequence with CTCN PAM
uuacaagucaauuucccacc

SEQ ID NO: 14989 - RNA, 20 nt, Artificial Sequence
  targeting sequence with CTCN PAM
guguuaaucuccuuacaagu

SEQ ID NO: 14990 - RNA, 20 nt, Artificial Sequence
  targeting sequence with CTCN PAM
cuguguuaaucuccuuacaa

SEQ ID NO: 14991 - RNA, 20 nt, Artificial Sequence
  targeting sequence with CTCN PAM
acacaagacagcaucuuucg

SEQ ID NO: 14992 - RNA, 20 nt, Artificial Sequence
  targeting sequence with CTCN PAM
gaaaugaugugugcagucuc

SEQ ID NO: 14993 - RNA, 20 nt, Artificial Sequence
  targeting sequence with CTCN PAM
agguugugcauuuuggagaa

SEQ ID NO: 14994 - RNA, 20 nt, Artificial Sequence
  targeting sequence with CTCN PAM
aaaaugcacaaccuagagac

SEQ ID NO: 14995 - RNA, 20 nt, Artificial Sequence
  targeting sequence with CTCN PAM
uuuuccucucaucuuuucuu

SEQ ID NO: 14996 - RNA, 20 nt, Artificial Sequence
  targeting sequence with CTCN PAM
caucuuuucuuccugcuggc

SEQ ID NO: 14997 - RNA, 20 nt, Artificial Sequence
  targeting sequence with CTCN PAM
ucuuuucuuccugcuggcug

SEQ ID NO: 14998 - RNA, 20 nt, Artificial Sequence
  targeting sequence with CTCN PAM
agucaucaugacugcuuucc

SEQ ID NO: 14999 - RNA, 20 nt, Artificial Sequence
  targeting sequence with CTCN PAM
ugaucuaauaugggugcgga

SEQ ID NO: 15000 - RNA, 20 nt, Artificial Sequence
  targeting sequence with CTCN PAM
gauucuaucucaugaucuaa

SEQ ID NO: 15001 - RNA, 20 nt, Artificial Sequence
  targeting sequence with CTCN PAM
guccucagauucuaucucau

SEQ ID NO: 15002 - RNA, 20 nt, Artificial Sequence
  targeting sequence with CTCN PAM
ggugugucucaccaugguuc

SEQ ID NO: 15003 - RNA, 20 nt, Artificial Sequence
  targeting sequence with CTCN PAM
ccaugguucccccaugcugc

SEQ ID NO: 15004 - RNA, 20 nt, Artificial Sequence
  targeting sequence with CTCN PAM
uuaagcauaaguuggccagg

SEQ ID NO: 15005 - RNA, 20 nt, Artificial Sequence
  targeting sequence with CTCN PAM
ugaaacucuuuaagcauaag

SEQ ID NO: 15006 - RNA, 20 nt, Artificial Sequence
  targeting sequence with CTCN PAM
ucccucuugaaacucuuuaa

SEQ ID NO: 15007 - RNA, 20 nt, Artificial Sequence
  targeting sequence with CTCN PAM
aaaaucacaagugacuuaaa

SEQ ID NO: 15008 - RNA, 20 nt, Artificial Sequence
  targeting sequence with CTCN PAM
cucccucccucccucccucc

SEQ ID NO: 15009 - RNA, 20 nt, Artificial Sequence
  targeting sequence with CTCN PAM
cucccucccucccucccucc

SEQ ID NO: 15010 - RNA, 20 nt, Artificial Sequence
  targeting sequence with CTCN PAM
cucccucccucccucccuuc

SEQ ID NO: 15011 - RNA, 20 nt, Artificial Sequence
  targeting sequence with CTCN PAM
cucccucccucccuuccuuc

SEQ ID NO: 15012 - RNA, 20 nt, Artificial Sequence
  targeting sequence with CTCN PAM
cucccucccuuccuuccuuc

SEQ ID NO: 15013 - RNA, 20 nt, Artificial Sequence
  targeting sequence with CTCN PAM
cucccuuccuuccuuccuuc

SEQ ID NO: 15014 - RNA, 20 nt, Artificial Sequence
  targeting sequence with CTCN PAM
cuuccuuccuuccuuccuuc

SEQ ID NO: 15015 - RNA, 20 nt, Artificial Sequence
  targeting sequence with CTCN PAM
gaaaagaaagaaggaaagga

SEQ ID NO: 15016 - RNA, 20 nt, Artificial Sequence
  targeting sequence with CTCN PAM
gucucagaaaagaaagaagg

SEQ ID NO: 15017 - RNA, 20 nt, Artificial Sequence
  targeting sequence with CTCN PAM
auugcccaggcuggagugca

SEQ ID NO: 15018 - RNA, 20 nt, Artificial Sequence
  targeting sequence with CTCN PAM
agccugggcaauagagcaag

SEQ ID NO: 15019 - RNA, 20 nt, Artificial Sequence
  targeting sequence with CTCN PAM
cuacaaccucuaccuccugg

SEQ ID NO: 15020 - RNA, 20 nt, Artificial Sequence
  targeting sequence with CTCN PAM
accuccuggguucaagcaau

SEQ ID NO: 15021 - RNA, 20 nt, Artificial Sequence
  targeting sequence with CTCN PAM
uggguucaagcaauucuccu

SEQ ID NO: 15022 - RNA, 20 nt, Artificial Sequence
  targeting sequence with CTCN PAM
ugccucagccucccgaguag

SEQ ID NO: 15023 - RNA, 20 nt, Artificial Sequence
  targeting sequence with CTCN PAM
gccucccgaguagcugggau

SEQ ID NO: 15024 - RNA, 20 nt, Artificial Sequence
  targeting sequence with CTCN PAM
cgaguagcugggauuacagg

SEQ ID NO: 15025 - RNA, 20 nt, Artificial Sequence
  targeting sequence with CTCN PAM
ggaggcugaggcaggagaau

SEQ ID NO: 15026 - RNA, 20 nt, Artificial Sequence
  targeting sequence with CTCN PAM
acuaaaaauacaaaaaauua

SEQ ID NO: 15027 - RNA, 20 nt, Artificial Sequence
  targeting sequence with CTCN PAM
ugagcucaaguaauccgccu

SEQ ID NO: 15028 - RNA, 20 nt, Artificial Sequence
  targeting sequence with CTCN PAM
ggaguucaagaucagccugg

SEQ ID NO: 15029 - RNA, 20 nt, Artificial Sequence
  targeting sequence with CTCN PAM
aguaauccgccugccucagc

SEQ ID NO: 15030 - RNA, 20 nt, Artificial Sequence
  targeting sequence with CTCN PAM
gccucccaaagugcugagau

SEQ ID NO: 15031 - RNA, 20 nt, Artificial Sequence
  targeting sequence with CTCN PAM
caaagugcugagauuacagg

SEQ ID NO: 15032 - RNA, 20 nt, Artificial Sequence
  targeting sequence with CTCN PAM
gcacuuugggaggcugaggc

SEQ ID NO: 15033 - RNA, 20 nt, Artificial Sequence
  targeting sequence with CTCN PAM
ugccuguaaucucagcacuu

SEQ ID NO: 15034 - RNA, 20 nt, Artificial Sequence
  targeting sequence with CTCN PAM
ggaagaucgaagugcagguc

SEQ ID NO: 15035 - RNA, 20 nt, Artificial Sequence
  targeting sequence with CTCN PAM
cugaacuucagcuucuccau

SEQ ID NO: 15036 - RNA, 20 nt, Artificial Sequence
  targeting sequence with CTCN PAM
gaacuucagcuucuccaugu

SEQ ID NO: 15037 - RNA, 20 nt, Artificial Sequence
  targeting sequence with CTCN PAM
auguauaaauaaaauaguga

SEQ ID NO: 15038 - RNA, 20 nt, Artificial Sequence
  targeting sequence with CTCN PAM
agccccuguaacaucaggac

SEQ ID NO: 15039 - RNA, 20 nt, Artificial Sequence
  targeting sequence with CTCN PAM
gcagaaguuacauuucauac

SEQ ID NO: 15040 - RNA, 20 nt, Artificial Sequence
  targeting sequence with CTCN PAM
guaaaaaaucacagaagcuc

SEQ ID NO: 15041 - RNA, 20 nt, Artificial Sequence
  targeting sequence with CTCN PAM
ccaagcggcccguugucccu

SEQ ID NO: 15042 - RNA, 20 nt, Artificial Sequence
  targeting sequence with CTCN PAM
gaauuaccauuucccuguaa

SEQ ID NO: 15043 - RNA, 20 nt, Artificial Sequence
  targeting sequence with CTCN PAM
agaggaauuuuuagaucaug

SEQ ID NO: 15044 - RNA, 20 nt, Artificial Sequence
  targeting sequence with CTCN PAM
agaggauugccuuuuuacag

SEQ ID NO: 15045 - RNA, 20 nt, Artificial Sequence
  targeting sequence with CTCN PAM
aaaaugugcugcaugaucua

SEQ ID NO: 15046 - RNA, 20 nt, Artificial Sequence
  targeting sequence with CTCN PAM
cggcugugccaggaucaagu

SEQ ID NO: 15047 - RNA, 20 nt, Artificial Sequence
  targeting sequence with CTCN PAM
ugggaauguuucuaucacug

SEQ ID NO: 15048 - RNA, 20 nt, Artificial Sequence
  targeting sequence with CTCN PAM
gugauagaaacauucccacg

SEQ ID NO: 15049 - RNA, 20 nt, Artificial Sequence
  targeting sequence with CTCN PAM
acuucucaguucuuggaagu

SEQ ID NO: 15050 - RNA, 20 nt, Artificial Sequence
  targeting sequence with CTCN PAM
guucuuggaagugucccaua

SEQ ID NO: 15051 - RNA, 20 nt, Artificial Sequence
  targeting sequence with CTCN PAM
uugcuucgucuucugcucca

SEQ ID NO: 15052 - RNA, 20 nt, Artificial Sequence
  targeting sequence with CTCN PAM
agcauagucccggaagaggg

SEQ ID NO: 15053 - RNA, 20 nt, Artificial Sequence
  targeting sequence with CTCN PAM
uccgggacuaugcuggagca

SEQ ID NO: 15054 - RNA, 20 nt, Artificial Sequence
  targeting sequence with CTCN PAM
agcacugggaccuccaggua

SEQ ID NO: 15055 - RNA, 20 nt, Artificial Sequence
  targeting sequence with CTCN PAM
agguaucacaguaaugggua

SEQ ID NO: 15056 - RNA, 20 nt, Artificial Sequence
  targeting sequence with CTCN PAM
guacccauuacugugauacc

SEQ ID NO: 15057 - RNA, 20 nt, Artificial Sequence
  targeting sequence with CTCN PAM
ucaaccagagcgcaaaggcu

SEQ ID NO: 15058 - RNA, 20 nt, Artificial Sequence
  targeting sequence with CTCN PAM
accagagcgcaaaggcugga

SEQ ID NO: 15059 - RNA, 20 nt, Artificial Sequence
  targeting sequence with CTCN PAM
gguugaggagcagggcugua

SEQ ID NO: 15060 - RNA, 20 nt, Artificial Sequence
  targeting sequence with CTCN PAM
agccuuugcgcucugguuga

SEQ ID NO: 15061 - RNA, 20 nt, Artificial Sequence
  targeting sequence with CTCN PAM
gcuuccgugucuccagccuu

SEQ ID NO: 15062 - RNA, 20 nt, Artificial Sequence
  targeting sequence with CTCN PAM
gaaucgcagcucugcuuccg

SEQ ID NO: 15063 - RNA, 20 nt, Artificial Sequence
  targeting sequence with CTCN PAM
agcgcucugaaucgcagcuc

SEQ ID NO: 15064 - RNA, 20 nt, Artificial Sequence
  targeting sequence with CTCN PAM
ccaggagcaaggcuggggcc

SEQ ID NO: 15065 - RNA, 20 nt, Artificial Sequence
  targeting sequence with CTCN PAM
aggagcaaggcuggggccug

SEQ ID NO: 15066 - RNA, 20 nt, Artificial Sequence
  targeting sequence with CTCN PAM
uggagagccucaagcgcucu

SEQ ID NO: 15067 - RNA, 20 nt, Artificial Sequence
  targeting sequence with CTCN PAM
gccaggccccagccuugcuc

SEQ ID NO: 15068 - RNA, 20 nt, Artificial Sequence
  targeting sequence with CTCN PAM
gggcucugccaggccccagc

SEQ ID NO: 15069 - RNA, 20 nt, Artificial Sequence
  targeting sequence with CTCN PAM
ucugggcucugccaggcccc

SEQ ID NO: 15070 - RNA, 20 nt, Artificial Sequence
  targeting sequence with CTCN PAM
agaagguuaggggccccucc

SEQ ID NO: 15071 - RNA, 20 nt, Artificial Sequence
  targeting sequence with CTCN PAM
gaggccaaaagaugaguggg

SEQ ID NO: 15072 - RNA, 20 nt, Artificial Sequence
  targeting sequence with CTCN PAM
gaguagaugccgcaucuuca

SEQ ID NO: 15073 - RNA, 20 nt, Artificial Sequence
  targeting sequence with CTCN PAM
ucuuuuggccucagaguaga

SEQ ID NO: 15074 - RNA, 20 nt, Artificial Sequence
  targeting sequence with CTCN PAM
uucccacucaucuuuuggcc

SEQ ID NO: 15075 - RNA, 20 nt, Artificial Sequence
  targeting sequence with CTCN PAM
ggacucuuucccacucaucu

SEQ ID NO: 15076 - RNA, 20 nt, Artificial Sequence
  targeting sequence with CTCN PAM
guaugcacugcccccccuuc

SEQ ID NO: 15077 - RNA, 20 nt, Artificial Sequence
  targeting sequence with CTCN PAM
ggaucagccaggcagaucug

SEQ ID NO: 15078 - RNA, 20 nt, Artificial Sequence
  targeting sequence with CTCN PAM
aguugaccacagaugcuuga

SEQ ID NO: 15079 - RNA, 20 nt, Artificial Sequence
  targeting sequence with CTCN PAM
gauggcuggguaacaggggu

SEQ ID NO: 15080 - RNA, 20 nt, Artificial Sequence
  targeting sequence with CTCN PAM
gcaucuggcaggcuagcuag

SEQ ID NO: 15081 - RNA, 20 nt, Artificial Sequence
  targeting sequence with CTCN PAM
uagcuagccugccagaugcu

SEQ ID NO: 15082 - RNA, 20 nt, Artificial Sequence
  targeting sequence with CTCN PAM
gacuuaagaaaugugggagg

SEQ ID NO: 15083 - RNA, 20 nt, Artificial Sequence
  targeting sequence with CTCN PAM
cacauuucuuaagucugagu

SEQ ID NO: 15084 - RNA, 20 nt, Artificial Sequence
  targeting sequence with CTCN PAM
ugccuguaaucccuacacuu

SEQ ID NO: 15085 - RNA, 20 nt, Artificial Sequence
  targeting sequence with CTCN PAM
caaaguguagggauuacagg

SEQ ID NO: 15086 - RNA, 20 nt, Artificial Sequence
  targeting sequence with CTCN PAM
caccuggccucccaaagugu

SEQ ID NO: 15087 - RNA, 20 nt, Artificial Sequence
  targeting sequence with CTCN PAM
agugaccucccaccuggccu

SEQ ID NO: 15088 - RNA, 20 nt, Artificial Sequence
  targeting sequence with CTCN PAM
uggccucaagugaccuccca

SEQ ID NO: 15089 - RNA, 20 nt, Artificial Sequence
  targeting sequence with CTCN PAM
auuucuaauauauauacaua

SEQ ID NO: 15090 - RNA, 20 nt, Artificial Sequence
  targeting sequence with CTCN PAM
ggcacaugccacuaugccug

SEQ ID NO: 15091 - RNA, 20 nt, Artificial Sequence
  targeting sequence with CTCN PAM
uacuucagucuuccaagugg

SEQ ID NO: 15092 - RNA, 20 nt, Artificial Sequence
  targeting sequence with CTCN PAM
agugaucuccuacuucaguc

SEQ ID NO: 15093 - RNA, 20 nt, Artificial Sequence
  targeting sequence with CTCN PAM
accuucugggcucaagugau

SEQ ID NO: 15094 - RNA, 20 nt, Artificial Sequence
  targeting sequence with CTCN PAM
cugcagccucgaccuucugg

SEQ ID NO: 15095 - RNA, 20 nt, Artificial Sequence
  targeting sequence with CTCN PAM
agccugggcgacagagugga

SEQ ID NO: 15096 - RNA, 20 nt, Artificial Sequence
  targeting sequence with CTCN PAM
gucgcccaggcuggagugca

SEQ ID NO: 15097 - RNA, 20 nt, Artificial Sequence
  targeting sequence with CTCN PAM
aaaaacaaacaaacaaacaa

SEQ ID NO: 15098 - RNA, 20 nt, Artificial Sequence
  targeting sequence with CTCN PAM
cauuucuuguuuguuuguuu

SEQ ID NO: 15099 - RNA, 20 nt, Artificial Sequence
  targeting sequence with CTCN PAM
cacauuucuuguuuguuugu

SEQ ID NO: 15100 - RNA, 20 nt, Artificial Sequence
  targeting sequence with CTCN PAM
ugcccauuugcaauguaacu

SEQ ID NO: 15101 - RNA, 20 nt, Artificial Sequence
  targeting sequence with CTCN PAM
guguguguugaauugaugca

SEQ ID NO: 15102 - RNA, 20 nt, Artificial Sequence
  targeting sequence with CTCN PAM
ucuguguguguugaauugau

SEQ ID NO: 15103 - RNA, 20 nt, Artificial Sequence
  targeting sequence with CTCN PAM
uggaaugggccaugugcuga

SEQ ID NO: 15104 - RNA, 20 nt, Artificial Sequence
  targeting sequence with CTCN PAM
ccgcuugaaucccacaauuc

SEQ ID NO: 15105 - RNA, 20 nt, Artificial Sequence
  targeting sequence with CTCN PAM
uccccgcuugaaucccacaa

SEQ ID NO: 15106 - RNA, 20 nt, Artificial Sequence
  targeting sequence with CTCN PAM
uuaagucagacugaagagca

SEQ ID NO: 15107 - RNA, 20 nt, Artificial Sequence
  targeting sequence with CTCN PAM
ucagucugacuuaaggagcc

SEQ ID NO: 15108 - RNA, 20 nt, Artificial Sequence
  targeting sequence with CTCN PAM
ccacugcccgugggugaaag

SEQ ID NO: 15109 - RNA, 20 nt, Artificial Sequence
  targeting sequence with CTCN PAM
cccgcuuagcauccugcaug

SEQ ID NO: 15110 - RNA, 20 nt, Artificial Sequence
  targeting sequence with CTCN PAM
ccgaguccagaucucuggug

SEQ ID NO: 15111 - RNA, 20 nt, Artificial Sequence
  targeting sequence with CTCN PAM
gggaggcuguggucaucaaa

SEQ ID NO: 15112 - RNA, 20 nt, Artificial Sequence
  targeting sequence with CTCN PAM
ggugauggagagcccucugg

SEQ ID NO: 15113 - RNA, 20 nt, Artificial Sequence
  targeting sequence with CTCN PAM
aucaccagagaucuggacuc

SEQ ID NO: 15114 - RNA, 20 nt, Artificial Sequence
  targeting sequence with CTCN PAM
ccaucaccagagaucuggac

SEQ ID NO: 15115 - RNA, 20 nt, Artificial Sequence
  targeting sequence with CTCN PAM
gggaaaauuccacaauaaag

SEQ ID NO: 15116 - RNA, 20 nt, Artificial Sequence
  targeting sequence with CTCN PAM
uuauuguggaauuuucccag

SEQ ID NO: 15117 - RNA, 20 nt, Artificial Sequence
  targeting sequence with CTCN PAM
agguagucucuuuauugugg

SEQ ID NO: 15118 - RNA, 20 nt, Artificial Sequence
  targeting sequence with CTCN PAM
gagguaaccacuucuacuau

SEQ ID NO: 15119 - RNA, 20 nt, Artificial Sequence
  targeting sequence with CTCN PAM
gaggaagggauggguuuuaa

SEQ ID NO: 15120 - RNA, 20 nt, Artificial Sequence
  targeting sequence with CTCN PAM
guaguugggguguacucucc

SEQ ID NO: 15121 - RNA, 20 nt, Artificial Sequence
  targeting sequence with CTCN PAM
ccgauacauucugguucacu

SEQ ID NO: 15122 - RNA, 20 nt, Artificial Sequence
  targeting sequence with CTCN PAM
gauacauucugguucacucc

SEQ ID NO: 15123 - RNA, 20 nt, Artificial Sequence
  targeting sequence with CTCN PAM
uuuucacuacugcauacuac

SEQ ID NO: 15124 - RNA, 20 nt, Artificial Sequence
  targeting sequence with CTCN PAM
acugugcgaauaggccacag

SEQ ID NO: 15125 - RNA, 20 nt, Artificial Sequence
  targeting sequence with CTCN PAM
ccaccugaugggcauuuaug

SEQ ID NO: 15126 - RNA, 20 nt, Artificial Sequence
  targeting sequence with CTCN PAM
accugaugggcauuuauguu

SEQ ID NO: 15127 - RNA, 20 nt, Artificial Sequence
  targeting sequence with CTCN PAM
gaucuacgccuagaguggaa

SEQ ID NO: 15128 - RNA, 20 nt, Artificial Sequence
  targeting sequence with CTCN PAM
aggcguagaucugagacaaa

SEQ ID NO: 15129 - RNA, 20 nt, Artificial Sequence
  targeting sequence with CTCN PAM
acaacccaccuauuccacuc

SEQ ID NO: 15130 - RNA, 20 nt, Artificial Sequence
  targeting sequence with CTCN PAM
cuccacaacccaccuauucc

SEQ ID NO: 15131 - RNA, 20 nt, Artificial Sequence
  targeting sequence with CTCN PAM
uuaguuguaugaaacaucgc

SEQ ID NO: 15132 - RNA, 20 nt, Artificial Sequence
  targeting sequence with CTCN PAM
cuccccaccccccagcagcu

SEQ ID NO: 15133 - RNA, 20 nt, Artificial Sequence
  targeting sequence with CTCN PAM
ccaccccccagcagcuauac

SEQ ID NO: 15134 - RNA, 20 nt, Artificial Sequence
  targeting sequence with CTCN PAM
cuauugauagacacuuacau

SEQ ID NO: 15135 - RNA, 20 nt, Artificial Sequence
  targeting sequence with CTCN PAM
gcaaaaugacaaagauguaa

SEQ ID NO: 15136 - RNA, 20 nt, Artificial Sequence
  targeting sequence with CTCN PAM
uucuuguuuguuuucuuuuc

SEQ ID NO: 15137 - RNA, 20 nt, Artificial Sequence
  targeting sequence with CTCN PAM
cccuuuuuuuuggggggggc

SEQ ID NO: 15138 - RNA, 20 nt, Artificial Sequence
  targeting sequence with CTCN PAM
guagcccaggcuggagugca

SEQ ID NO: 15139 - RNA, 20 nt, Artificial Sequence
  targeting sequence with CTCN PAM
agccugggcuacagaguaag

SEQ ID NO: 15140 - RNA, 20 nt, Artificial Sequence
  targeting sequence with CTCN PAM
cugcagccuugaccucccag

SEQ ID NO: 15141 - RNA, 20 nt, Artificial Sequence
  targeting sequence with CTCN PAM
caggcucaagcaauccuccu

SEQ ID NO: 15142 - RNA, 20 nt, Artificial Sequence
  targeting sequence with CTCN PAM
agcaauccuccugccucggc

SEQ ID NO: 15143 - RNA, 20 nt, Artificial Sequence
  targeting sequence with CTCN PAM
ugccucggccucccagguag

SEQ ID NO: 15144 - RNA, 20 nt, Artificial Sequence
  targeting sequence with CTCN PAM
gccucccagguagcugggac

SEQ ID NO: 15145 - RNA, 20 nt, Artificial Sequence
  targeting sequence with CTCN PAM
cagguagcugggacuacagg

SEQ ID NO: 15146 - RNA, 20 nt, Artificial Sequence
  targeting sequence with CTCN PAM
accaaaaaauacaaaaauua

SEQ ID NO: 15147 - RNA, 20 nt, Artificial Sequence
  targeting sequence with CTCN PAM
ugggcucaagcgauccuccu

SEQ ID NO: 15148 - RNA, 20 nt, Artificial Sequence
  targeting sequence with CTCN PAM
agcgauccuccugccucagc

SEQ ID NO: 15149 - RNA, 20 nt, Artificial Sequence
  targeting sequence with CTCN PAM
ugccucagccucccgaaguu

SEQ ID NO: 15150 - RNA, 20 nt, Artificial Sequence
  targeting sequence with CTCN PAM
gccucccgaaguucugggau

SEQ ID NO: 15151 - RNA, 20 nt, Artificial Sequence
  targeting sequence with CTCN PAM
cgaaguucugggauuacagg

SEQ ID NO: 15152 - RNA, 20 nt, Artificial Sequence
  targeting sequence with CTCN PAM
uaccuguaaucccagaacuu

SEQ ID NO: 15153 - RNA, 20 nt, Artificial Sequence
  targeting sequence with CTCN PAM
cauccuuguuuuaauccauc

SEQ ID NO: 15154 - RNA, 20 nt, Artificial Sequence
  targeting sequence with CTCN PAM
uccuuguuuuaauccaucuu

SEQ ID NO: 15155 - RNA, 20 nt, Artificial Sequence
  targeting sequence with CTCN PAM
aaaauaaguaaauaaaaaua

SEQ ID NO: 15156 - RNA, 20 nt, Artificial Sequence
  targeting sequence with CTCN PAM
uguugcccaggcuggagugc

SEQ ID NO: 15157 - RNA, 20 nt, Artificial Sequence
  targeting sequence with CTCN PAM
agccugggcaacaagagcga

SEQ ID NO: 15158 - RNA, 20 nt, Artificial Sequence
  targeting sequence with CTCN PAM
auccugguucacugcagucu

SEQ ID NO: 15159 - RNA, 20 nt, Artificial Sequence
  targeting sequence with CTCN PAM
agcucccagguucaagugau

SEQ ID NO: 15160 - RNA, 20 nt, Artificial Sequence
  targeting sequence with CTCN PAM
cagguucaagugauucuccu

SEQ ID NO: 15161 - RNA, 20 nt, Artificial Sequence
  targeting sequence with CTCN PAM
ugccucagccucccaaguag

SEQ ID NO: 15162 - RNA, 20 nt, Artificial Sequence
  targeting sequence with CTCN PAM
gccucccaaguagcugggac

SEQ ID NO: 15163 - RNA, 20 nt, Artificial Sequence
  targeting sequence with CTCN PAM
caaguagcugggacuacagg

SEQ ID NO: 15164 - RNA, 20 nt, Artificial Sequence
  targeting sequence with CTCN PAM
acuaaaaauacaaaauuagc

SEQ ID NO: 15165 - RNA, 20 nt, Artificial Sequence
  targeting sequence with CTCN PAM
aacuccugaccucaggugau

SEQ ID NO: 15166 - RNA, 20 nt, Artificial Sequence
  targeting sequence with CTCN PAM
ugaccucaggugauccgccc

SEQ ID NO: 15167 - RNA, 20 nt, Artificial Sequence
  targeting sequence with CTCN PAM
ggugauccgcccaccucagc

SEQ ID NO: 15168 - RNA, 20 nt, Artificial Sequence
  targeting sequence with CTCN PAM
gccucccaaagugcuaggau

SEQ ID NO: 15169 - RNA, 20 nt, Artificial Sequence
  targeting sequence with CTCN PAM
caaagugcuaggauuacagg

SEQ ID NO: 15170 - RNA, 20 nt, Artificial Sequence
  targeting sequence with CTCN PAM
ggccuguaauccuagcacuu

SEQ ID NO: 15171 - RNA, 20 nt, Artificial Sequence
  targeting sequence with CTCN PAM
aaugccaaggaaguugagug

SEQ ID NO: 15172 - RNA, 20 nt, Artificial Sequence
  targeting sequence with CTCN PAM
acuuccuuggcauuugagaa

SEQ ID NO: 15173 - RNA, 20 nt, Artificial Sequence
  targeting sequence with CTCN PAM
cccuuuaggcuggugaauug

SEQ ID NO: 15174 - RNA, 20 nt, Artificial Sequence
  targeting sequence with CTCN PAM
guuauugauuuauuucuuua

SEQ ID NO: 15175 - RNA, 20 nt, Artificial Sequence
  targeting sequence with CTCN PAM
uuugguuuuguuuuuaaaga

SEQ ID NO: 15176 - RNA, 20 nt, Artificial Sequence
  targeting sequence with CTCN PAM
gggccuaugcccuccuuugg

SEQ ID NO: 15177 - RNA, 20 nt, Artificial Sequence
  targeting sequence with CTCN PAM
cugggccuaugcccuccuuu

SEQ ID NO: 15178 - RNA, 20 nt, Artificial Sequence
  targeting sequence with CTCN PAM
gaaggggcuacucugauuga

SEQ ID NO: 15179 - RNA, 20 nt, Artificial Sequence
  targeting sequence with CTCN PAM
gauugaggggcaugugcucu

SEQ ID NO: 15180 - RNA, 20 nt, Artificial Sequence
  targeting sequence with CTCN PAM
aucagaguagccccuucuga

SEQ ID NO: 15181 - RNA, 20 nt, Artificial Sequence
  targeting sequence with CTCN PAM
gggcaaaaguagcaguuggg

SEQ ID NO: 15182 - RNA, 20 nt, Artificial Sequence
  targeting sequence with CTCN PAM
aacugcuacuuuuugagaaa

SEQ ID NO: 15183 - RNA, 20 nt, Artificial Sequence
  targeting sequence with CTCN PAM
aaaaguagcaguuggaggca

SEQ ID NO: 15184 - RNA, 20 nt, Artificial Sequence
  targeting sequence with CTCN PAM
auuucucaaaaaguagcagu

SEQ ID NO: 15185 - RNA, 20 nt, Artificial Sequence
  targeting sequence with CTCN PAM
aauccuaccaggugggcaau

SEQ ID NO: 15186 - RNA, 20 nt, Artificial Sequence
  targeting sequence with CTCN PAM
gcggccucccugacaacaca

SEQ ID NO: 15187 - RNA, 20 nt, Artificial Sequence
  targeting sequence with CTCN PAM
cugacaacacaggugacccc

SEQ ID NO: 15188 - RNA, 20 nt, Artificial Sequence
  targeting sequence with CTCN PAM
ucagcaucuccagccccugg

SEQ ID NO: 15189 - RNA, 20 nt, Artificial Sequence
  targeting sequence with CTCN PAM
agccccuggugggcagaggg

SEQ ID NO: 15190 - RNA, 20 nt, Artificial Sequence
  targeting sequence with CTCN PAM
gcccaccaggggcuggagau

SEQ ID NO: 15191 - RNA, 20 nt, Artificial Sequence
  targeting sequence with CTCN PAM
ccugugcccucugcccacca

SEQ ID NO: 15192 - RNA, 20 nt, Artificial Sequence
  targeting sequence with CTCN PAM
gcucccaacauugcaccaug

SEQ ID NO: 15193 - RNA, 20 nt, Artificial Sequence
  targeting sequence with CTCN PAM
caacauugcaccauggggac

SEQ ID NO: 15194 - RNA, 20 nt, Artificial Sequence
  targeting sequence with CTCN PAM
guccccauggugcaauguug

SEQ ID NO: 15195 - RNA, 20 nt, Artificial Sequence
  targeting sequence with CTCN PAM
gggucucaguccccauggug

SEQ ID NO: 15196 - RNA, 20 nt, Artificial Sequence
  targeting sequence with CTCN PAM
uguguaagcuuggggguguc

SEQ ID NO: 15197 - RNA, 20 nt, Artificial Sequence
  targeting sequence with CTCN PAM
cuacagaaggcaggaugcug

SEQ ID NO: 15198 - RNA, 20 nt, Artificial Sequence
  targeting sequence with CTCN PAM
agccccagucagcagcuugg

SEQ ID NO: 15199 - RNA, 20 nt, Artificial Sequence
  targeting sequence with CTCN PAM
aagcugcugacuggggcugg

SEQ ID NO: 15200 - RNA, 20 nt, Artificial Sequence
  targeting sequence with CTCN PAM
cagcccaaucagggcugauu

SEQ ID NO: 15201 - RNA, 20 nt, Artificial Sequence
  targeting sequence with CTCN PAM
aaucagcccugauugggcug

SEQ ID NO: 15202 - RNA, 20 nt, Artificial Sequence
  targeting sequence with CTCN PAM
cacccgggugaggggucugc

SEQ ID NO: 15203 - RNA, 20 nt, Artificial Sequence
  targeting sequence with CTCN PAM
cccgggugugaggcugcugg

SEQ ID NO: 15204 - RNA, 20 nt, Artificial Sequence
  targeting sequence with CTCN PAM
uggcuccugggagcgucacc

SEQ ID NO: 15205 - RNA, 20 nt, Artificial Sequence
  targeting sequence with CTCN PAM
ugggagcgucaccagcgaca

SEQ ID NO: 15206 - RNA, 20 nt, Artificial Sequence
  targeting sequence with CTCN PAM
caggagccaugagaccgaca

SEQ ID NO: 15207 - RNA, 20 nt, Artificial Sequence
  targeting sequence with CTCN PAM
cccuccucgacuuccacagc

SEQ ID NO: 15208 - RNA, 20 nt, Artificial Sequence
  targeting sequence with CTCN PAM
ucgacuuccacagcaggauc

SEQ ID NO: 15209 - RNA, 20 nt, Artificial Sequence
  targeting sequence with CTCN PAM
acuuccacagcaggaucauc

SEQ ID NO: 15210 - RNA, 20 nt, Artificial Sequence
  targeting sequence with CTCN PAM
ugaaucugaaaagccaggug

SEQ ID NO: 15211 - RNA, 20 nt, Artificial Sequence
  targeting sequence with CTCN PAM
ccuggcuuuucagauucagg

SEQ ID NO: 15212 - RNA, 20 nt, Artificial Sequence
  targeting sequence with CTCN PAM
ugcucaccuggcuuuucaga

SEQ ID NO: 15213 - RNA, 20 nt, Artificial Sequence
  targeting sequence with CTCN PAM
ucuugcucaccuggcuuuuc

SEQ ID NO: 15214 - RNA, 20 nt, Artificial Sequence
  targeting sequence with CTCN PAM
ucccucaucccugcgagccc

SEQ ID NO: 15215 - RNA, 20 nt, Artificial Sequence
  targeting sequence with CTCN PAM
cucaucccugcgagcccacu

SEQ ID NO: 15216 - RNA, 20 nt, Artificial Sequence
  targeting sequence with CTCN PAM
ucccugcgagcccacucccu

SEQ ID NO: 15217 - RNA, 20 nt, Artificial Sequence
  targeting sequence with CTCN PAM
cagggaugagggaggagcug

SEQ ID NO: 15218 - RNA, 20 nt, Artificial Sequence
  targeting sequence with CTCN PAM
cuggguugccuuugaugcuc

SEQ ID NO: 15219 - RNA, 20 nt, Artificial Sequence
  targeting sequence with CTCN PAM
accccugcuucucguucuuu

SEQ ID NO: 15220 - RNA, 20 nt, Artificial Sequence
  targeting sequence with CTCN PAM
uucuuucccagccuggcccc

SEQ ID NO: 15221 - RNA, 20 nt, Artificial Sequence
  targeting sequence with CTCN PAM
cccagcacucacccagcacc

SEQ ID NO: 15222 - RNA, 20 nt, Artificial Sequence
  targeting sequence with CTCN PAM
cccagcacccacccagcacc

SEQ ID NO: 15223 - RNA, 20 nt, Artificial Sequence
  targeting sequence with CTCN PAM
gcagcuuggugcuggguggg

SEQ ID NO: 15224 - RNA, 20 nt, Artificial Sequence
  targeting sequence with CTCN PAM
acugccuuuuggcugaagag

SEQ ID NO: 15225 - RNA, 20 nt, Artificial Sequence
  targeting sequence with CTCN PAM
ucagccaaaaggcaguugag

SEQ ID NO: 15226 - RNA, 20 nt, Artificial Sequence
  targeting sequence with CTCN PAM
cucagggaagagccacaggg

SEQ ID NO: 15227 - RNA, 20 nt, Artificial Sequence
  targeting sequence with CTCN PAM
gggaagagccacagggccuu

SEQ ID NO: 15228 - RNA, 20 nt, Artificial Sequence
  targeting sequence with CTCN PAM
ucccugagcgaggccggccc

SEQ ID NO: 15229 - RNA, 20 nt, Artificial Sequence
  targeting sequence with CTCN PAM
agcuggaaggcccuguggcu

SEQ ID NO: 15230 - RNA, 20 nt, Artificial Sequence
  targeting sequence with CTCN PAM
aacuagcugcccacagcugc

SEQ ID NO: 15231 - RNA, 20 nt, Artificial Sequence
  targeting sequence with CTCN PAM
ugccccagucccuccaacua

SEQ ID NO: 15232 - RNA, 20 nt, Artificial Sequence
  targeting sequence with CTCN PAM
ggguuuaucuggacaugagg

SEQ ID NO: 15233 - RNA, 20 nt, Artificial Sequence
  targeting sequence with CTCN PAM
uguccagauaaacccugagg

SEQ ID NO: 15234 - RNA, 20 nt, Artificial Sequence
  targeting sequence with CTCN PAM
gugcacccucauguccagau

SEQ ID NO: 15235 - RNA, 20 nt, Artificial Sequence
  targeting sequence with CTCN PAM
cucgaggaccucccggucug

SEQ ID NO: 15236 - RNA, 20 nt, Artificial Sequence
  targeting sequence with CTCN PAM
aggaccucccggucugaugg

SEQ ID NO: 15237 - RNA, 20 nt, Artificial Sequence
  targeting sequence with CTCN PAM
agggagugaacugggccugg

SEQ ID NO: 15238 - RNA, 20 nt, Artificial Sequence
  targeting sequence with CTCN PAM
cggucugauggggaagccug

SEQ ID NO: 15239 - RNA, 20 nt, Artificial Sequence
  targeting sequence with CTCN PAM
ggauuaccgccacugaagca

SEQ ID NO: 15240 - RNA, 20 nt, Artificial Sequence
  targeting sequence with CTCN PAM
agcucuggauuaccgccacu

SEQ ID NO: 15241 - RNA, 20 nt, Artificial Sequence
  targeting sequence with CTCN PAM
uccagcucuggauuaccgcc

SEQ ID NO: 15242 - RNA, 20 nt, Artificial Sequence
  targeting sequence with CTCN PAM
gggcuccuccagcucuggau

SEQ ID NO: 15243 - RNA, 20 nt, Artificial Sequence
  targeting sequence with CTCN PAM
ucugggcuccuccagcucug

SEQ ID NO: 15244 - RNA, 20 nt, Artificial Sequence
  targeting sequence with CTCN PAM
aacccacucugggaggucag

SEQ ID NO: 15245 - RNA, 20 nt, Artificial Sequence
  targeting sequence with CTCN PAM
gggaggucagggaaagcuuc

SEQ ID NO: 15246 - RNA, 20 nt, Artificial Sequence
  targeting sequence with CTCN PAM
cagaguggguuagaggacuc

SEQ ID NO: 15247 - RNA, 20 nt, Artificial Sequence
  targeting sequence with CTCN PAM
ucuaggaagcuuucccugac

SEQ ID NO: 15248 - RNA, 20 nt, Artificial Sequence
  targeting sequence with CTCN PAM
gccgggggaaguguucuauu

SEQ ID NO: 15249 - RNA, 20 nt, Artificial Sequence
  targeting sequence with CTCN PAM
cuaggugucuuggcaaauag

SEQ ID NO: 15250 - RNA, 20 nt, Artificial Sequence
  targeting sequence with CTCN PAM
cuaucucccuaggugucuug

SEQ ID NO: 15251 - RNA, 20 nt, Artificial Sequence
  targeting sequence with CTCN PAM
gcaccuggacccccucccua

SEQ ID NO: 15252 - RNA, 20 nt, Artificial Sequence
  targeting sequence with CTCN PAM
gcccuuuuacuucucggcac

SEQ ID NO: 15253 - RNA, 20 nt, Artificial Sequence
  targeting sequence with CTCN PAM
gacuucccaguuaacucugc

SEQ ID NO: 15254 - RNA, 20 nt, Artificial Sequence
  targeting sequence with CTCN PAM
aaaugcaccuugguuuggac

SEQ ID NO: 15255 - RNA, 20 nt, Artificial Sequence
  targeting sequence with CTCN PAM
uccuucaaggcucaaaaugc

SEQ ID NO: 15256 - RNA, 20 nt, Artificial Sequence
  targeting sequence with CTCN PAM
cucauccuucaaggcucaaa

SEQ ID NO: 15257 - RNA, 20 nt, Artificial Sequence
  targeting sequence with CTCN PAM
cacucauccuucaaggcuca

SEQ ID NO: 15258 - RNA, 20 nt, Artificial Sequence
  targeting sequence with CTCN PAM
cggucaugcaggcugcucuc

SEQ ID NO: 15259 - RNA, 20 nt, Artificial Sequence
  targeting sequence with CTCN PAM
ucccggucaugcaggcugcu

SEQ ID NO: 15260 - RNA, 20 nt, Artificial Sequence
  targeting sequence with CTCN PAM
ccucccggucaugcaggcug

SEQ ID NO: 15261 - RNA, 20 nt, Artificial Sequence
  targeting sequence with CTCN PAM
cuccucccggucaugcaggc

SEQ ID NO: 15262 - RNA, 20 nt, Artificial Sequence
  targeting sequence with CTCN PAM
gccugggcugccucucuccu

SEQ ID NO: 15263 - RNA, 20 nt, Artificial Sequence
  targeting sequence with CTCN PAM
gggccuuagcccaugccguu

SEQ ID NO: 15264 - RNA, 20 nt, Artificial Sequence
  targeting sequence with CTCN PAM
gaagcugcaucuuccuucug

SEQ ID NO: 15265 - RNA, 20 nt, Artificial Sequence
  targeting sequence with CTCN PAM
uucccagaaggaagaugcag

SEQ ID NO: 15266 - RNA, 20 nt, Artificial Sequence
  targeting sequence with CTCN PAM
ccuagcacugccccagcacu

SEQ ID NO: 15267 - RNA, 20 nt, Artificial Sequence
  targeting sequence with CTCN PAM
cacugcuccccuagcacugc

SEQ ID NO: 15268 - RNA, 20 nt, Artificial Sequence
  targeting sequence with CTCN PAM
aaggcggucuucaguuaggu

SEQ ID NO: 15269 - RNA, 20 nt, Artificial Sequence
  targeting sequence with CTCN PAM
cuguucaagauaaaaguuga

SEQ ID NO: 15270 - RNA, 20 nt, Artificial Sequence
  targeting sequence with CTCN PAM
cugcuugaaaccguccaugg

SEQ ID NO: 15271 - RNA, 20 nt, Artificial Sequence
  targeting sequence with CTCN PAM
ccucccugcuugaaaccguc

SEQ ID NO: 15272 - RNA, 20 nt, Artificial Sequence
  targeting sequence with CTCN PAM
caccccucaccucccugcuu

SEQ ID NO: 15273 - RNA, 20 nt, Artificial Sequence
  targeting sequence with CTCN PAM
cuguaucucacaccccucac

SEQ ID NO: 15274 - RNA, 20 nt, Artificial Sequence
  targeting sequence with CTCN PAM
ucgcuguaucucacaccccu

SEQ ID NO: 15275 - RNA, 20 nt, Artificial Sequence
  targeting sequence with CTCN PAM
uccccaccgcaugcauucuc

SEQ ID NO: 15276 - RNA, 20 nt, Artificial Sequence
  targeting sequence with CTCN PAM
ccacugccucuuccccaccg

SEQ ID NO: 15277 - RNA, 20 nt, Artificial Sequence
  targeting sequence with CTCN PAM
uccccacugccucuucccca

SEQ ID NO: 15278 - RNA, 20 nt, Artificial Sequence
  targeting sequence with CTCN PAM
ccagccccagccuccucccc

SEQ ID NO: 15279 - RNA, 20 nt, Artificial Sequence
  targeting sequence with CTCN PAM
aacuccccagccccagccuc

SEQ ID NO: 15280 - RNA, 20 nt, Artificial Sequence
  targeting sequence with CTCN PAM
ccaacuccccagccccagcc

SEQ ID NO: 15281 - RNA, 20 nt, Artificial Sequence
  targeting sequence with CTCN PAM
ucuccaacuccccagcccca

SEQ ID NO: 15282 - RNA, 20 nt, Artificial Sequence
  targeting sequence with CTCN PAM
ccucuccaacuccccagccc

SEQ ID NO: 15283 - RNA, 20 nt, Artificial Sequence
  targeting sequence with CTCN PAM
auauucuggccucuccucuc

SEQ ID NO: 15284 - RNA, 20 nt, Artificial Sequence
  targeting sequence with CTCN PAM
ccauauucuggccucuccuc

SEQ ID NO: 15285 - RNA, 20 nt, Artificial Sequence
  targeting sequence with CTCN PAM
ccauaggcuuuucucuccau

SEQ ID NO: 15286 - RNA, 20 nt, Artificial Sequence
  targeting sequence with CTCN PAM
aguggguguggugaggagga

SEQ ID NO: 15287 - RNA, 20 nt, Artificial Sequence
  targeting sequence with CTCN PAM
aggccuccccauaggcuuuu

SEQ ID NO: 15288 - RNA, 20 nt, Artificial Sequence
  targeting sequence with CTCN PAM
ccacacccacucgaggccuc

SEQ ID NO: 15289 - RNA, 20 nt, Artificial Sequence
  targeting sequence with CTCN PAM
ucaccacacccacucgaggc

SEQ ID NO: 15290 - RNA, 20 nt, Artificial Sequence
  targeting sequence with CTCN PAM
uccaggaaugccccaugccc

SEQ ID NO: 15291 - RNA, 20 nt, Artificial Sequence
  targeting sequence with CTCN PAM
cuuccaggaaugccccaugc

SEQ ID NO: 15292 - RNA, 20 nt, Artificial Sequence
  targeting sequence with CTCN PAM
cucuuccaggaaugccccau

SEQ ID NO: 15293 - RNA, 20 nt, Artificial Sequence
  targeting sequence with CTCN PAM
ucucucuuccaggaaugccc

SEQ ID NO: 15294 - RNA, 20 nt, Artificial Sequence
  targeting sequence with CTCN PAM
gccccccaaaucugccccuc

SEQ ID NO: 15295 - RNA, 20 nt, Artificial Sequence
  targeting sequence with CTCN PAM
guucuggacauccugguaua

SEQ ID NO: 15296 - RNA, 20 nt, Artificial Sequence
  targeting sequence with CTCN PAM
uucggcagcuauuccaugcc

SEQ ID NO: 15297 - RNA, 20 nt, Artificial Sequence
  targeting sequence with CTCN PAM
ucccagccccucauucggca

SEQ ID NO: 15298 - RNA, 20 nt, Artificial Sequence
  targeting sequence with CTCN PAM
caucccagccccucauucgg

SEQ ID NO: 15299 - RNA, 20 nt, Artificial Sequence
  targeting sequence with CTCN PAM
ggucuguucccucucauccc

SEQ ID NO: 15300 - RNA, 20 nt, Artificial Sequence
  targeting sequence with CTCN PAM
cucaggucuguucccucuca

SEQ ID NO: 15301 - RNA, 20 nt, Artificial Sequence
  targeting sequence with CTCN PAM
uggggguggcucucugggac

SEQ ID NO: 15302 - RNA, 20 nt, Artificial Sequence
  targeting sequence with CTCN PAM
cugggacagacauggucugg

SEQ ID NO: 15303 - RNA, 20 nt, Artificial Sequence
  targeting sequence with CTCN PAM
gggacagacauggucugggg

SEQ ID NO: 15304 - RNA, 20 nt, Artificial Sequence
  targeting sequence with CTCN PAM
gcuucccccagaccaugucu

SEQ ID NO: 15305 - RNA, 20 nt, Artificial Sequence
  targeting sequence with CTCN PAM
ucugcuucccccagaccaug

SEQ ID NO: 15306 - RNA, 20 nt, Artificial Sequence
  targeting sequence with CTCN PAM
aaccccuccucugcuucccc

SEQ ID NO: 15307 - RNA, 20 nt, Artificial Sequence
  targeting sequence with CTCN PAM
ugaagucaggccaagcgaag

SEQ ID NO: 15308 - RNA, 20 nt, Artificial Sequence
  targeting sequence with CTCN PAM
cagcugcagugcuacagggc

SEQ ID NO: 15309 - RNA, 20 nt, Artificial Sequence
  targeting sequence with CTCN PAM
gaccuccuuagaggcccccg

SEQ ID NO: 15310 - RNA, 20 nt, Artificial Sequence
  targeting sequence with CTCN PAM
uuagaggcccccguccccac

SEQ ID NO: 15311 - RNA, 20 nt, Artificial Sequence
  targeting sequence with CTCN PAM
aaggaggucugagcccuccc

SEQ ID NO: 15312 - RNA, 20 nt, Artificial Sequence
  targeting sequence with CTCN PAM
gucuucccauccguacagug

SEQ ID NO: 15313 - RNA, 20 nt, Artificial Sequence
  targeting sequence with CTCN PAM
aggccucagucuucccaucc

SEQ ID NO: 15314 - RNA, 20 nt, Artificial Sequence
  targeting sequence with CTCN PAM
cgagaacccgggagugaccc

SEQ ID NO: 15315 - RNA, 20 nt, Artificial Sequence
  targeting sequence with CTCN PAM
ggaguuucauucuucccucu

SEQ ID NO: 15316 - RNA, 20 nt, Artificial Sequence
  targeting sequence with CTCN PAM
cggguucucgggaguuucau

SEQ ID NO: 15317 - RNA, 20 nt, Artificial Sequence
  targeting sequence with CTCN PAM
acgccuuuggcccccaaaug

SEQ ID NO: 15318 - RNA, 20 nt, Artificial Sequence
  targeting sequence with CTCN PAM
ucauggccaggacccaacag

SEQ ID NO: 15319 - RNA, 20 nt, Artificial Sequence
  targeting sequence with CTCN PAM
uuauaauuuugcucuagauc

SEQ ID NO: 15320 - RNA, 20 nt, Artificial Sequence
  targeting sequence with CTCN PAM
agaucuagaguuucaugguu

SEQ ID NO: 15321 - RNA, 20 nt, Artificial Sequence
  targeting sequence with CTCN PAM
agaucuagagcaaaauuaua

SEQ ID NO: 15322 - RNA, 20 nt, Artificial Sequence
  targeting sequence with CTCN PAM
aaaaaaaaaaaaaaauuggc

SEQ ID NO: 15323 - RNA, 20 nt, Artificial Sequence
  targeting sequence with CTCN PAM
agccugggugacaaagcaag

SEQ ID NO: 15324 - RNA, 20 nt, Artificial Sequence
  targeting sequence with CTCN PAM
gcucacugcagucuccacuu

SEQ ID NO: 15325 - RNA, 20 nt, Artificial Sequence
  targeting sequence with CTCN PAM
cugcagucuccacuucccag

SEQ ID NO: 15326 - RNA, 20 nt, Artificial Sequence
  targeting sequence with CTCN PAM
acuucccaggcucaagcaau

SEQ ID NO: 15327 - RNA, 20 nt, Artificial Sequence
  targeting sequence with CTCN PAM
agcaaucuucccaccucagc

SEQ ID NO: 15328 - RNA, 20 nt, Artificial Sequence
  targeting sequence with CTCN PAM
gccucccaaguagcuaggcc

SEQ ID NO: 15329 - RNA, 20 nt, Artificial Sequence
  targeting sequence with CTCN PAM
caaguagcuaggccuauagg

SEQ ID NO: 15330 - RNA, 20 nt, Artificial Sequence
  targeting sequence with CTCN PAM
gcucauuuuuaaagauuuuc

SEQ ID NO: 15331 - RNA, 20 nt, Artificial Sequence
  targeting sequence with CTCN PAM
uuuuuaaagauuuucguaga

SEQ ID NO: 15332 - RNA, 20 nt, Artificial Sequence
  targeting sequence with CTCN PAM
acgaaaaucuuuaaaaauga

SEQ ID NO: 15333 - RNA, 20 nt, Artificial Sequence
  targeting sequence with CTCN PAM
acucuacgaaaaucuuuaaa

SEQ ID NO: 15334 - RNA, 20 nt, Artificial Sequence
  targeting sequence with CTCN PAM
cgauauugcccagaauuuaa

SEQ ID NO: 15335 - RNA, 20 nt, Artificial Sequence
  targeting sequence with CTCN PAM
ugcuucccccacccuugauc

SEQ ID NO: 15336 - RNA, 20 nt, Artificial Sequence
  targeting sequence with CTCN PAM
auaagguguuauaaaauagu

SEQ ID NO: 15337 - RNA, 20 nt, Artificial Sequence
  targeting sequence with CTCN PAM
gaguuguguauccaucucua

SEQ ID NO: 15338 - RNA, 20 nt, Artificial Sequence
  targeting sequence with CTCN PAM
gaguauaccaaaagccauug

SEQ ID NO: 15339 - RNA, 20 nt, Artificial Sequence
  targeting sequence with CTCN PAM
auaaucaauuuuagaauauu

SEQ ID NO: 15340 - RNA, 20 nt, Artificial Sequence
  targeting sequence with CTCN PAM
ccacccccacuccccagccc

SEQ ID NO: 15341 - RNA, 20 nt, Artificial Sequence
  targeting sequence with CTCN PAM
acccccacuccccagcccug

SEQ ID NO: 15342 - RNA, 20 nt, Artificial Sequence
  targeting sequence with CTCN PAM
ccagcccuggcaaccaccaa

SEQ ID NO: 15343 - RNA, 20 nt, Artificial Sequence
  targeting sequence with CTCN PAM
uccaugucguagccagggcu

SEQ ID NO: 15344 - RNA, 20 nt, Artificial Sequence
  targeting sequence with CTCN PAM
augucguagccagggcuuca

SEQ ID NO: 15345 - RNA, 20 nt, Artificial Sequence
  targeting sequence with CTCN PAM
uuuguauggcuggauaauau

SEQ ID NO: 15346 - RNA, 20 nt, Artificial Sequence
  targeting sequence with CTCN PAM
gguauauaccgaagagugga

SEQ ID NO: 15347 - RNA, 20 nt, Artificial Sequence
  targeting sequence with CTCN PAM
ucgguauauaccugagggaa

SEQ ID NO: 15348 - RNA, 20 nt, Artificial Sequence
  targeting sequence with CTCN PAM
gcccugaaaguuuucauaau

SEQ ID NO: 15349 - RNA, 20 nt, Artificial Sequence
  targeting sequence with CTCN PAM
ugcuuguaauccuagcacuu

SEQ ID NO: 15350 - RNA, 20 nt, Artificial Sequence
  targeting sequence with CTCN PAM
caaagugcuaggauuacaag

SEQ ID NO: 15351 - RNA, 20 nt, Artificial Sequence
  targeting sequence with CTCN PAM
gucucccaaagugcuaggau

SEQ ID NO: 15352 - RNA, 20 nt, Artificial Sequence
  targeting sequence with CTCN PAM
ggaguuugagacuaaacuga

SEQ ID NO: 15353 - RNA, 20 nt, Artificial Sequence
  targeting sequence with CTCN PAM
ugaguucaagcuaucuuccc

SEQ ID NO: 15354 - RNA, 20 nt, Artificial Sequence
  targeting sequence with CTCN PAM
aacuccugaguucaagcuau

SEQ ID NO: 15355 - RNA, 20 nt, Artificial Sequence
  targeting sequence with CTCN PAM
guuuagucucaaacuccuga

SEQ ID NO: 15356 - RNA, 20 nt, Artificial Sequence
  targeting sequence with CTCN PAM
cuacauugcucaguuuaguc

SEQ ID NO: 15357 - RNA, 20 nt, Artificial Sequence
  targeting sequence with CTCN PAM
gaaguagcugggaccacagg

SEQ ID NO: 15358 - RNA, 20 nt, Artificial Sequence
  targeting sequence with CTCN PAM
gucuccgaaguagcugggac

SEQ ID NO: 15359 - RNA, 20 nt, Artificial Sequence
  targeting sequence with CTCN PAM
ugccucagucuccgaaguag

SEQ ID NO: 15360 - RNA, 20 nt, Artificial Sequence
  targeting sequence with CTCN PAM
agugauccucuugccucagu

SEQ ID NO: 15361 - RNA, 20 nt, Artificial Sequence
  targeting sequence with CTCN PAM
agcucaagugauccucuugc

SEQ ID NO: 15362 - RNA, 20 nt, Artificial Sequence
  targeting sequence with CTCN PAM
ccagcucaagugauccucuu

SEQ ID NO: 15363 - RNA, 20 nt, Artificial Sequence
  targeting sequence with CTCN PAM
cugcagccuugaccucucca

SEQ ID NO: 15364 - RNA, 20 nt, Artificial Sequence
  targeting sequence with CTCN PAM
agcuugggugacagauugag

SEQ ID NO: 15365 - RNA, 20 nt, Artificial Sequence
  targeting sequence with CTCN PAM
aucugucacccaagcuggag

SEQ ID NO: 15366 - RNA, 20 nt, Artificial Sequence
  targeting sequence with CTCN PAM
auaaaacaaaacaaaaaacu

SEQ ID NO: 15367 - RNA, 20 nt, Artificial Sequence
  targeting sequence with CTCN PAM
cuuccacuguacccgucacc

SEQ ID NO: 15368 - RNA, 20 nt, Artificial Sequence
  targeting sequence with CTCN PAM
aacagucaccaucuugugga

SEQ ID NO: 15369 - RNA, 20 nt, Artificial Sequence
  targeting sequence with CTCN PAM
uguuucaucugcuggguuau

SEQ ID NO: 15370 - RNA, 20 nt, Artificial Sequence
  targeting sequence with CTCN PAM
uaucuguuaaagguaaauau

SEQ ID NO: 15371 - RNA, 20 nt, Artificial Sequence
  targeting sequence with CTCN PAM
cauuuaucuguugccuuucu

SEQ ID NO: 15372 - RNA, 20 nt, Artificial Sequence
  targeting sequence with CTCN PAM
gggaaugagcauuugguuga

SEQ ID NO: 15373 - RNA, 20 nt, Artificial Sequence
  targeting sequence with CTCN PAM
uucccagagcaggauuugaa

SEQ ID NO: 15374 - RNA, 20 nt, Artificial Sequence
  targeting sequence with CTCN PAM
accaaaugcucauucccaga

SEQ ID NO: 15375 - RNA, 20 nt, Artificial Sequence
  targeting sequence with CTCN PAM
caaccaaaugcucauuccca

SEQ ID NO: 15376 - RNA, 20 nt, Artificial Sequence
  targeting sequence with CTCN PAM
cacuuuuucuuuccccccuu

SEQ ID NO: 15377 - RNA, 20 nt, Artificial Sequence
  targeting sequence with CTCN PAM
agggcacacagccggguuuc

SEQ ID NO: 15378 - RNA, 20 nt, Artificial Sequence
  targeting sequence with CTCN PAM
ccagggcacacagccggguu

SEQ ID NO: 15379 - RNA, 20 nt, Artificial Sequence
  targeting sequence with CTCN PAM
cagucugggugccucugaga

SEQ ID NO: 15380 - RNA, 20 nt, Artificial Sequence
  targeting sequence with CTCN PAM
gucugggugccucugagaau

SEQ ID NO: 15381 - RNA, 20 nt, Artificial Sequence
  targeting sequence with CTCN PAM
gagaaugugcacauagcccc

SEQ ID NO: 15382 - RNA, 20 nt, Artificial Sequence
  targeting sequence with CTCN PAM
gaggcacccagacugagaga

SEQ ID NO: 15383 - RNA, 20 nt, Artificial Sequence
  targeting sequence with CTCN PAM
gggggcuaugugcacauucu

SEQ ID NO: 15384 - RNA, 20 nt, Artificial Sequence
  targeting sequence with CTCN PAM
auucuuuaaaaagagagauu

SEQ ID NO: 15385 - RNA, 20 nt, Artificial Sequence
  targeting sequence with CTCN PAM
uuuuaaagaauggaguauuc

SEQ ID NO: 15386 - RNA, 20 nt, Artificial Sequence
  targeting sequence with CTCN PAM
cuuuuuaaagaauggaguau

SEQ ID NO: 15387 - RNA, 20 nt, Artificial Sequence
  targeting sequence with CTCN PAM
agccuguaaucccagcacuu

SEQ ID NO: 15388 - RNA, 20 nt, Artificial Sequence
  targeting sequence with CTCN PAM
caaagugcugggauuacagg

SEQ ID NO: 15389 - RNA, 20 nt, Artificial Sequence
  targeting sequence with CTCN PAM
gccucccaaagugcugggau

SEQ ID NO: 15390 - RNA, 20 nt, Artificial Sequence
  targeting sequence with CTCN PAM
ugacccacccgccucggccu

SEQ ID NO: 15391 - RNA, 20 nt, Artificial Sequence
  targeting sequence with CTCN PAM
ugaccucaugacccacccgc

SEQ ID NO: 15392 - RNA, 20 nt, Artificial Sequence
  targeting sequence with CTCN PAM
acuaaaaauacaaaaaucag

SEQ ID NO: 15393 - RNA, 20 nt, Artificial Sequence
  targeting sequence with CTCN PAM
caaguagcugggauuacagg

SEQ ID NO: 15394 - RNA, 20 nt, Artificial Sequence
  targeting sequence with CTCN PAM
gccucccaaguagcugggau

SEQ ID NO: 15395 - RNA, 20 nt, Artificial Sequence
  targeting sequence with CTCN PAM
ugccucagccucccaaguag

SEQ ID NO: 15396 - RNA, 20 nt, Artificial Sequence
  targeting sequence with CTCN PAM
uggguucaagcaguucuccu

SEQ ID NO: 15397 - RNA, 20 nt, Artificial Sequence
  targeting sequence with CTCN PAM
accuccuggguucaagcagu

SEQ ID NO: 15398 - RNA, 20 nt, Artificial Sequence
  targeting sequence with CTCN PAM
cugcaaccuccaccuccugg

SEQ ID NO: 15399 - RNA, 20 nt, Artificial Sequence
  targeting sequence with CTCN PAM
gcucacugcaaccuccaccu

SEQ ID NO: 15400 - RNA, 20 nt, Artificial Sequence
  targeting sequence with CTCN PAM
agccuggggacauagagaga

SEQ ID NO: 15401 - RNA, 20 nt, Artificial Sequence
  targeting sequence with CTCN PAM
auguccccaggcuggagugc

SEQ ID NO: 15402 - RNA, 20 nt, Artificial Sequence
  targeting sequence with CTCN PAM
cuauguccccaggcuggagu

SEQ ID NO: 15403 - RNA, 20 nt, Artificial Sequence
  targeting sequence with CTCN PAM
aagaaaaaaagagagagaga

SEQ ID NO: 15404 - RNA, 20 nt, Artificial Sequence
  targeting sequence with CTCN PAM
uuuuuucuuugagacacugu

SEQ ID NO: 15405 - RNA, 20 nt, Artificial Sequence
  targeting sequence with CTCN PAM
cuuuuuuucuuugagacacu

SEQ ID NO: 15406 - RNA, 20 nt, Artificial Sequence
  targeting sequence with CTCN PAM
cucuuuuuuucuuugagaca

SEQ ID NO: 15407 - RNA, 20 nt, Artificial Sequence
  targeting sequence with CTCN PAM
cucucuuuuuuucuuugaga

SEQ ID NO: 15408 - RNA, 20 nt, Artificial Sequence
  targeting sequence with CTCN PAM
gugagccuugaggggagacc

SEQ ID NO: 15409 - RNA, 20 nt, Artificial Sequence
  targeting sequence with CTCN PAM
cugagucucucucucuuuuu

SEQ ID NO: 15410 - RNA, 20 nt, Artificial Sequence
  targeting sequence with CTCN PAM
aggcucacugagucucucuc

SEQ ID NO: 15411 - RNA, 20 nt, Artificial Sequence
  targeting sequence with CTCN PAM
ccucaaggcucacugagucu

SEQ ID NO: 15412 - RNA, 20 nt, Artificial Sequence
  targeting sequence with CTCN PAM
cggauggucuccccucaagg

SEQ ID NO: 15413 - RNA, 20 nt, Artificial Sequence
  targeting sequence with CTCN PAM
caugccagcggucagugucu

SEQ ID NO: 15414 - RNA, 20 nt, Artificial Sequence
  targeting sequence with CTCN PAM
ccaagacacugaccgcuggc

SEQ ID NO: 15415 - RNA, 20 nt, Artificial Sequence
  targeting sequence with CTCN PAM
ccccaagacacugaccgcug

SEQ ID NO: 15416 - RNA, 20 nt, Artificial Sequence
  targeting sequence with CTCN PAM
cccaccccccacgggccagc

SEQ ID NO: 15417 - RNA, 20 nt, Artificial Sequence
  targeting sequence with CTCN PAM
guggcaggcaucagcuggcc

SEQ ID NO: 15418 - RNA, 20 nt, Artificial Sequence
  targeting sequence with CTCN PAM
ccucaggcccgagccacggc

SEQ ID NO: 15419 - RNA, 20 nt, Artificial Sequence
  targeting sequence with CTCN PAM
ucaggcccgagccacggcgg

SEQ ID NO: 15420 - RNA, 20 nt, Artificial Sequence
  targeting sequence with CTCN PAM
ggcccgagccacggcggugu

SEQ ID NO: 15421 - RNA, 20 nt, Artificial Sequence
  targeting sequence with CTCN PAM
ggccugaggagagauggcag

SEQ ID NO: 15422 - RNA, 20 nt, Artificial Sequence
  targeting sequence with CTCN PAM
uggugggacaccgccguggc

SEQ ID NO: 15423 - RNA, 20 nt, Artificial Sequence
  targeting sequence with CTCN PAM
ggccuccuggugggacaccg

SEQ ID NO: 15424 - RNA, 20 nt, Artificial Sequence
  targeting sequence with CTCN PAM
cggugggacgccgccacccc

SEQ ID NO: 15425 - RNA, 20 nt, Artificial Sequence
  targeting sequence with CTCN PAM
agcaccaugcguagcaccgg

SEQ ID NO: 15426 - RNA, 20 nt, Artificial Sequence
  targeting sequence with CTCN PAM
ccagccugcagcgccuccag

SEQ ID NO: 15427 - RNA, 20 nt, Artificial Sequence
  targeting sequence with CTCN PAM
acauccugcacaaguaccca

SEQ ID NO: 15428 - RNA, 20 nt, Artificial Sequence
  targeting sequence with CTCN PAM
gcuucaaguaccugcugaag

SEQ ID NO: 15429 - RNA, 20 nt, Artificial Sequence
  targeting sequence with CTCN PAM
ucgccaggccccucaacucc

SEQ ID NO: 15430 - RNA, 20 nt, Artificial Sequence
  targeting sequence with CTCN PAM
ccaggccccucaacuccaaa

SEQ ID NO: 15431 - RNA, 20 nt, Artificial Sequence
  targeting sequence with CTCN PAM
acuccaaagccaggggggcc

SEQ ID NO: 15432 - RNA, 20 nt, Artificial Sequence
  targeting sequence with CTCN PAM
aaagccaggggggccacugg

SEQ ID NO: 15433 - RNA, 20 nt, Artificial Sequence
  targeting sequence with CTCN PAM
ggggcgcuuacuuugaagcu

SEQ ID NO: 15434 - RNA, 20 nt, Artificial Sequence
  targeting sequence with CTCN PAM
cucaggggcgcuuacuuuga

SEQ ID NO: 15435 - RNA, 20 nt, Artificial Sequence
  targeting sequence with CTCN PAM
aacccugggcuauguccucc

SEQ ID NO: 15436 - RNA, 20 nt, Artificial Sequence
  targeting sequence with CTCN PAM
gugagugcugcggccucuac

SEQ ID NO: 15437 - RNA, 20 nt, Artificial Sequence
  targeting sequence with CTCN PAM
cagaggccaggaccauugcu

SEQ ID NO: 15438 - RNA, 20 nt, Artificial Sequence
  targeting sequence with CTCN PAM
acuggaaggccuuuccccuc

SEQ ID NO: 15439 - RNA, 20 nt, Artificial Sequence
  targeting sequence with CTCN PAM
gguccccuguccuuguuccu

SEQ ID NO: 15440 - RNA, 20 nt, Artificial Sequence
  targeting sequence with CTCN PAM
uguggucucagccgagaugc

SEQ ID NO: 15441 - RNA, 20 nt, Artificial Sequence
  targeting sequence with CTCN PAM
gccgagaugcccucuccucu

SEQ ID NO: 15442 - RNA, 20 nt, Artificial Sequence
  targeting sequence with CTCN PAM
gcugagaccacaggaggaac

SEQ ID NO: 15443 - RNA, 20 nt, Artificial Sequence
  targeting sequence with CTCN PAM
ccucuaggaaggcagguagu

SEQ ID NO: 15444 - RNA, 20 nt, Artificial Sequence
  targeting sequence with CTCN PAM
ucuaggaaggcagguagugu

SEQ ID NO: 15445 - RNA, 20 nt, Artificial Sequence
  targeting sequence with CTCN PAM
aggaaggcagguagugugcc

SEQ ID NO: 15446 - RNA, 20 nt, Artificial Sequence
  targeting sequence with CTCN PAM
cugagcucccacugcaagag

SEQ ID NO: 15447 - RNA, 20 nt, Artificial Sequence
  targeting sequence with CTCN PAM
gagcucccacugcaagaguc

SEQ ID NO: 15448 - RNA, 20 nt, Artificial Sequence
  targeting sequence with CTCN PAM
gagagggcacacuaccugcc

SEQ ID NO: 15449 - RNA, 20 nt, Artificial Sequence
  targeting sequence with CTCN PAM
cacugcaagagucacccugu

SEQ ID NO: 15450 - RNA, 20 nt, Artificial Sequence
  targeting sequence with CTCN PAM
ugcagugggagcucagagag

SEQ ID NO: 15451 - RNA, 20 nt, Artificial Sequence
  targeting sequence with CTCN PAM
ccacagcaaaggguuuuccc

SEQ ID NO: 15452 - RNA, 20 nt, Artificial Sequence
  targeting sequence with CTCN PAM
gcuggcaccucccugagcag

SEQ ID NO: 15453 - RNA, 20 nt, Artificial Sequence
  targeting sequence with CTCN PAM
cugagcagccauguccuccg

SEQ ID NO: 15454 - RNA, 20 nt, Artificial Sequence
  targeting sequence with CTCN PAM
gggaggugccagcagaggga

SEQ ID NO: 15455 - RNA, 20 nt, Artificial Sequence
  targeting sequence with CTCN PAM
guuucaaaggggagaguuuc

SEQ ID NO: 15456 - RNA, 20 nt, Artificial Sequence
  targeting sequence with CTCN PAM
ccuuugaaacggaggacaug

SEQ ID NO: 15457 - RNA, 20 nt, Artificial Sequence
  targeting sequence with CTCN PAM
ccccuuugaaacggaggaca

SEQ ID NO: 15458 - RNA, 20 nt, Artificial Sequence
  targeting sequence with CTCN PAM
uuauaaagaugaaacucucc

SEQ ID NO: 15459 - RNA, 20 nt, Artificial Sequence
  targeting sequence with CTCN PAM
aaaaggggacccaugccagg

SEQ ID NO: 15460 - RNA, 20 nt, Artificial Sequence
  targeting sequence with CTCN PAM
gagcugaggcaggucuggga

SEQ ID NO: 15461 - RNA, 20 nt, Artificial Sequence
  targeting sequence with CTCN PAM
gagugaccuggcaugggucc

SEQ ID NO: 15462 - RNA, 20 nt, Artificial Sequence
  targeting sequence with CTCN PAM
gcucugagugaccuggcaug

SEQ ID NO: 15463 - RNA, 20 nt, Artificial Sequence
  targeting sequence with CTCN PAM
gggaccagacccacggccug

SEQ ID NO: 15464 - RNA, 20 nt, Artificial Sequence
  targeting sequence with CTCN PAM
gccuaccccaagccgguccc

SEQ ID NO: 15465 - RNA, 20 nt, Artificial Sequence
  targeting sequence with CTCN PAM
ugggcgugggucagagccug

SEQ ID NO: 15466 - RNA, 20 nt, Artificial Sequence
  targeting sequence with CTCN PAM
gacccacgcccaggaguucu

SEQ ID NO: 15467 - RNA, 20 nt, Artificial Sequence
  targeting sequence with CTCN PAM
cugcuuagccgccugguccu

SEQ ID NO: 15468 - RNA, 20 nt, Artificial Sequence
  targeting sequence with CTCN PAM
ucucccugcuuagccgccug

SEQ ID NO: 15469 - RNA, 20 nt, Artificial Sequence
  targeting sequence with CTCN PAM
ggcucuucucccugcuuagc

SEQ ID NO: 15470 - RNA, 20 nt, Artificial Sequence
  targeting sequence with CTCN PAM
acugccagcacaccgcauca

SEQ ID NO: 15471 - RNA, 20 nt, Artificial Sequence
  targeting sequence with CTCN PAM
ccaucaccaagacuagaaac

SEQ ID NO: 15472 - RNA, 20 nt, Artificial Sequence
  targeting sequence with CTCN PAM
gggcuccccaucaccaagac

SEQ ID NO: 15473 - RNA, 20 nt, Artificial Sequence
  targeting sequence with CTCN PAM
uggcaagcuguuucuuuccu

SEQ ID NO: 15474 - RNA, 20 nt, Artificial Sequence
  targeting sequence with CTCN PAM
cuucccugccgcucacagcc

SEQ ID NO: 15475 - RNA, 20 nt, Artificial Sequence
  targeting sequence with CTCN PAM
cagccuuggugauuguccug

SEQ ID NO: 15476 - RNA, 20 nt, Artificial Sequence
  targeting sequence with CTCN PAM
ucuuuacagcaggacaauca

SEQ ID NO: 15477 - RNA, 20 nt, Artificial Sequence
  targeting sequence with CTCN PAM
agccguguaccacagccacg

SEQ ID NO: 15478 - RNA, 20 nt, Artificial Sequence
  targeting sequence with CTCN PAM
uccagccguguaccacagcc

SEQ ID NO: 15479 - RNA, 20 nt, Artificial Sequence
  targeting sequence with CTCN PAM
gcccuccuccagccguguac

SEQ ID NO: 15480 - RNA, 20 nt, Artificial Sequence
  targeting sequence with CTCN PAM
cagcuuccuccgcccuccuc

SEQ ID NO: 15481 - RNA, 20 nt, Artificial Sequence
  targeting sequence with CTCN PAM
gggcucacagcuuccuccgc

SEQ ID NO: 15482 - RNA, 20 nt, Artificial Sequence
  targeting sequence with CTCN PAM
gcccauguucugcugagcgu

SEQ ID NO: 15483 - RNA, 20 nt, Artificial Sequence
  targeting sequence with CTCN PAM
gcagaacaugggcugagguc

SEQ ID NO: 15484 - RNA, 20 nt, Artificial Sequence
  targeting sequence with CTCN PAM
ccccuugacgcucagcagaa

SEQ ID NO: 15485 - RNA, 20 nt, Artificial Sequence
  targeting sequence with CTCN PAM
ugccccaugcccccaccacc

SEQ ID NO: 15486 - RNA, 20 nt, Artificial Sequence
  targeting sequence with CTCN PAM
cccacuacccugaagcgcug

SEQ ID NO: 15487 - RNA, 20 nt, Artificial Sequence
  targeting sequence with CTCN PAM
ucccccacuacccugaagcg

SEQ ID NO: 15488 - RNA, 20 nt, Artificial Sequence
  targeting sequence with CTCN PAM
uccucccccacuacccugaa

SEQ ID NO: 15489 - RNA, 20 nt, Artificial Sequence
  targeting sequence with CTCN PAM
ggacuccuccucccccacua

SEQ ID NO: 15490 - RNA, 20 nt, Artificial Sequence
  targeting sequence with CTCN PAM
accaccugcccuaggccugc

SEQ ID NO: 15491 - RNA, 20 nt, Artificial Sequence
  targeting sequence with CTCN PAM
caaccaccugcccuaggccu

SEQ ID NO: 15492 - RNA, 20 nt, Artificial Sequence
  targeting sequence with CTCN PAM
ggaucucucaaccaccugcc

SEQ ID NO: 15493 - RNA, 20 nt, Artificial Sequence
  targeting sequence with CTCN PAM
aaggacaguggcuucgugcc

SEQ ID NO: 15494 - RNA, 20 nt, Artificial Sequence
  targeting sequence with CTCN PAM
cugccucucacugccugugg

SEQ ID NO: 15495 - RNA, 20 nt, Artificial Sequence
  targeting sequence with CTCN PAM
cacugccuguggagcccccc

SEQ ID NO: 15496 - RNA, 20 nt, Artificial Sequence
  targeting sequence with CTCN PAM
cugccuguggagccccccug

SEQ ID NO: 15497 - RNA, 20 nt, Artificial Sequence
  targeting sequence with CTCN PAM
acaggcagugagaggcaggg

SEQ ID NO: 15498 - RNA, 20 nt, Artificial Sequence
  targeting sequence with CTCN PAM
uuccaaacaggggggcucca

SEQ ID NO: 15499 - RNA, 20 nt, Artificial Sequence
  targeting sequence with CTCN PAM
cauucggagucuuacggggg

SEQ ID NO: 15500 - RNA, 20 nt, Artificial Sequence
  targeting sequence with CTCN PAM
gaaugggaggccucguucca

SEQ ID NO: 15501 - RNA, 20 nt, Artificial Sequence
  targeting sequence with CTCN PAM
cgccccccaccccccguaag

SEQ ID NO: 15502 - RNA, 20 nt, Artificial Sequence
  targeting sequence with CTCN PAM
ggugccucacgccccccacc

SEQ ID NO: 15503 - RNA, 20 nt, Artificial Sequence
  targeting sequence with CTCN PAM
gcuuucagccccaccccgug

SEQ ID NO: 15504 - RNA, 20 nt, Artificial Sequence
  targeting sequence with CTCN PAM
aguuaguucccaagcacaag

SEQ ID NO: 15505 - RNA, 20 nt, Artificial Sequence
  targeting sequence with CTCN PAM
caggagagcgggugaggcca

SEQ ID NO: 15506 - RNA, 20 nt, Artificial Sequence
  targeting sequence with CTCN PAM
ugggagccgucgcgggggcc

SEQ ID NO: 15507 - RNA, 20 nt, Artificial Sequence
  targeting sequence with CTCN PAM
ccugggagccgucgcggggg

SEQ ID NO: 15508 - RNA, 20 nt, Artificial Sequence
  targeting sequence with CTCN PAM
cccgcucuccugggagccgu

SEQ ID NO: 15509 - RNA, 20 nt, Artificial Sequence
  targeting sequence with CTCN PAM
cuugguuucuuggggcccuu

SEQ ID NO: 15510 - RNA, 20 nt, Artificial Sequence
  targeting sequence with CTCN PAM
uuggccucacuugguuucuu

SEQ ID NO: 15511 - RNA, 20 nt, Artificial Sequence
  targeting sequence with CTCN PAM
caacgugggcaaggugaaaa

SEQ ID NO: 15512 - RNA, 20 nt, Artificial Sequence
  targeting sequence with CTCN PAM
uggcugccuuuuucaccuug

SEQ ID NO: 15513 - RNA, 20 nt, Artificial Sequence
  targeting sequence with CTCN PAM
ucccaagccaggcgcagcca

SEQ ID NO: 15514 - RNA, 20 nt, Artificial Sequence
  targeting sequence with CTCN PAM
caagccaggcgcagccacag

SEQ ID NO: 15515 - RNA, 20 nt, Artificial Sequence
  targeting sequence with CTCN PAM
guggcugcgccuggcuuggg

SEQ ID NO: 15516 - RNA, 20 nt, Artificial Sequence
  targeting sequence with CTCN PAM
caagcaaggcggcgcggcca

SEQ ID NO: 15517 - RNA, 20 nt, Artificial Sequence
  targeting sequence with CTCN PAM
cgacugugcccugguguccu

SEQ ID NO: 15518 - RNA, 20 nt, Artificial Sequence
  targeting sequence with CTCN PAM
cccgacugugcccugguguc

SEQ ID NO: 15519 - RNA, 20 nt, Artificial Sequence
  targeting sequence with CTCN PAM
gcaggaaggcaaaggccaaa

SEQ ID NO: 15520 - RNA, 20 nt, Artificial Sequence
  targeting sequence with CTCN PAM
ugcugccuuuggccuuugcc

SEQ ID NO: 15521 - RNA, 20 nt, Artificial Sequence
  targeting sequence with CTCN PAM
aguggcugucaagaccccca

SEQ ID NO: 15522 - RNA, 20 nt, Artificial Sequence
  targeting sequence with CTCN PAM
ccgcccccgcuccaguggcu

SEQ ID NO: 15523 - RNA, 20 nt, Artificial Sequence
  targeting sequence with CTCN PAM
ggagagggguuuccuuaucu

SEQ ID NO: 15524 - RNA, 20 nt, Artificial Sequence
  targeting sequence with CTCN PAM
agagcuggcuccccgccccc

SEQ ID NO: 15525 - RNA, 20 nt, Artificial Sequence
  targeting sequence with CTCN PAM
ccagagcuggcuccccgccc

SEQ ID NO: 15526 - RNA, 20 nt, Artificial Sequence
  targeting sequence with CTCN PAM
ggacacaugcacuagauaag

SEQ ID NO: 15527 - RNA, 20 nt, Artificial Sequence
  targeting sequence with CTCN PAM
aggucaagcccagcacucag

SEQ ID NO: 15528 - RNA, 20 nt, Artificial Sequence
  targeting sequence with CTCN PAM
ccaggucaagcccagcacuc

SEQ ID NO: 15529 - RNA, 20 nt, Artificial Sequence
  targeting sequence with CTCN PAM
cuccaggucaagcccagcac

SEQ ID NO: 15530 - RNA, 20 nt, Artificial Sequence
  targeting sequence with CTCN PAM
cucuccaggucaagcccagc

SEQ ID NO: 15531 - RNA, 20 nt, Artificial Sequence
  targeting sequence with CTCN PAM
ugguagcugguugggggaag

SEQ ID NO: 15532 - RNA, 20 nt, Artificial Sequence
  targeting sequence with CTCN PAM
uucccccaaccagcuaccau

SEQ ID NO: 15533 - RNA, 20 nt, Artificial Sequence
  targeting sequence with CTCN PAM
gcuucccccuucauaacccu

SEQ ID NO: 15534 - RNA, 20 nt, Artificial Sequence
  targeting sequence with CTCN PAM
uggucucugcuucccccuuc

SEQ ID NO: 15535 - RNA, 20 nt, Artificial Sequence
  targeting sequence with CTCN PAM
uucuugaggcaguggaggaa

SEQ ID NO: 15536 - RNA, 20 nt, Artificial Sequence
  targeting sequence with CTCN PAM
agaaugagucagucuccugg

SEQ ID NO: 15537 - RNA, 20 nt, Artificial Sequence
  targeting sequence with CTCN PAM
acugccucaagaaugaguca

SEQ ID NO: 15538 - RNA, 20 nt, Artificial Sequence
  targeting sequence with CTCN PAM
agcaggggaagggccugugu

SEQ ID NO: 15539 - RNA, 20 nt, Artificial Sequence
  targeting sequence with CTCN PAM
aggccuuuacacaggcccuu

SEQ ID NO: 15540 - RNA, 20 nt, Artificial Sequence
  targeting sequence with CTCN PAM
accuucuuuaugccuccagg

SEQ ID NO: 15541 - RNA, 20 nt, Artificial Sequence
  targeting sequence with CTCN PAM
ugccuguaagccuaacacuu

SEQ ID NO: 15542 - RNA, 20 nt, Artificial Sequence
  targeting sequence with CTCN PAM
caaaguguuaggcuuacagg

SEQ ID NO: 15543 - RNA, 20 nt, Artificial Sequence
  targeting sequence with CTCN PAM
agggauccgcccgccuuggc

SEQ ID NO: 15544 - RNA, 20 nt, Artificial Sequence
  targeting sequence with CTCN PAM
ugaccucaagggauccgccc

SEQ ID NO: 15545 - RNA, 20 nt, Artificial Sequence
  targeting sequence with CTCN PAM
aacuccugaccucaagggau

SEQ ID NO: 15546 - RNA, 20 nt, Artificial Sequence
  targeting sequence with CTCN PAM
gcuaaaaauacaaaaauuag

SEQ ID NO: 15547 - RNA, 20 nt, Artificial Sequence
  targeting sequence with CTCN PAM
gccacccaaguaccugggau

SEQ ID NO: 15548 - RNA, 20 nt, Artificial Sequence
  targeting sequence with CTCN PAM
uggguucaagugauuuuccu

SEQ ID NO: 15549 - RNA, 20 nt, Artificial Sequence
  targeting sequence with CTCN PAM
cuguaacaucugccuccugg

SEQ ID NO: 15550 - RNA, 20 nt, Artificial Sequence
  targeting sequence with CTCN PAM
gcucacuguaacaucugccu

SEQ ID NO: 15551 - RNA, 20 nt, Artificial Sequence
  targeting sequence with CTCN PAM
agcgugggugacagagugac

SEQ ID NO: 15552 - RNA, 20 nt, Artificial Sequence
  targeting sequence with CTCN PAM
gucacccacgcuggaguaca

SEQ ID NO: 15553 - RNA, 20 nt, Artificial Sequence
  targeting sequence with CTCN PAM
gucucaaaacaaaacacaaa

SEQ ID NO: 15554 - RNA, 20 nt, Artificial Sequence
  targeting sequence with CTCN PAM
aaacaaaacacaaaaagaag

SEQ ID NO: 15555 - RNA, 20 nt, Artificial Sequence
  targeting sequence with CTCN PAM
accuucuuuuuguguuuugu

SEQ ID NO: 15556 - RNA, 20 nt, Artificial Sequence
  targeting sequence with CTCN PAM
aauacuccaccuucuuuuug

SEQ ID NO: 15557 - RNA, 20 nt, Artificial Sequence
  targeting sequence with CTCN PAM
uugccaaaacuguagguaga

SEQ ID NO: 15558 - RNA, 20 nt, Artificial Sequence
  targeting sequence with CTCN PAM
agauaaagcccugauuccag

SEQ ID NO: 15559 - RNA, 20 nt, Artificial Sequence
  targeting sequence with CTCN PAM
gcauuguccuccagauaaag

SEQ ID NO: 15560 - RNA, 20 nt, Artificial Sequence
  targeting sequence with CTCN PAM
agcccuagcugcuuccuguc

SEQ ID NO: 15561 - RNA, 20 nt, Artificial Sequence
  targeting sequence with CTCN PAM
cucucuuuuagagacaggcu

SEQ ID NO: 15562 - RNA, 20 nt, Artificial Sequence
  targeting sequence with CTCN PAM
cucuuuuagagacaggcucu

SEQ ID NO: 15563 - RNA, 20 nt, Artificial Sequence
  targeting sequence with CTCN PAM
cuuuuagagacaggcucuug

SEQ ID NO: 15564 - RNA, 20 nt, Artificial Sequence
  targeting sequence with CTCN PAM
uuuagagacaggcucuugcu

SEQ ID NO: 15565 - RNA, 20 nt, Artificial Sequence
  targeting sequence with CTCN PAM
aaaagagagagaggaaaaaa

SEQ ID NO: 15566 - RNA, 20 nt, Artificial Sequence
  targeting sequence with CTCN PAM
ugcucugucacacaggugag

SEQ ID NO: 15567 - RNA, 20 nt, Artificial Sequence
  targeting sequence with CTCN PAM
gucacacaggugagugcuga

SEQ ID NO: 15568 - RNA, 20 nt, Artificial Sequence
  targeting sequence with CTCN PAM
ccugugugacagagcaagag

SEQ ID NO: 15569 - RNA, 20 nt, Artificial Sequence
  targeting sequence with CTCN PAM
gcacucaccugugugacaga

SEQ ID NO: 15570 - RNA, 20 nt, Artificial Sequence
  targeting sequence with CTCN PAM
aauuccugggcucagcacuc

SEQ ID NO: 15571 - RNA, 20 nt, Artificial Sequence
  targeting sequence with CTCN PAM
gcaaaaaauaaaaauauuag

SEQ ID NO: 15572 - RNA, 20 nt, Artificial Sequence
  targeting sequence with CTCN PAM
caaguagcuggggcaacagg

SEQ ID NO: 15573 - RNA, 20 nt, Artificial Sequence
  targeting sequence with CTCN PAM
gccucccaaguagcuggggc

SEQ ID NO: 15574 - RNA, 20 nt, Artificial Sequence
  targeting sequence with CTCN PAM
ugccucagccucccaaguag

SEQ ID NO: 15575 - RNA, 20 nt, Artificial Sequence
  targeting sequence with CTCN PAM
agcgauccuccugccucagc

SEQ ID NO: 15576 - RNA, 20 nt, Artificial Sequence
  targeting sequence with CTCN PAM
caggcucaagcgauccuccu

SEQ ID NO: 15577 - RNA, 20 nt, Artificial Sequence
  targeting sequence with CTCN PAM
guuuacugcagccuugaccu

SEQ ID NO: 15578 - RNA, 20 nt, Artificial Sequence
  targeting sequence with CTCN PAM
agcacagugacagagcgaga

SEQ ID NO: 15579 - RNA, 20 nt, Artificial Sequence
  targeting sequence with CTCN PAM
gucacugugcuggagugugg

SEQ ID NO: 15580 - RNA, 20 nt, Artificial Sequence
  targeting sequence with CTCN PAM
cucugucacugugcuggagu

SEQ ID NO: 15581 - RNA, 20 nt, Artificial Sequence
  targeting sequence with CTCN PAM
agcugacaggcccguuagac

SEQ ID NO: 15582 - RNA, 20 nt, Artificial Sequence
  targeting sequence with CTCN PAM
agccuuuaguuugucuucca

SEQ ID NO: 15583 - RNA, 20 nt, Artificial Sequence
  targeting sequence with CTCN PAM
aagcccaccaaagccaacgu

SEQ ID NO: 15584 - RNA, 20 nt, Artificial Sequence
  targeting sequence with CTCN PAM
aggcaaagcacuagugcucc

SEQ ID NO: 15585 - RNA, 20 nt, Artificial Sequence
  targeting sequence with CTCN PAM
agccacucugugaggggcau

SEQ ID NO: 15586 - RNA, 20 nt, Artificial Sequence
  targeting sequence with CTCN PAM
gugaggggcaugcuauuauu

SEQ ID NO: 15587 - RNA, 20 nt, Artificial Sequence
  targeting sequence with CTCN PAM
cagaguggcuggaggguuaa

SEQ ID NO: 15588 - RNA, 20 nt, Artificial Sequence
  targeting sequence with CTCN PAM
gugaccuaguuugaagacug

SEQ ID NO: 15589 - RNA, 20 nt, Artificial Sequence
  targeting sequence with CTCN PAM
gaguggcuaaaugauuugcc

SEQ ID NO: 15590 - RNA, 20 nt, Artificial Sequence
  targeting sequence with CTCN PAM
gagccucagugaccuaguuu

SEQ ID NO: 15591 - RNA, 20 nt, Artificial Sequence
  targeting sequence with CTCN PAM
guuaugugacauggggcaaa

SEQ ID NO: 15592 - RNA, 20 nt, Artificial Sequence
  targeting sequence with CTCN PAM
uggguccuaggucuucacuc

SEQ ID NO: 15593 - RNA, 20 nt, Artificial Sequence
  targeting sequence with CTCN PAM
agaacccccauuccuccugg

SEQ ID NO: 15594 - RNA, 20 nt, Artificial Sequence
  targeting sequence with CTCN PAM
uucuuccccuauaaaaccuc

SEQ ID NO: 15595 - RNA, 20 nt, Artificial Sequence
  targeting sequence with CTCN PAM
uccaucaaauuccaggagau

SEQ ID NO: 15596 - RNA, 20 nt, Artificial Sequence
  targeting sequence with CTCN PAM
aucaaauuccaggagaugcu

SEQ ID NO: 15597 - RNA, 20 nt, Artificial Sequence
  targeting sequence with CTCN PAM
uggaauuugauggaggaggu

SEQ ID NO: 15598 - RNA, 20 nt, Artificial Sequence
  targeting sequence with CTCN PAM
gcaucuccuggaauuugaug

SEQ ID NO: 15599 - RNA, 20 nt, Artificial Sequence
  targeting sequence with CTCN PAM
gcuuugguuuuccuguaggc

SEQ ID NO: 15600 - RNA, 20 nt, Artificial Sequence
  targeting sequence with CTCN PAM
cagcuuugguuuuccuguag

SEQ ID NO: 15601 - RNA, 20 nt, Artificial Sequence
  targeting sequence with CTCN PAM
uacucucagcuuugguuuuc

SEQ ID NO: 15602 - RNA, 20 nt, Artificial Sequence
  targeting sequence with CTCN PAM
ggccuguucagggcaggcag

SEQ ID NO: 15603 - RNA, 20 nt, Artificial Sequence
  targeting sequence with CTCN PAM
gcccccggaagggucaucca

SEQ ID NO: 15604 - RNA, 20 nt, Artificial Sequence
  targeting sequence with CTCN PAM
auuucuuuuccuacaaagca

SEQ ID NO: 15605 - RNA, 20 nt, Artificial Sequence
  targeting sequence with CTCN PAM
cugguccccuggcacccugg

SEQ ID NO: 15606 - RNA, 20 nt, Artificial Sequence
  targeting sequence with CTCN PAM
gguccccuggcacccugggg

SEQ ID NO: 15607 - RNA, 20 nt, Artificial Sequence
  targeting sequence with CTCN PAM
uaucuguaagauggggaugg

SEQ ID NO: 15608 - RNA, 20 nt, Artificial Sequence
  targeting sequence with CTCN PAM
ggguacacaacaucgcccuu

SEQ ID NO: 15609 - RNA, 20 nt, Artificial Sequence
  targeting sequence with CTCN PAM
ggguggcucuggguacacaa

SEQ ID NO: 15610 - RNA, 20 nt, Artificial Sequence
  targeting sequence with CTCN PAM
uugcuccugguuugcuuucg

SEQ ID NO: 15611 - RNA, 20 nt, Artificial Sequence
  targeting sequence with CTCN PAM
ugguuugcuuucguauaggu

SEQ ID NO: 15612 - RNA, 20 nt, Artificial Sequence
  targeting sequence with CTCN PAM
ugcuaagggcagugggucca

SEQ ID NO: 15613 - RNA, 20 nt, Artificial Sequence
  targeting sequence with CTCN PAM
gucuuccuggacaaaugugc

SEQ ID NO: 15614 - RNA, 20 nt, Artificial Sequence
  targeting sequence with CTCN PAM
ucauccaaaguguccagcca

SEQ ID NO: 15615 - RNA, 20 nt, Artificial Sequence
  targeting sequence with CTCN PAM
ggcuggacacuuuggaugau

SEQ ID NO: 15616 - RNA, 20 nt, Artificial Sequence
  targeting sequence with CTCN PAM
ggcccuaagcuucagcccuc

SEQ ID NO: 15617 - RNA, 20 nt, Artificial Sequence
  targeting sequence with CTCN PAM
gccccugccucuggcccuaa

SEQ ID NO: 15618 - RNA, 20 nt, Artificial Sequence
  targeting sequence with CTCN PAM
ccgccccugccucuggcccu

SEQ ID NO: 15619 - RNA, 20 nt, Artificial Sequence
  targeting sequence with CTCN PAM
cuccgccccugccucuggcc

SEQ ID NO: 15620 - RNA, 20 nt, Artificial Sequence
  targeting sequence with CTCN PAM
gucucucuccgccccugccu

SEQ ID NO: 15621 - RNA, 20 nt, Artificial Sequence
  targeting sequence with CTCN PAM
gcccuaguuuuuauucuuca

SEQ ID NO: 15622 - RNA, 20 nt, Artificial Sequence
  targeting sequence with CTCN PAM
auuuauuucauuguaagcua

SEQ ID NO: 15623 - RNA, 20 nt, Artificial Sequence
  targeting sequence with CTCN PAM
caauugguguggguagaggc

SEQ ID NO: 15624 - RNA, 20 nt, Artificial Sequence
  targeting sequence with CTCN PAM
acccacaccaauugugagga

SEQ ID NO: 15625 - RNA, 20 nt, Artificial Sequence
  targeting sequence with CTCN PAM
gccucuacccacaccaauug

SEQ ID NO: 15626 - RNA, 20 nt, Artificial Sequence
  targeting sequence with CTCN PAM
gcggauguucaugaaggacc

SEQ ID NO: 15627 - RNA, 20 nt, Artificial Sequence
  targeting sequence with CTCN PAM
gauaggagguccugccucag

SEQ ID NO: 15628 - RNA, 20 nt, Artificial Sequence
  targeting sequence with CTCN PAM
uaucugagccccagcauugg

SEQ ID NO: 15629 - RNA, 20 nt, Artificial Sequence
  targeting sequence with CTCN PAM
gggauacagacugugugcua

SEQ ID NO: 15630 - RNA, 20 nt, Artificial Sequence
  targeting sequence with CTCN PAM
aucagccccuuugcaucccg

SEQ ID NO: 15631 - RNA, 20 nt, Artificial Sequence
  targeting sequence with CTCN PAM
cuccaucagccccuuugcau

SEQ ID NO: 15632 - RNA, 20 nt, Artificial Sequence
  targeting sequence with CTCN PAM
uccuggaagccugaucgcag

SEQ ID NO: 15633 - RNA, 20 nt, Artificial Sequence
  targeting sequence with CTCN PAM
ucugccugacaacagcuacc

SEQ ID NO: 15634 - RNA, 20 nt, Artificial Sequence
  targeting sequence with CTCN PAM
gccucaucugccugacaaca

SEQ ID NO: 15635 - RNA, 20 nt, Artificial Sequence
  targeting sequence with CTCN PAM
gauggcauccucugccucau

SEQ ID NO: 15636 - RNA, 20 nt, Artificial Sequence
  targeting sequence with CTCN PAM
uuucaucccaccccucagau

SEQ ID NO: 15637 - RNA, 20 nt, Artificial Sequence
  targeting sequence with CTCN PAM
ggcaguggaaaggaaggauu

SEQ ID NO: 15638 - RNA, 20 nt, Artificial Sequence
  targeting sequence with CTCN PAM
aauccuuccuuuccacugcc

SEQ ID NO: 15639 - RNA, 20 nt, Artificial Sequence
  targeting sequence with CTCN PAM
gcuacucuaauccuuccuuu

SEQ ID NO: 15640 - RNA, 20 nt, Artificial Sequence
  targeting sequence with CTCN PAM
cugucuucucagcuacucua

SEQ ID NO: 15641 - RNA, 20 nt, Artificial Sequence
  targeting sequence with CTCN PAM
ggaaccaguggcugaaaggu

SEQ ID NO: 15642 - RNA, 20 nt, Artificial Sequence
  targeting sequence with CTCN PAM
ugggccaggcacugcgacag

SEQ ID NO: 15643 - RNA, 20 nt, Artificial Sequence
  targeting sequence with CTCN PAM
gcagccagcgccugugcucu

SEQ ID NO: 15644 - RNA, 20 nt, Artificial Sequence
  targeting sequence with CTCN PAM
gaagaagagguggggcuggg

SEQ ID NO: 15645 - RNA, 20 nt, Artificial Sequence
  targeting sequence with CTCN PAM
ucuucagagcacaggcgcug

SEQ ID NO: 15646 - RNA, 20 nt, Artificial Sequence
  targeting sequence with CTCN PAM
agcgggguggguagggcugg

SEQ ID NO: 15647 - RNA, 20 nt, Artificial Sequence
  targeting sequence with CTCN PAM
gacagcccguccaacccugu

SEQ ID NO: 15648 - RNA, 20 nt, Artificial Sequence
  targeting sequence with CTCN PAM
gucuggaggggguaccauuu

SEQ ID NO: 15649 - RNA, 20 nt, Artificial Sequence
  targeting sequence with CTCN PAM
agacagagauccuugcucag

SEQ ID NO: 15650 - RNA, 20 nt, Artificial Sequence
  targeting sequence with CTCN PAM
uccuucugcugaaaugguac

SEQ ID NO: 15651 - RNA, 20 nt, Artificial Sequence
  targeting sequence with CTCN PAM
ucacgcugggagcugcagga

SEQ ID NO: 15652 - RNA, 20 nt, Artificial Sequence
  targeting sequence with CTCN PAM
cgcugggagcugcaggaagg

SEQ ID NO: 15653 - RNA, 20 nt, Artificial Sequence
  targeting sequence with CTCN PAM
cagcgugaggagcauguucc

SEQ ID NO: 15654 - RNA, 20 nt, Artificial Sequence
  targeting sequence with CTCN PAM
agccacacagaccuuccugc

SEQ ID NO: 15655 - RNA, 20 nt, Artificial Sequence
  targeting sequence with CTCN PAM
uuacugggcucuagccacac

SEQ ID NO: 15656 - RNA, 20 nt, Artificial Sequence
  targeting sequence with CTCN PAM
ucuuuacugggcucuagcca

SEQ ID NO: 15657 - RNA, 20 nt, Artificial Sequence
  targeting sequence with CTCN PAM
caucccugugcuccucuuua

SEQ ID NO: 15658 - RNA, 20 nt, Artificial Sequence
  targeting sequence with CTCN PAM
ucucccaucccugugcuccu

SEQ ID NO: 15659 - RNA, 20 nt, Artificial Sequence
  targeting sequence with CTCN PAM
ucacacggagagacaggcuc

SEQ ID NO: 15660 - RNA, 20 nt, Artificial Sequence
  targeting sequence with CTCN PAM
cacggagagacaggcucugu

SEQ ID NO: 15661 - RNA, 20 nt, Artificial Sequence
  targeting sequence with CTCN PAM
gugugaggagugccgcagau

SEQ ID NO: 15662 - RNA, 20 nt, Artificial Sequence
  targeting sequence with CTCN PAM
ccgugugaggagugccgcag

SEQ ID NO: 15663 - RNA, 20 nt, Artificial Sequence
  targeting sequence with CTCN PAM
gugucccuaccucuugacuc

SEQ ID NO: 15664 - RNA, 20 nt, Artificial Sequence
  targeting sequence with CTCN PAM
ugacucugggcuccaugauu

SEQ ID NO: 15665 - RNA, 20 nt, Artificial Sequence
  targeting sequence with CTCN PAM
gggcuccaugauuacuugac

SEQ ID NO: 15666 - RNA, 20 nt, Artificial Sequence
  targeting sequence with CTCN PAM
augauuacuugaccaguaga

SEQ ID NO: 15667 - RNA, 20 nt, Artificial Sequence
  targeting sequence with CTCN PAM
aacacaagaaguagaagcug

SEQ ID NO: 15668 - RNA, 20 nt, Artificial Sequence
  targeting sequence with CTCN PAM
cucuucaaacuuggccacca

SEQ ID NO: 15669 - RNA, 20 nt, Artificial Sequence
  targeting sequence with CTCN PAM
ucaaacuuggccaccacucu

SEQ ID NO: 15670 - RNA, 20 nt, Artificial Sequence
  targeting sequence with CTCN PAM
augggaaagcccaugcagcu

SEQ ID NO: 15671 - RNA, 20 nt, Artificial Sequence
  targeting sequence with CTCN PAM
acaagcugcaugggcuuucc

SEQ ID NO: 15672 - RNA, 20 nt, Artificial Sequence
  targeting sequence with CTCN PAM
ccacaagcugcaugggcuuu

SEQ ID NO: 15673 - RNA, 20 nt, Artificial Sequence
  targeting sequence with CTCN PAM
guuccucuccacaagcugca

SEQ ID NO: 15674 - RNA, 20 nt, Artificial Sequence
  targeting sequence with CTCN PAM
auuuuucagcuccugcugaa

SEQ ID NO: 15675 - RNA, 20 nt, Artificial Sequence
  targeting sequence with CTCN PAM
ugcugaacucucugaccagc

SEQ ID NO: 15676 - RNA, 20 nt, Artificial Sequence
  targeting sequence with CTCN PAM
cugaccagcugguaccacgu

SEQ ID NO: 15677 - RNA, 20 nt, Artificial Sequence
  targeting sequence with CTCN PAM
gaccagcugguaccacgugc

SEQ ID NO: 15678 - RNA, 20 nt, Artificial Sequence
  targeting sequence with CTCN PAM
auuagggcuggaagaugcag

SEQ ID NO: 15679 - RNA, 20 nt, Artificial Sequence
  targeting sequence with CTCN PAM
aaugguuccuuaugacaaag

SEQ ID NO: 15680 - RNA, 20 nt, Artificial Sequence
  targeting sequence with CTCN PAM
guugcuugccguccucuaau

SEQ ID NO: 15681 - RNA, 20 nt, Artificial Sequence
  targeting sequence with CTCN PAM
gcagggaugugggcgggcag

SEQ ID NO: 15682 - RNA, 20 nt, Artificial Sequence
  targeting sequence with CTCN PAM
caggccugucugcccgccca

SEQ ID NO: 15683 - RNA, 20 nt, Artificial Sequence
  targeting sequence with CTCN PAM
ucacaggccugucugcccgc

SEQ ID NO: 15684 - RNA, 20 nt, Artificial Sequence
  targeting sequence with CTCN PAM
ugccacaacccagaugaagg

SEQ ID NO: 15685 - RNA, 20 nt, Artificial Sequence
  targeting sequence with CTCN PAM
cagagggaggguuagaagug

SEQ ID NO: 15686 - RNA, 20 nt, Artificial Sequence
  targeting sequence with CTCN PAM
gugagcauguccuggcuggu

SEQ ID NO: 15687 - RNA, 20 nt, Artificial Sequence
  targeting sequence with CTCN PAM
cucugugagcauguccuggc

SEQ ID NO: 15688 - RNA, 20 nt, Artificial Sequence
  targeting sequence with CTCN PAM
gcugauggauuggauguagg

SEQ ID NO: 15689 - RNA, 20 nt, Artificial Sequence
  targeting sequence with CTCN PAM
ucagugacccuuccuacauc

SEQ ID NO: 15690 - RNA, 20 nt, Artificial Sequence
  targeting sequence with CTCN PAM
ggaaauggucacccagcagu

SEQ ID NO: 15691 - RNA, 20 nt, Artificial Sequence
  targeting sequence with CTCN PAM
ccucaggaaauggucaccca

SEQ ID NO: 15692 - RNA, 20 nt, Artificial Sequence
  targeting sequence with CTCN PAM
uggcacgugccaaguccuca

SEQ ID NO: 15693 - RNA, 20 nt, Artificial Sequence
  targeting sequence with CTCN PAM
gcagccuccuggcacgugcc

SEQ ID NO: 15694 - RNA, 20 nt, Artificial Sequence
  targeting sequence with CTCN PAM
ucaggaccauaucucggcag

SEQ ID NO: 15695 - RNA, 20 nt, Artificial Sequence
  targeting sequence with CTCN PAM
caucaggaccauaucucggc

SEQ ID NO: 15696 - RNA, 20 nt, Artificial Sequence
  targeting sequence with CTCN PAM
guggcuaggcugccaccucu

SEQ ID NO: 15697 - RNA, 20 nt, Artificial Sequence
  targeting sequence with CTCN PAM
guccuccguggcuaggcugc

SEQ ID NO: 15698 - RNA, 20 nt, Artificial Sequence
  targeting sequence with CTCN PAM
cuguccuccguggcuaggcu

SEQ ID NO: 15699 - RNA, 20 nt, Artificial Sequence
  targeting sequence with CTCN PAM
cuuuaguccaccccuuccuu

SEQ ID NO: 15700 - RNA, 20 nt, Artificial Sequence
  targeting sequence with CTCN PAM
gacucccuuuaguccacccc

SEQ ID NO: 15701 - RNA, 20 nt, Artificial Sequence
  targeting sequence with CTCN PAM
aguccugugcaguuugccuc

SEQ ID NO: 15702 - RNA, 20 nt, Artificial Sequence
  targeting sequence with CTCN PAM
gcauggggcaucagcugcuc

SEQ ID NO: 15703 - RNA, 20 nt, Artificial Sequence
  targeting sequence with CTCN PAM
cuuccugccccugcuccacc

SEQ ID NO: 15704 - RNA, 20 nt, Artificial Sequence
  targeting sequence with CTCN PAM
accaccccacccucuccucc

SEQ ID NO: 15705 - RNA, 20 nt, Artificial Sequence
  targeting sequence with CTCN PAM
ccuccuggaaucccggcuuu

SEQ ID NO: 15706 - RNA, 20 nt, Artificial Sequence
  targeting sequence with CTCN PAM
uccuggaaucccggcuuugc

SEQ ID NO: 15707 - RNA, 20 nt, Artificial Sequence
  targeting sequence with CTCN PAM
uggaaucccggcuuugccua

SEQ ID NO: 15708 - RNA, 20 nt, Artificial Sequence
  targeting sequence with CTCN PAM
gggugcccuucuggguccug

SEQ ID NO: 15709 - RNA, 20 nt, Artificial Sequence
  targeting sequence with CTCN PAM
ggaagcaccagcccggcccc

SEQ ID NO: 15710 - RNA, 20 nt, Artificial Sequence
  targeting sequence with CTCN PAM
ucaggaagcaccagcccggc

SEQ ID NO: 15711 - RNA, 20 nt, Artificial Sequence
  targeting sequence with CTCN PAM
ugccacugcucauucacggc

SEQ ID NO: 15712 - RNA, 20 nt, Artificial Sequence
  targeting sequence with CTCN PAM
uucacggcuuggcccagugc

SEQ ID NO: 15713 - RNA, 20 nt, Artificial Sequence
  targeting sequence with CTCN PAM
cguccaugagcuggggacag

SEQ ID NO: 15714 - RNA, 20 nt, Artificial Sequence
  targeting sequence with CTCN PAM
uggacgugagaugcccacug

SEQ ID NO: 15715 - RNA, 20 nt, Artificial Sequence
  targeting sequence with CTCN PAM
cuuagcugcaaugguuucuu

SEQ ID NO: 15716 - RNA, 20 nt, Artificial Sequence
  targeting sequence with CTCN PAM
uuugaaaaggaaagaaacca

SEQ ID NO: 15717 - RNA, 20 nt, Artificial Sequence
  targeting sequence with CTCN PAM
uaugacccucaaaggguagg

SEQ ID NO: 15718 - RNA, 20 nt, Artificial Sequence
  targeting sequence with CTCN PAM
aaggguaggaaccucccucc

SEQ ID NO: 15719 - RNA, 20 nt, Artificial Sequence
  targeting sequence with CTCN PAM
cuccugcccacagcugccag

SEQ ID NO: 15720 - RNA, 20 nt, Artificial Sequence
  targeting sequence with CTCN PAM
ugcccacagcugccaggucc

SEQ ID NO: 15721 - RNA, 20 nt, Artificial Sequence
  targeting sequence with CTCN PAM
gagccccagauaaggauuau

SEQ ID NO: 15722 - RNA, 20 nt, Artificial Sequence
  targeting sequence with CTCN PAM
gaggaccuggcagcuguggg

SEQ ID NO: 15723 - RNA, 20 nt, Artificial Sequence
  targeting sequence with CTCN PAM
gcgcagaagguggccaccuu

SEQ ID NO: 15724 - RNA, 20 nt, Artificial Sequence
  targeting sequence with CTCN PAM
ggaaacuagagauuuccucc

SEQ ID NO: 15725 - RNA, 20 nt, Artificial Sequence
  targeting sequence with CTCN PAM
aguuuccagagucguuucuc

SEQ ID NO: 15726 - RNA, 20 nt, Artificial Sequence
  targeting sequence with CTCN PAM
auuugcaaauacauuucuaa

SEQ ID NO: 15727 - RNA, 20 nt, Artificial Sequence
  targeting sequence with CTCN PAM
uugacguuuagaaauguauu

SEQ ID NO: 15728 - RNA, 20 nt, Artificial Sequence
  targeting sequence with CTCN PAM
ggaucagggugugcacacca

SEQ ID NO: 15729 - RNA, 20 nt, Artificial Sequence
  targeting sequence with CTCN PAM
ucggccccgccccauccaag

SEQ ID NO: 15730 - RNA, 20 nt, Artificial Sequence
  targeting sequence with CTCN PAM
gccccgccccauccaagcgc

SEQ ID NO: 15731 - RNA, 20 nt, Artificial Sequence
  targeting sequence with CTCN PAM
gagacgcucgccacaaacgg

SEQ ID NO: 15732 - RNA, 20 nt, Artificial Sequence
  targeting sequence with CTCN PAM
gagaacgccagccgcacggg

SEQ ID NO: 15733 - RNA, 20 nt, Artificial Sequence
  targeting sequence with CTCN PAM
ccacaaacgguuagggcagc

SEQ ID NO: 15734 - RNA, 20 nt, Artificial Sequence
  targeting sequence with CTCN PAM
gggaaccguguauucauucc

SEQ ID NO: 15735 - RNA, 20 nt, Artificial Sequence
  targeting sequence with CTCN PAM
cccucaaaaugcuaucaaau

SEQ ID NO: 15736 - RNA, 20 nt, Artificial Sequence
  targeting sequence with CTCN PAM
aaaugcuaucaaaugugcug

SEQ ID NO: 15737 - RNA, 20 nt, Artificial Sequence
  targeting sequence with CTCN PAM
gaauagaaaaugugaaagau

SEQ ID NO: 15738 - RNA, 20 nt, Artificial Sequence
  targeting sequence with CTCN PAM
ccacacagaagccacuguag

SEQ ID NO: 15739 - RNA, 20 nt, Artificial Sequence
  targeting sequence with CTCN PAM
acacagaagccacuguagga

SEQ ID NO: 15740 - RNA, 20 nt, Artificial Sequence
  targeting sequence with CTCN PAM
cuuuucuguucucauuaauu

SEQ ID NO: 15741 - RNA, 20 nt, Artificial Sequence
  targeting sequence with CTCN PAM
uuaauuuuagaacugguauu

SEQ ID NO: 15742 - RNA, 20 nt, Artificial Sequence
  targeting sequence with CTCN PAM
ugauaaauacauguguaacu

SEQ ID NO: 15743 - RNA, 20 nt, Artificial Sequence
  targeting sequence with CTCN PAM
acuuaauuucuugcuuuuuu

SEQ ID NO: 15744 - RNA, 20 nt, Artificial Sequence
  targeting sequence with CTCN PAM
aaagguacagcaacuccacu

SEQ ID NO: 15745 - RNA, 20 nt, Artificial Sequence
  targeting sequence with CTCN PAM
cgagaucuuucccugggguu

SEQ ID NO: 15746 - RNA, 20 nt, Artificial Sequence
  targeting sequence with CTCN PAM
agaucuuucccugggguugg

SEQ ID NO: 15747 - RNA, 20 nt, Artificial Sequence
  targeting sequence with CTCN PAM
agagccagcuccaaagguac

SEQ ID NO: 15748 - RNA, 20 nt, Artificial Sequence
  targeting sequence with CTCN PAM
aaccccagggaaagaucucg

SEQ ID NO: 15749 - RNA, 20 nt, Artificial Sequence
  targeting sequence with CTCN PAM
ccaaccccagggaaagaucu

SEQ ID NO: 15750 - RNA, 20 nt, Artificial Sequence
  targeting sequence with CTCN PAM
ucuccaaccccagggaaaga

SEQ ID NO: 15751 - RNA, 20 nt, Artificial Sequence
  targeting sequence with CTCN PAM
ccccugcccacaagaacaau

SEQ ID NO: 15752 - RNA, 20 nt, Artificial Sequence
  targeting sequence with CTCN PAM
gacaaggaagcaggcaguuu

SEQ ID NO: 15753 - RNA, 20 nt, Artificial Sequence
  targeting sequence with CTCN PAM
uuucucagacaaggaagcag

SEQ ID NO: 15754 - RNA, 20 nt, Artificial Sequence
  targeting sequence with CTCN PAM
ucaagcuuaaaaaauacgua

SEQ ID NO: 15755 - RNA, 20 nt, Artificial Sequence
  targeting sequence with CTCN PAM
ccgcccauuuuggggaccac

SEQ ID NO: 15756 - RNA, 20 nt, Artificial Sequence
  targeting sequence with CTCN PAM
acagugguccccaaaauggg

SEQ ID NO: 15757 - RNA, 20 nt, Artificial Sequence
  targeting sequence with CTCN PAM
ggcccggaaggaccauggga

SEQ ID NO: 15758 - RNA, 20 nt, Artificial Sequence
  targeting sequence with CTCN PAM
aggucacacaaccaggaagg

SEQ ID NO: 15759 - RNA, 20 nt, Artificial Sequence
  targeting sequence with CTCN PAM
gcacagcugaagcaauucuc

SEQ ID NO: 15760 - RNA, 20 nt, Artificial Sequence
  targeting sequence with CTCN PAM
aguugcugcgucugucauac

SEQ ID NO: 15761 - RNA, 20 nt, Artificial Sequence
  targeting sequence with CTCN PAM
aacaagcccgucaggaaugu

SEQ ID NO: 15762 - RNA, 20 nt, Artificial Sequence
  targeting sequence with CTCN PAM
ucucuaacaagcccgucagg

SEQ ID NO: 15763 - RNA, 20 nt, Artificial Sequence
  targeting sequence with CTCN PAM
uaaccucaucucuaacaagc

SEQ ID NO: 15764 - RNA, 20 nt, Artificial Sequence
  targeting sequence with CTCN PAM
aggaagauuucacagcugcu

SEQ ID NO: 15765 - RNA, 20 nt, Artificial Sequence
  targeting sequence with CTCN PAM
gagcuuaaggaauggcagcu

SEQ ID NO: 15766 - RNA, 20 nt, Artificial Sequence
  targeting sequence with CTCN PAM
gaggacaccccgggaccucc

SEQ ID NO: 15767 - RNA, 20 nt, Artificial Sequence
  targeting sequence with CTCN PAM
gggccgggcccacagcaugc

SEQ ID NO: 15768 - RNA, 20 nt, Artificial Sequence
  targeting sequence with CTCN PAM
uuucaucuccuggccucuga

SEQ ID NO: 15769 - RNA, 20 nt, Artificial Sequence
  targeting sequence with CTCN PAM
uggccucugacugccuucuc

SEQ ID NO: 15770 - RNA, 20 nt, Artificial Sequence
  targeting sequence with CTCN PAM
gacugccuucucagaagcua

SEQ ID NO: 15771 - RNA, 20 nt, Artificial Sequence
  targeting sequence with CTCN PAM
gaagcuagucaggugucugc

SEQ ID NO: 15772 - RNA, 20 nt, Artificial Sequence
  targeting sequence with CTCN PAM
agagugcagcugagacagga

SEQ ID NO: 15773 - RNA, 20 nt, Artificial Sequence
  targeting sequence with CTCN PAM
ugagguuugggcagacaccu

SEQ ID NO: 15774 - RNA, 20 nt, Artificial Sequence
  targeting sequence with CTCN PAM
gcugcacucuugagguuugg

SEQ ID NO: 15775 - RNA, 20 nt, Artificial Sequence
  targeting sequence with CTCN PAM
ugucucagcugcacucuuga

SEQ ID NO: 15776 - RNA, 20 nt, Artificial Sequence
  targeting sequence with CTCN PAM
cucccuccucucucucacaa

SEQ ID NO: 15777 - RNA, 20 nt, Artificial Sequence
  targeting sequence with CTCN PAM
cuccucucucucacaaacug

SEQ ID NO: 15778 - RNA, 20 nt, Artificial Sequence
  targeting sequence with CTCN PAM
ucucucucacaaacugguaa

SEQ ID NO: 15779 - RNA, 20 nt, Artificial Sequence
  targeting sequence with CTCN PAM
cucucacaaacugguaaaga

SEQ ID NO: 15780 - RNA, 20 nt, Artificial Sequence
  targeting sequence with CTCN PAM
cucacaaacugguaaagaaa

SEQ ID NO: 15781 - RNA, 20 nt, Artificial Sequence
  targeting sequence with CTCN PAM
cacaaacugguaaagaaacu

SEQ ID NO: 15782 - RNA, 20 nt, Artificial Sequence
  targeting sequence with CTCN PAM
caaacugguaaagaaacugc

SEQ ID NO: 15783 - RNA, 20 nt, Artificial Sequence
  targeting sequence with CTCN PAM
cgcuuggcuaucucaggaca

SEQ ID NO: 15784 - RNA, 20 nt, Artificial Sequence
  targeting sequence with CTCN PAM
ggacaaaggcuggagcccac

SEQ ID NO: 15785 - RNA, 20 nt, Artificial Sequence
  targeting sequence with CTCN PAM
agccuuuguccugagauagc

SEQ ID NO: 15786 - RNA, 20 nt, Artificial Sequence
  targeting sequence with CTCN PAM
ggaaucuucuuuauaauaaa

SEQ ID NO: 15787 - RNA, 20 nt, Artificial Sequence
  targeting sequence with CTCN PAM
agcccccaugggcucugagc

SEQ ID NO: 15788 - RNA, 20 nt, Artificial Sequence
  targeting sequence with CTCN PAM
gagccagucccaacacuggc

SEQ ID NO: 15789 - RNA, 20 nt, Artificial Sequence
  targeting sequence with CTCN PAM
gagcccaugggggcuggagg

SEQ ID NO: 15790 - RNA, 20 nt, Artificial Sequence
  targeting sequence with CTCN PAM
gccaguguugggacuggcuc

SEQ ID NO: 15791 - RNA, 20 nt, Artificial Sequence
  targeting sequence with CTCN PAM
cagccaacucagccaguguu

SEQ ID NO: 15792 - RNA, 20 nt, Artificial Sequence
  targeting sequence with CTCN PAM
guggccgaugggccaugcgg

SEQ ID NO: 15793 - RNA, 20 nt, Artificial Sequence
  targeting sequence with CTCN PAM
guuccugccagaaacgaccc

SEQ ID NO: 15794 - RNA, 20 nt, Artificial Sequence
  targeting sequence with CTCN PAM
ggcgccaggggcgcucugcc

SEQ ID NO: 15795 - RNA, 20 nt, Artificial Sequence
  targeting sequence with CTCN PAM
gccaggucugcccgcucucu

SEQ ID NO: 15796 - RNA, 20 nt, Artificial Sequence
  targeting sequence with CTCN PAM
cuggaacagucauuuccagu

SEQ ID NO: 15797 - RNA, 20 nt, Artificial Sequence
  targeting sequence with CTCN PAM
ggaacagucauuuccagugu

SEQ ID NO: 15798 - RNA, 20 nt, Artificial Sequence
  targeting sequence with CTCN PAM
ccaugcaacacuggaaauga

SEQ ID NO: 15799 - RNA, 20 nt, Artificial Sequence
  targeting sequence with CTCN PAM
cgggaccccuccccgggucc

SEQ ID NO: 15800 - RNA, 20 nt, Artificial Sequence
  targeting sequence with CTCN PAM
ggaccccuccccggguccuc

SEQ ID NO: 15801 - RNA, 20 nt, Artificial Sequence
  targeting sequence with CTCN PAM
ccggguccucugcgcaagcg

SEQ ID NO: 15802 - RNA, 20 nt, Artificial Sequence
  targeting sequence with CTCN PAM
gcgcaagcggcagcuauuca

SEQ ID NO: 15803 - RNA, 20 nt, Artificial Sequence
  targeting sequence with CTCN PAM
gugcaucuuaaccccucucc

SEQ ID NO: 15804 - RNA, 20 nt, Artificial Sequence
  targeting sequence with CTCN PAM
ccuuuuccuggagacggggc

SEQ ID NO: 15805 - RNA, 20 nt, Artificial Sequence
  targeting sequence with CTCN PAM
uuuuccuggagacggggcuc

SEQ ID NO: 15806 - RNA, 20 nt, Artificial Sequence
  targeting sequence with CTCN PAM
aggaaaaggagagggguuaa

SEQ ID NO: 15807 - RNA, 20 nt, Artificial Sequence
  targeting sequence with CTCN PAM
uugaacugaccuuugauugg

SEQ ID NO: 15808 - RNA, 20 nt, Artificial Sequence
  targeting sequence with CTCN PAM
cugcaccaguguggaugagg

SEQ ID NO: 15809 - RNA, 20 nt, Artificial Sequence
  targeting sequence with CTCN PAM
uccacacuggugcagggagc

SEQ ID NO: 15810 - RNA, 20 nt, Artificial Sequence
  targeting sequence with CTCN PAM
accucauccacacuggugca

SEQ ID NO: 15811 - RNA, 20 nt, Artificial Sequence
  targeting sequence with CTCN PAM
gggcuggcggccuccucucc

SEQ ID NO: 15812 - RNA, 20 nt, Artificial Sequence
  targeting sequence with CTCN PAM
ucucccccaguuugugcuug

SEQ ID NO: 15813 - RNA, 20 nt, Artificial Sequence
  targeting sequence with CTCN PAM
cccccaguuugugcuuggcc

SEQ ID NO: 15814 - RNA, 20 nt, Artificial Sequence
  targeting sequence with CTCN PAM
cccaguuugugcuuggccgc

SEQ ID NO: 15815 - RNA, 20 nt, Artificial Sequence
  targeting sequence with CTCN PAM
cagcagcagccugaccaacu

SEQ ID NO: 15816 - RNA, 20 nt, Artificial Sequence
  targeting sequence with CTCN PAM
ccaugugucucaggccucac

SEQ ID NO: 15817 - RNA, 20 nt, Artificial Sequence
  targeting sequence with CTCN PAM
augugucucaggccucacug

SEQ ID NO: 15818 - RNA, 20 nt, Artificial Sequence
  targeting sequence with CTCN PAM
ggccucacuguagcacucgu

SEQ ID NO: 15819 - RNA, 20 nt, Artificial Sequence
  targeting sequence with CTCN PAM
cuguagcacucguagauguu

SEQ ID NO: 15820 - RNA, 20 nt, Artificial Sequence
  targeting sequence with CTCN PAM
uagauguuguccuccaucaa

SEQ ID NO: 15821 - RNA, 20 nt, Artificial Sequence
  targeting sequence with CTCN PAM
aucaaagccaccaccugcuc

SEQ ID NO: 15822 - RNA, 20 nt, Artificial Sequence
  targeting sequence with CTCN PAM
aacuugugcugcaguugugu

SEQ ID NO: 15823 - RNA, 20 nt, Artificial Sequence
  targeting sequence with CTCN PAM
gggccgugggguuggccucc

SEQ ID NO: 15824 - RNA, 20 nt, Artificial Sequence
  targeting sequence with CTCN PAM
agcgcggccaugaucugagg

SEQ ID NO: 15825 - RNA, 20 nt, Artificial Sequence
  targeting sequence with CTCN PAM
gaucauggccgcgcuggagg

SEQ ID NO: 15826 - RNA, 20 nt, Artificial Sequence
  targeting sequence with CTCN PAM
ccucagaucauggccgcgcu

SEQ ID NO: 15827 - RNA, 20 nt, Artificial Sequence
  targeting sequence with CTCN PAM
gcugcuccccucagaucaug

SEQ ID NO: 15828 - RNA, 20 nt, Artificial Sequence
  targeting sequence with CTCN PAM
guucgugggagagaacacac

SEQ ID NO: 15829 - RNA, 20 nt, Artificial Sequence
  targeting sequence with CTCN PAM
cacgaacugaggcagggcua

SEQ ID NO: 15830 - RNA, 20 nt, Artificial Sequence
  targeting sequence with CTCN PAM
cccacgaacugaggcagggc

SEQ ID NO: 15831 - RNA, 20 nt, Artificial Sequence
  targeting sequence with CTCN PAM
ugguagacguucaggggugu

SEQ ID NO: 15832 - RNA, 20 nt, Artificial Sequence
  targeting sequence with CTCN PAM
gggugcuugccccuaaugga

SEQ ID NO: 15833 - RNA, 20 nt, Artificial Sequence
  targeting sequence with CTCN PAM
aggacacacaucucagggug

SEQ ID NO: 15834 - RNA, 20 nt, Artificial Sequence
  targeting sequence with CTCN PAM
ccuaccccgagggcaggugc

SEQ ID NO: 15835 - RNA, 20 nt, Artificial Sequence
  targeting sequence with CTCN PAM
ggguaggugagcuuccuacu

SEQ ID NO: 15836 - RNA, 20 nt, Artificial Sequence
  targeting sequence with CTCN PAM
cccuggggcacucaccugcg

SEQ ID NO: 15837 - RNA, 20 nt, Artificial Sequence
  targeting sequence with CTCN PAM
ccugcggccgauaccucuug

SEQ ID NO: 15838 - RNA, 20 nt, Artificial Sequence
  targeting sequence with CTCN PAM
uggcguacuuauaaaucucu

SEQ ID NO: 15839 - RNA, 20 nt, Artificial Sequence
  targeting sequence with CTCN PAM
gccauggccacauugguguu

SEQ ID NO: 15840 - RNA, 20 nt, Artificial Sequence
  targeting sequence with CTCN PAM
uucugguauuucuauaagga

SEQ ID NO: 15841 - RNA, 20 nt, Artificial Sequence
  targeting sequence with CTCN PAM
uuauagaaauaccagaauga

SEQ ID NO: 15842 - RNA, 20 nt, Artificial Sequence
  targeting sequence with CTCN PAM
ccauccugccuccuuauaga

SEQ ID NO: 15843 - RNA, 20 nt, Artificial Sequence
  targeting sequence with CTCN PAM
uccccauccugccuccuuau

SEQ ID NO: 15844 - RNA, 20 nt, Artificial Sequence
  targeting sequence with CTCN PAM
gcuuugaccgcugggcuaac

SEQ ID NO: 15845 - RNA, 20 nt, Artificial Sequence
  targeting sequence with CTCN PAM
ccacggcccccacagaacag

SEQ ID NO: 15846 - RNA, 20 nt, Artificial Sequence
  targeting sequence with CTCN PAM
ucgcugaacuguucuguggg

SEQ ID NO: 15847 - RNA, 20 nt, Artificial Sequence
  targeting sequence with CTCN PAM
agucccauggacgaagacgg

SEQ ID NO: 15848 - RNA, 20 nt, Artificial Sequence
  targeting sequence with CTCN PAM
ucuccauccagagggugcuc

SEQ ID NO: 15849 - RNA, 20 nt, Artificial Sequence
  targeting sequence with CTCN PAM
ccauccagagggugcucucc

SEQ ID NO: 15850 - RNA, 20 nt, Artificial Sequence
  targeting sequence with CTCN PAM
auccagagggugcucuccug

SEQ ID NO: 15851 - RNA, 20 nt, Artificial Sequence
  targeting sequence with CTCN PAM
ggauggagaggagauuggac

SEQ ID NO: 15852 - RNA, 20 nt, Artificial Sequence
  targeting sequence with CTCN PAM
ccugcccccgcuccucaaac

SEQ ID NO: 15853 - RNA, 20 nt, Artificial Sequence
  targeting sequence with CTCN PAM
ugcccccgcuccucaaacuc

SEQ ID NO: 15854 - RNA, 20 nt, Artificial Sequence
  targeting sequence with CTCN PAM
ucaaacucugggaaaaugca

SEQ ID NO: 15855 - RNA, 20 nt, Artificial Sequence
  targeting sequence with CTCN PAM
aacucugggaaaaugcauga

SEQ ID NO: 15856 - RNA, 20 nt, Artificial Sequence
  targeting sequence with CTCN PAM
gggaaaaugcaugacgaauu

SEQ ID NO: 15857 - RNA, 20 nt, Artificial Sequence
  targeting sequence with CTCN PAM
ugcuggccugcaaauucguc

SEQ ID NO: 15858 - RNA, 20 nt, Artificial Sequence
  targeting sequence with CTCN PAM
gcgcucccugcccuuacucc

SEQ ID NO: 15859 - RNA, 20 nt, Artificial Sequence
  targeting sequence with CTCN PAM
cugcccuuacuccaguggag

SEQ ID NO: 15860 - RNA, 20 nt, Artificial Sequence
  targeting sequence with CTCN PAM
aguggaggcauugaggccca

SEQ ID NO: 15861 - RNA, 20 nt, Artificial Sequence
  targeting sequence with CTCN PAM
acuggaguaagggcagggag

SEQ ID NO: 15862 - RNA, 20 nt, Artificial Sequence
  targeting sequence with CTCN PAM
augccuccacuggaguaagg

SEQ ID NO: 15863 - RNA, 20 nt, Artificial Sequence
  targeting sequence with CTCN PAM
gcucuucaggcccccauccc

SEQ ID NO: 15864 - RNA, 20 nt, Artificial Sequence
  targeting sequence with CTCN PAM
ucaggcccccaucccccgcc

SEQ ID NO: 15865 - RNA, 20 nt, Artificial Sequence
  targeting sequence with CTCN PAM
gcggcgggggaugggggccu

SEQ ID NO: 15866 - RNA, 20 nt, Artificial Sequence
  targeting sequence with CTCN PAM
acuccucggccagaugggca

SEQ ID NO: 15867 - RNA, 20 nt, Artificial Sequence
  targeting sequence with CTCN PAM
ucggccagaugggcauucau

SEQ ID NO: 15868 - RNA, 20 nt, Artificial Sequence
  targeting sequence with CTCN PAM
gccagaugggcauucaucuc

SEQ ID NO: 15869 - RNA, 20 nt, Artificial Sequence
  targeting sequence with CTCN PAM
ugcucgcugagcggcgucau

SEQ ID NO: 15870 - RNA, 20 nt, Artificial Sequence
  targeting sequence with CTCN PAM
cugagcggcgucauguccug

SEQ ID NO: 15871 - RNA, 20 nt, Artificial Sequence
  targeting sequence with CTCN PAM
gcgagcaagagaugaaugcc

SEQ ID NO: 15872 - RNA, 20 nt, Artificial Sequence
  targeting sequence with CTCN PAM
ggaaucuccuuggcguagag

SEQ ID NO: 15873 - RNA, 20 nt, Artificial Sequence
  targeting sequence with CTCN PAM
uuggcguagaggagcuuguu

SEQ ID NO: 15874 - RNA, 20 nt, Artificial Sequence
  targeting sequence with CTCN PAM
acgccaaggagauuccugag

SEQ ID NO: 15875 - RNA, 20 nt, Artificial Sequence
  targeting sequence with CTCN PAM
ucuacgccaaggagauuccu

SEQ ID NO: 15876 - RNA, 20 nt, Artificial Sequence
  targeting sequence with CTCN PAM
gcccaggauucgccaaccaa

SEQ ID NO: 15877 - RNA, 20 nt, Artificial Sequence
  targeting sequence with CTCN PAM
ucucugcccaggauucgcca

SEQ ID NO: 15878 - RNA, 20 nt, Artificial Sequence
  targeting sequence with CTCN PAM
cucuucucugcccaggauuc

SEQ ID NO: 15879 - RNA, 20 nt, Artificial Sequence
  targeting sequence with CTCN PAM
agcagccaucuaacacccuc

SEQ ID NO: 15880 - RNA, 20 nt, Artificial Sequence
  targeting sequence with CTCN PAM
uccagaaaacgaccagaucc

SEQ ID NO: 15881 - RNA, 20 nt, Artificial Sequence
  targeting sequence with CTCN PAM
ucccuccugccacauaagug

SEQ ID NO: 15882 - RNA, 20 nt, Artificial Sequence
  targeting sequence with CTCN PAM
ugccacauaagugaccuuag

SEQ ID NO: 15883 - RNA, 20 nt, Artificial Sequence
  targeting sequence with CTCN PAM
ggggccugcuaaggucacuu

SEQ ID NO: 15884 - RNA, 20 nt, Artificial Sequence
  targeting sequence with CTCN PAM
uugggccucgggggccugcu

SEQ ID NO: 15885 - RNA, 20 nt, Artificial Sequence
  targeting sequence with CTCN PAM
cccggucacugaacgucccc

SEQ ID NO: 15886 - RNA, 20 nt, Artificial Sequence
  targeting sequence with CTCN PAM
gccggccccagaccaggggc

SEQ ID NO: 15887 - RNA, 20 nt, Artificial Sequence
  targeting sequence with CTCN PAM
ucacugugcucugucugccc

SEQ ID NO: 15888 - RNA, 20 nt, Artificial Sequence
  targeting sequence with CTCN PAM
cugugcucugucugccccgc

SEQ ID NO: 15889 - RNA, 20 nt, Artificial Sequence
  targeting sequence with CTCN PAM
gucugccccgccuacuuucc

SEQ ID NO: 15890 - RNA, 20 nt, Artificial Sequence
  targeting sequence with CTCN PAM
ccacccacaucauuguccua

SEQ ID NO: 15891 - RNA, 20 nt, Artificial Sequence
  targeting sequence with CTCN PAM
ucacugcacgcagcccauuc

SEQ ID NO: 15892 - RNA, 20 nt, Artificial Sequence
  targeting sequence with CTCN PAM
gggugauaggucuugguggc

SEQ ID NO: 15893 - RNA, 20 nt, Artificial Sequence
  targeting sequence with CTCN PAM
ggcuuccaggaauccuagcc

SEQ ID NO: 15894 - RNA, 20 nt, Artificial Sequence
  targeting sequence with CTCN PAM
guggaauauuucccaccaca

SEQ ID NO: 15895 - RNA, 20 nt, Artificial Sequence
  targeting sequence with CTCN PAM
uaacgccugaaagaagugcc

SEQ ID NO: 15896 - RNA, 20 nt, Artificial Sequence
  targeting sequence with CTCN PAM
caguucuuugucagucacgg

SEQ ID NO: 15897 - RNA, 20 nt, Artificial Sequence
  targeting sequence with CTCN PAM
gaaggcagggugcccgugac

SEQ ID NO: 15898 - RNA, 20 nt, Artificial Sequence
  targeting sequence with CTCN PAM
cguacugccuccgaaggcag

SEQ ID NO: 15899 - RNA, 20 nt, Artificial Sequence
  targeting sequence with CTCN PAM
acuacuacucacguacugcc

SEQ ID NO: 15900 - RNA, 20 nt, Artificial Sequence
  targeting sequence with CTCN PAM
uucccgugguccgucucuga

SEQ ID NO: 15901 - RNA, 20 nt, Artificial Sequence
  targeting sequence with CTCN PAM
gaaaugcgugggcuaaaugc

SEQ ID NO: 15902 - RNA, 20 nt, Artificial Sequence
  targeting sequence with CTCN PAM
ucccugcucacagcaaccgg

SEQ ID NO: 15903 - RNA, 20 nt, Artificial Sequence
  targeting sequence with CTCN PAM
cagcaaccggcugcuuuccu

SEQ ID NO: 15904 - RNA, 20 nt, Artificial Sequence
  targeting sequence with CTCN PAM
cugucuuugccugcgccguu

SEQ ID NO: 15905 - RNA, 20 nt, Artificial Sequence
  targeting sequence with CTCN PAM
cugccuggaaggccauccuc

SEQ ID NO: 15906 - RNA, 20 nt, Artificial Sequence
  targeting sequence with CTCN PAM
gccuggaaggccauccucuu

SEQ ID NO: 15907 - RNA, 20 nt, Artificial Sequence
  targeting sequence with CTCN PAM
uucaucuucaaccucuaaag

SEQ ID NO: 15908 - RNA, 20 nt, Artificial Sequence
  targeting sequence with CTCN PAM
aaagccagacacagccuugu

SEQ ID NO: 15909 - RNA, 20 nt, Artificial Sequence
  targeting sequence with CTCN PAM
gagcuccuagccacccauca

SEQ ID NO: 15910 - RNA, 20 nt, Artificial Sequence
  targeting sequence with CTCN PAM
gagauucaugcgguguguug

SEQ ID NO: 15911 - RNA, 20 nt, Artificial Sequence
  targeting sequence with CTCN PAM
uagccacccaucaccccucu

SEQ ID NO: 15912 - RNA, 20 nt, Artificial Sequence
  targeting sequence with CTCN PAM
gcccaccccuucacugaaug

SEQ ID NO: 15913 - RNA, 20 nt, Artificial Sequence
  targeting sequence with CTCN PAM
cuugaauggcuuuugacuuu

SEQ ID NO: 15914 - RNA, 20 nt, Artificial Sequence
  targeting sequence with CTCN PAM
gggcaguagccccugaaagu

SEQ ID NO: 15915 - RNA, 20 nt, Artificial Sequence
  targeting sequence with CTCN PAM
uacuggcuuucccacaccgg

SEQ ID NO: 15916 - RNA, 20 nt, Artificial Sequence
  targeting sequence with CTCN PAM
ggccuguguucaaagccagu

SEQ ID NO: 15917 - RNA, 20 nt, Artificial Sequence
  targeting sequence with CTCN PAM
guaucgcugcagaccaacug

SEQ ID NO: 15918 - RNA, 20 nt, Artificial Sequence
  targeting sequence with CTCN PAM
cugucugaaugagucacuca

SEQ ID NO: 15919 - RNA, 20 nt, Artificial Sequence
  targeting sequence with CTCN PAM
uucagacagggagacaccua

SEQ ID NO: 15920 - RNA, 20 nt, Artificial Sequence
  targeting sequence with CTCN PAM
ucccacauccccuagaccug

SEQ ID NO: 15921 - RNA, 20 nt, Artificial Sequence
  targeting sequence with CTCN PAM
ggucuaggggaugugggaug

SEQ ID NO: 15922 - RNA, 20 nt, Artificial Sequence
  targeting sequence with CTCN PAM
caggaagaucucugagcuca

SEQ ID NO: 15923 - RNA, 20 nt, Artificial Sequence
  targeting sequence with CTCN PAM
gagcucagccucagagaguc

SEQ ID NO: 15924 - RNA, 20 nt, Artificial Sequence
  targeting sequence with CTCN PAM
gagaucuuccugggagggga

SEQ ID NO: 15925 - RNA, 20 nt, Artificial Sequence
  targeting sequence with CTCN PAM
gccucagagagucgaggagg

SEQ ID NO: 15926 - RNA, 20 nt, Artificial Sequence
  targeting sequence with CTCN PAM
gagagucgaggaggcuaccc

SEQ ID NO: 15927 - RNA, 20 nt, Artificial Sequence
  targeting sequence with CTCN PAM
gaggcugagcucagagaucu

SEQ ID NO: 15928 - RNA, 20 nt, Artificial Sequence
  targeting sequence with CTCN PAM
cugaggcugagcucagagau

SEQ ID NO: 15929 - RNA, 20 nt, Artificial Sequence
  targeting sequence with CTCN PAM
acucucugaggcugagcuca

SEQ ID NO: 15930 - RNA, 20 nt, Artificial Sequence
  targeting sequence with CTCN PAM
ucgacucucugaggcugagc

SEQ ID NO: 15931 - RNA, 20 nt, Artificial Sequence
  targeting sequence with CTCN PAM
ggcccugugcaugggccugg

SEQ ID NO: 15932 - RNA, 20 nt, Artificial Sequence
  targeting sequence with CTCN PAM
gaccugcagcugggcaaggu

SEQ ID NO: 15933 - RNA, 20 nt, Artificial Sequence
  targeting sequence with CTCN PAM
aucucugaccugcagcuggg

SEQ ID NO: 15934 - RNA, 20 nt, Artificial Sequence
  targeting sequence with CTCN PAM
gguucugggugaacauccug

SEQ ID NO: 15935 - RNA, 20 nt, Artificial Sequence
  targeting sequence with CTCN PAM
ccgguucugggugaacaucc

SEQ ID NO: 15936 - RNA, 20 nt, Artificial Sequence
  targeting sequence with CTCN PAM
cugucuuugucacccuaccc

SEQ ID NO: 15937 - RNA, 20 nt, Artificial Sequence
  targeting sequence with CTCN PAM
acugcuuccuaccccacccu

SEQ ID NO: 15938 - RNA, 20 nt, Artificial Sequence
  targeting sequence with CTCN PAM
acaacugucccucgacugcu

SEQ ID NO: 15939 - RNA, 20 nt, Artificial Sequence
  targeting sequence with CTCN PAM
uccacaacugucccucgacu

SEQ ID NO: 15940 - RNA, 20 nt, Artificial Sequence
  targeting sequence with CTCN PAM
ccuccacaacugucccucga

SEQ ID NO: 15941 - RNA, 20 nt, Artificial Sequence
  targeting sequence with CTCN PAM
cuccuccacaacugucccuc

SEQ ID NO: 15942 - RNA, 20 nt, Artificial Sequence
  targeting sequence with CTCN PAM
agggccugagguuggagccu

SEQ ID NO: 15943 - RNA, 20 nt, Artificial Sequence
  targeting sequence with CTCN PAM
ggcccuugagggacaaagcc

SEQ ID NO: 15944 - RNA, 20 nt, Artificial Sequence
  targeting sequence with CTCN PAM
aaccucaggcccuugaggga

SEQ ID NO: 15945 - RNA, 20 nt, Artificial Sequence
  targeting sequence with CTCN PAM
gccccacugcaccccagcug

SEQ ID NO: 15946 - RNA, 20 nt, Artificial Sequence
  targeting sequence with CTCN PAM
cagccccacugcaccccagc

SEQ ID NO: 15947 - RNA, 20 nt, Artificial Sequence
  targeting sequence with CTCN PAM
agcaggaaaccgggcucuca

SEQ ID NO: 15948 - RNA, 20 nt, Artificial Sequence
  targeting sequence with CTCN PAM
ugccuugcuccagcaggaaa

SEQ ID NO: 15949 - RNA, 20 nt, Artificial Sequence
  targeting sequence with CTCN PAM
ugagccuccagucagguccu

SEQ ID NO: 15950 - RNA, 20 nt, Artificial Sequence
  targeting sequence with CTCN PAM
ggaggggguugggggguaca

SEQ ID NO: 15951 - RNA, 20 nt, Artificial Sequence
  targeting sequence with CTCN PAM
agucagguccugguucucau

SEQ ID NO: 15952 - RNA, 20 nt, Artificial Sequence
  targeting sequence with CTCN PAM
uuagaaccaggugccggccc

SEQ ID NO: 15953 - RNA, 20 nt, Artificial Sequence
  targeting sequence with CTCN PAM
ucccugaacccuugcaggca

SEQ ID NO: 15954 - RNA, 20 nt, Artificial Sequence
  targeting sequence with CTCN PAM
cugaacccuugcaggcagca

SEQ ID NO: 15955 - RNA, 20 nt, Artificial Sequence
  targeting sequence with CTCN PAM
gcuaaugucggacuuccugc

SEQ ID NO: 15956 - RNA, 20 nt, Artificial Sequence
  targeting sequence with CTCN PAM
aggcccugccccccacagcc

SEQ ID NO: 15957 - RNA, 20 nt, Artificial Sequence
  targeting sequence with CTCN PAM
ggccuuguccucaagaggcc

SEQ ID NO: 15958 - RNA, 20 nt, Artificial Sequence
  targeting sequence with CTCN PAM
agaggccagagagggugagc

SEQ ID NO: 15959 - RNA, 20 nt, Artificial Sequence
  targeting sequence with CTCN PAM
ugaggacaaggccagagcuc

SEQ ID NO: 15960 - RNA, 20 nt, Artificial Sequence
  targeting sequence with CTCN PAM
ggccucuugaggacaaggcc

SEQ ID NO: 15961 - RNA, 20 nt, Artificial Sequence
  targeting sequence with CTCN PAM
cuggccucuugaggacaagg

SEQ ID NO: 15962 - RNA, 20 nt, Artificial Sequence
  targeting sequence with CTCN PAM
cccucucuggccucuugagg

SEQ ID NO: 15963 - RNA, 20 nt, Artificial Sequence
  targeting sequence with CTCN PAM
ggccacccagugacucagca

SEQ ID NO: 15964 - RNA, 20 nt, Artificial Sequence
  targeting sequence with CTCN PAM
gcagccugggcauguguacc

SEQ ID NO: 15965 - RNA, 20 nt, Artificial Sequence
  targeting sequence with CTCN PAM
ggggguacacaugcccaggc

SEQ ID NO: 15966 - RNA, 20 nt, Artificial Sequence
  targeting sequence with CTCN PAM
aggaagcugcugcccugcac

SEQ ID NO: 15967 - RNA, 20 nt, Artificial Sequence
  targeting sequence with CTCN PAM
gugcagggcagcagcuuccu

SEQ ID NO: 15968 - RNA, 20 nt, Artificial Sequence
  targeting sequence with CTCN PAM
ggaagaauaccaccagccca

SEQ ID NO: 15969 - RNA, 20 nt, Artificial Sequence
  targeting sequence with CTCN PAM
uagcuugucggggucaugca

SEQ ID NO: 15970 - RNA, 20 nt, Artificial Sequence
  targeting sequence with CTCN PAM
aaggagggcuaccaacuggg

SEQ ID NO: 15971 - RNA, 20 nt, Artificial Sequence
  targeting sequence with CTCN PAM
uuugaggcaccucuuagcuu

SEQ ID NO: 15972 - RNA, 20 nt, Artificial Sequence
  targeting sequence with CTCN PAM
uacccaguugguagcccucc

SEQ ID NO: 15973 - RNA, 20 nt, Artificial Sequence
  targeting sequence with CTCN PAM
gcccuacauuaucugaaucu

SEQ ID NO: 15974 - RNA, 20 nt, Artificial Sequence
  targeting sequence with CTCN PAM
acugucccaggcuguguggu

SEQ ID NO: 15975 - RNA, 20 nt, Artificial Sequence
  targeting sequence with CTCN PAM
agaccacacagccugggaca

SEQ ID NO: 15976 - RNA, 20 nt, Artificial Sequence
  targeting sequence with CTCN PAM
gagccucagugugcuuaucu

SEQ ID NO: 15977 - RNA, 20 nt, Artificial Sequence
  targeting sequence with CTCN PAM
gagaagcagcaccugcucaa

SEQ ID NO: 15978 - RNA, 20 nt, Artificial Sequence
  targeting sequence with CTCN PAM
gugugcuuaucugugaagug

SEQ ID NO: 15979 - RNA, 20 nt, Artificial Sequence
  targeting sequence with CTCN PAM
acuucacagauaagcacacu

SEQ ID NO: 15980 - RNA, 20 nt, Artificial Sequence
  targeting sequence with CTCN PAM
ggugggcaccaucagcucca

SEQ ID NO: 15981 - RNA, 20 nt, Artificial Sequence
  targeting sequence with CTCN PAM
caggugggcaccaucagcuc

SEQ ID NO: 15982 - RNA, 20 nt, Artificial Sequence
  targeting sequence with CTCN PAM
cgcaccccucucaggugggc

SEQ ID NO: 15983 - RNA, 20 nt, Artificial Sequence
  targeting sequence with CTCN PAM
ucuaguuaauucccaccauu

SEQ ID NO: 15984 - RNA, 20 nt, Artificial Sequence
  targeting sequence with CTCN PAM
acuguaaaaugcgacccaug

SEQ ID NO: 15985 - RNA, 20 nt, Artificial Sequence
  targeting sequence with CTCN PAM
gugcuucaguuuccccucca

SEQ ID NO: 15986 - RNA, 20 nt, Artificial Sequence
  targeting sequence with CTCN PAM
cugugcuucaguuuccccuc

SEQ ID NO: 15987 - RNA, 20 nt, Artificial Sequence
  targeting sequence with CTCN PAM
uccgagaacacacagcuggg

SEQ ID NO: 15988 - RNA, 20 nt, Artificial Sequence
  targeting sequence with CTCN PAM
gaugagugacuuagccucuc

SEQ ID NO: 15989 - RNA, 20 nt, Artificial Sequence
  targeting sequence with CTCN PAM
gccauuucccagcugugugu

SEQ ID NO: 15990 - RNA, 20 nt, Artificial Sequence
  targeting sequence with CTCN PAM
ucugccauuucccagcugug

SEQ ID NO: 15991 - RNA, 20 nt, Artificial Sequence
  targeting sequence with CTCN PAM
ccugcuuggggucaagcccu

SEQ ID NO: 15992 - RNA, 20 nt, Artificial Sequence
  targeting sequence with CTCN PAM
gaacccccugccacaggggc

SEQ ID NO: 15993 - RNA, 20 nt, Artificial Sequence
  targeting sequence with CTCN PAM
gaccccgacacccuacacau

SEQ ID NO: 15994 - RNA, 20 nt, Artificial Sequence
  targeting sequence with CTCN PAM
ucucagccugcuccuccagg

SEQ ID NO: 15995 - RNA, 20 nt, Artificial Sequence
  targeting sequence with CTCN PAM
gccugcuccuccaggaaguc

SEQ ID NO: 15996 - RNA, 20 nt, Artificial Sequence
  targeting sequence with CTCN PAM
uccaggaagucgaaaaagua

SEQ ID NO: 15997 - RNA, 20 nt, Artificial Sequence
  targeting sequence with CTCN PAM
aggaagucgaaaaaguacuu

SEQ ID NO: 15998 - RNA, 20 nt, Artificial Sequence
  targeting sequence with CTCN PAM
gaauggccuugaacagguca

SEQ ID NO: 15999 - RNA, 20 nt, Artificial Sequence
  targeting sequence with CTCN PAM
cccgcagggcacguugcaga

SEQ ID NO: 16000 - RNA, 20 nt, Artificial Sequence
  targeting sequence with CTCN PAM
gcacguggcccggggcugac

SEQ ID NO: 16001 - RNA, 20 nt, Artificial Sequence
  targeting sequence with CTCN PAM
gcggagcuugaaaugccagg

SEQ ID NO: 16002 - RNA, 20 nt, Artificial Sequence
  targeting sequence with CTCN PAM
gcagagccaccaagggugcc

SEQ ID NO: 16003 - RNA, 20 nt, Artificial Sequence
  targeting sequence with CTCN PAM
uucagcagccuggcauuuca

SEQ ID NO: 16004 - RNA, 20 nt, Artificial Sequence
  targeting sequence with CTCN PAM
gugaccagccugaugccaug

SEQ ID NO: 16005 - RNA, 20 nt, Artificial Sequence
  targeting sequence with CTCN PAM
cuggcucacuugccucccag

SEQ ID NO: 16006 - RNA, 20 nt, Artificial Sequence
  targeting sequence with CTCN PAM
ggcucacuugccucccagag

SEQ ID NO: 16007 - RNA, 20 nt, Artificial Sequence
  targeting sequence with CTCN PAM
cuugccucccagaggcguug

SEQ ID NO: 16008 - RNA, 20 nt, Artificial Sequence
  targeting sequence with CTCN PAM
cagaggcguugaaaggacua

SEQ ID NO: 16009 - RNA, 20 nt, Artificial Sequence
  targeting sequence with CTCN PAM
gggaggcaagugagccagag

SEQ ID NO: 16010 - RNA, 20 nt, Artificial Sequence
  targeting sequence with CTCN PAM
auuaguccuuucaacgccuc

SEQ ID NO: 16011 - RNA, 20 nt, Artificial Sequence
  targeting sequence with CTCN PAM
augugccagugccucgauua

SEQ ID NO: 16012 - RNA, 20 nt, Artificial Sequence
  targeting sequence with CTCN PAM
acuccaugugccagugccuc

SEQ ID NO: 16013 - RNA, 20 nt, Artificial Sequence
  targeting sequence with CTCN PAM
ggcacuuccaguucucgacu

SEQ ID NO: 16014 - RNA, 20 nt, Artificial Sequence
  targeting sequence with CTCN PAM
guggcagcgccggcacccca

SEQ ID NO: 16015 - RNA, 20 nt, Artificial Sequence
  targeting sequence with CTCN PAM
gggccucugcuguacccugu

SEQ ID NO: 16016 - RNA, 20 nt, Artificial Sequence
  targeting sequence with CTCN PAM
gcuguacccuguuacguggg

SEQ ID NO: 16017 - RNA, 20 nt, Artificial Sequence
  targeting sequence with CTCN PAM
gucaggcauuuuuccuggcu

SEQ ID NO: 16018 - RNA, 20 nt, Artificial Sequence
  targeting sequence with CTCN PAM
cagccaggaaaaaugccuga

SEQ ID NO: 16019 - RNA, 20 nt, Artificial Sequence
  targeting sequence with CTCN PAM
ucaagugggacccuaagccu

SEQ ID NO: 16020 - RNA, 20 nt, Artificial Sequence
  targeting sequence with CTCN PAM
agugggacccuaagccuuca

SEQ ID NO: 16021 - RNA, 20 nt, Artificial Sequence
  targeting sequence with CTCN PAM
ugccccuccagccccacagg

SEQ ID NO: 16022 - RNA, 20 nt, Artificial Sequence
  targeting sequence with CTCN PAM
agccccacaggggaaacagg

SEQ ID NO: 16023 - RNA, 20 nt, Artificial Sequence
  targeting sequence with CTCN PAM
caccccucucccagccgcgg

SEQ ID NO: 16024 - RNA, 20 nt, Artificial Sequence
  targeting sequence with CTCN PAM
cccagccgcgggugcacagc

SEQ ID NO: 16025 - RNA, 20 nt, Artificial Sequence
  targeting sequence with CTCN PAM
cagccgcgggugcacagcug

SEQ ID NO: 16026 - RNA, 20 nt, Artificial Sequence
  targeting sequence with CTCN PAM
gggccagcugugcacccgcg

SEQ ID NO: 16027 - RNA, 20 nt, Artificial Sequence
  targeting sequence with CTCN PAM
ggagcuggggcuggagccuu

SEQ ID NO: 16028 - RNA, 20 nt, Artificial Sequence
  targeting sequence with CTCN PAM
agagggucauugcucagggc

SEQ ID NO: 16029 - RNA, 20 nt, Artificial Sequence
  targeting sequence with CTCN PAM
agccccagcuccagaggguc

SEQ ID NO: 16030 - RNA, 20 nt, Artificial Sequence
  targeting sequence with CTCN PAM
gugcaguggguacaaggcuc

SEQ ID NO: 16031 - RNA, 20 nt, Artificial Sequence
  targeting sequence with CTCN PAM
ccucugugcaguggguacaa

SEQ ID NO: 16032 - RNA, 20 nt, Artificial Sequence
  targeting sequence with CTCN PAM
gucuccccucugugcagugg

SEQ ID NO: 16033 - RNA, 20 nt, Artificial Sequence
  targeting sequence with CTCN PAM
ccuugguggagagcaggcgg

SEQ ID NO: 16034 - RNA, 20 nt, Artificial Sequence
  targeting sequence with CTCN PAM
accaaggugaguccggccuc

SEQ ID NO: 16035 - RNA, 20 nt, Artificial Sequence
  targeting sequence with CTCN PAM
ccaccaaggugaguccggcc

SEQ ID NO: 16036 - RNA, 20 nt, Artificial Sequence
  targeting sequence with CTCN PAM
cggaaaucuaccugacccgc

SEQ ID NO: 16037 - RNA, 20 nt, Artificial Sequence
  targeting sequence with CTCN PAM
gccggugagacuucuugggc

SEQ ID NO: 16038 - RNA, 20 nt, Artificial Sequence
  targeting sequence with CTCN PAM
ccggcagagccaucgcaaga

SEQ ID NO: 16039 - RNA, 20 nt, Artificial Sequence
  targeting sequence with CTCN PAM
gccagcucguccguaggcag

SEQ ID NO: 16040 - RNA, 20 nt, Artificial Sequence
  targeting sequence with CTCN PAM
uccguaggcagcaccuggga

SEQ ID NO: 16041 - RNA, 20 nt, Artificial Sequence
  targeting sequence with CTCN PAM
caggugcugccuacggacga

SEQ ID NO: 16042 - RNA, 20 nt, Artificial Sequence
  targeting sequence with CTCN PAM
gccgccugugggaggucugg

SEQ ID NO: 16043 - RNA, 20 nt, Artificial Sequence
  targeting sequence with CTCN PAM
cacaggcggccgaggauggg

SEQ ID NO: 16044 - RNA, 20 nt, Artificial Sequence
  targeting sequence with CTCN PAM
gccaugcuucuuagcacaca

SEQ ID NO: 16045 - RNA, 20 nt, Artificial Sequence
  targeting sequence with CTCN PAM
ugauucugggccccaucccu

SEQ ID NO: 16046 - RNA, 20 nt, Artificial Sequence
  targeting sequence with CTCN PAM
cccaccccccagccuuucgc

SEQ ID NO: 16047 - RNA, 20 nt, Artificial Sequence
  targeting sequence with CTCN PAM
cagcccugcgaaaggcuggg

SEQ ID NO: 16048 - RNA, 20 nt, Artificial Sequence
  targeting sequence with CTCN PAM
ugggaaaagugcucccagcc

SEQ ID NO: 16049 - RNA, 20 nt, Artificial Sequence
  targeting sequence with CTCN PAM
guggguguggccuuggcuuu

SEQ ID NO: 16050 - RNA, 20 nt, Artificial Sequence
  targeting sequence with CTCN PAM
gccccgggggauccagcccc

SEQ ID NO: 16051 - RNA, 20 nt, Artificial Sequence
  targeting sequence with CTCN PAM
ccaaauggaaauacuucucu

SEQ ID NO: 16052 - RNA, 20 nt, Artificial Sequence
  targeting sequence with CTCN PAM
guguccaagucuuucacugu

SEQ ID NO: 16053 - RNA, 20 nt, Artificial Sequence
  targeting sequence with CTCN PAM
cagugaaagacuuggacaca

SEQ ID NO: 16054 - RNA, 20 nt, Artificial Sequence
  targeting sequence with CTCN PAM
cacagugaaagacuuggaca

SEQ ID NO: 16055 - RNA, 20 nt, Artificial Sequence
  targeting sequence with CTCN PAM
cguguuuauuuauuguguuu

SEQ ID NO: 16056 - RNA, 20 nt, Artificial Sequence
  targeting sequence with CTCN PAM
cccguguuuauuuauugugu

SEQ ID NO: 16057 - RNA, 20 nt, Artificial Sequence
  targeting sequence with CTCN PAM
ucucccguguuuauuuauug

SEQ ID NO: 16058 - RNA, 20 nt, Artificial Sequence
  targeting sequence with CTCN PAM
ccucucccguguuuauuuau

SEQ ID NO: 16059 - RNA, 20 nt, Artificial Sequence
  targeting sequence with CTCN PAM
ucuccucucccguguuuauu

SEQ ID NO: 16060 - RNA, 20 nt, Artificial Sequence
  targeting sequence with CTCN PAM
ccucuccucucccguguuua

SEQ ID NO: 16061 - RNA, 20 nt, Artificial Sequence
  targeting sequence with CTCN PAM
aucuuucugucuucauuucu

SEQ ID NO: 16062 - RNA, 20 nt, Artificial Sequence
  targeting sequence with CTCN PAM
cuccaucuuucugucuucau

SEQ ID NO: 16063 - RNA, 20 nt, Artificial Sequence
  targeting sequence with CTCN PAM
ccaucuuucugucuuguuuc

SEQ ID NO: 16064 - RNA, 20 nt, Artificial Sequence
  targeting sequence with CTCN PAM
ccccaucuuucugucuuguu

SEQ ID NO: 16065 - RNA, 20 nt, Artificial Sequence
  targeting sequence with CTCN PAM
gcuucuguuucucuccccau

SEQ ID NO: 16066 - RNA, 20 nt, Artificial Sequence
  targeting sequence with CTCN PAM
aucuuucugucucugcuucu

SEQ ID NO: 16067 - RNA, 20 nt, Artificial Sequence
  targeting sequence with CTCN PAM
ccaucuuucugucucugcuu

SEQ ID NO: 16068 - RNA, 20 nt, Artificial Sequence
  targeting sequence with CTCN PAM
cuccaucuuucugucucugc

SEQ ID NO: 16069 - RNA, 20 nt, Artificial Sequence
  targeting sequence with CTCN PAM
guuucuguuucucucuccau

SEQ ID NO: 16070 - RNA, 20 nt, Artificial Sequence
  targeting sequence with CTCN PAM
gucuccguuucuguuucucu

SEQ ID NO: 16071 - RNA, 20 nt, Artificial Sequence
  targeting sequence with CTCN PAM
uuggaucucugucuccguuu

SEQ ID NO: 16072 - RNA, 20 nt, Artificial Sequence
  targeting sequence with CTCN PAM
gacugucucuuuggaucucu

SEQ ID NO: 16073 - RNA, 20 nt, Artificial Sequence
  targeting sequence with CTCN PAM
cugacugucucuuuggaucu

SEQ ID NO: 16074 - RNA, 20 nt, Artificial Sequence
  targeting sequence with CTCN PAM
uucucucugacugucucuuu

SEQ ID NO: 16075 - RNA, 20 nt, Artificial Sequence
  targeting sequence with CTCN PAM
gucucauucucucugacugu

SEQ ID NO: 16076 - RNA, 20 nt, Artificial Sequence
  targeting sequence with CTCN PAM
gcaucucugucucauucucu

SEQ ID NO: 16077 - RNA, 20 nt, Artificial Sequence
  targeting sequence with CTCN PAM
ccaugcgucucugcaucucu

SEQ ID NO: 16078 - RNA, 20 nt, Artificial Sequence
  targeting sequence with CTCN PAM
gucuccccaugcgucucugc

SEQ ID NO: 16079 - RNA, 20 nt, Artificial Sequence
  targeting sequence with CTCN PAM
cagacucagucuccccaugc

SEQ ID NO: 16080 - RNA, 20 nt, Artificial Sequence
  targeting sequence with CTCN PAM
cccagacucagucuccccau

SEQ ID NO: 16081 - RNA, 20 nt, Artificial Sequence
  targeting sequence with CTCN PAM
gucucucccagacucagucu

SEQ ID NO: 16082 - RNA, 20 nt, Artificial Sequence
  targeting sequence with CTCN PAM
ccgucucucccagacucagu

SEQ ID NO: 16083 - RNA, 20 nt, Artificial Sequence
  targeting sequence with CTCN PAM
cuccgucucucccagacuca

SEQ ID NO: 16084 - RNA, 20 nt, Artificial Sequence
  targeting sequence with CTCN PAM
cucuccgucucucccagacu

SEQ ID NO: 16085 - RNA, 20 nt, Artificial Sequence
  targeting sequence with CTCN PAM
cuuaucucucucuccgucuc

SEQ ID NO: 16086 - RNA, 20 nt, Artificial Sequence
  targeting sequence with CTCN PAM
ggaucucacuuaucucucuc

SEQ ID NO: 16087 - RNA, 20 nt, Artificial Sequence
  targeting sequence with CTCN PAM
cugugugucucuggaucuca

SEQ ID NO: 16088 - RNA, 20 nt, Artificial Sequence
  targeting sequence with CTCN PAM
cucgcugugugucucuggau

SEQ ID NO: 16089 - RNA, 20 nt, Artificial Sequence
  targeting sequence with CTCN PAM
gucucgcucgcugugugucu

SEQ ID NO: 16090 - RNA, 20 nt, Artificial Sequence
  targeting sequence with CTCN PAM
cucugucucgcucgcugugu

SEQ ID NO: 16091 - RNA, 20 nt, Artificial Sequence
  targeting sequence with CTCN PAM
gccucacucugucucgcucg

SEQ ID NO: 16092 - RNA, 20 nt, Artificial Sequence
  targeting sequence with CTCN PAM
cugccucacucugucucgcu

SEQ ID NO: 16093 - RNA, 20 nt, Artificial Sequence
  targeting sequence with CTCN PAM
cucugccucacucugucucg

SEQ ID NO: 16094 - RNA, 20 nt, Artificial Sequence
  targeting sequence with CTCN PAM
aucccgggucacugugugug

SEQ ID NO: 16095 - RNA, 20 nt, Artificial Sequence
  targeting sequence with CTCN PAM
uuccaagucccuccaucccg

SEQ ID NO: 16096 - RNA, 20 nt, Artificial Sequence
  targeting sequence with CTCN PAM
accgcugucccuccuuccaa

SEQ ID NO: 16097 - RNA, 20 nt, Artificial Sequence
  targeting sequence with CTCN PAM
ccaccgcugucccuccuucc

SEQ ID NO: 16098 - RNA, 20 nt, Artificial Sequence
  targeting sequence with CTCN PAM
cccguggcugcaucuuccug

SEQ ID NO: 16099 - RNA, 20 nt, Artificial Sequence
  targeting sequence with CTCN PAM
ucccccguggcugcaucuuc

SEQ ID NO: 16100 - RNA, 20 nt, Artificial Sequence
  targeting sequence with CTCN PAM
gggguggggugggcaaaggc

SEQ ID NO: 16101 - RNA, 20 nt, Artificial Sequence
  targeting sequence with CTCN PAM
gggcucaggggugggguggg

SEQ ID NO: 16102 - RNA, 20 nt, Artificial Sequence
  targeting sequence with CTCN PAM
ugccagcccagauucccagg

SEQ ID NO: 16103 - RNA, 20 nt, Artificial Sequence
  targeting sequence with CTCN PAM
cagcagccugggaaucuggg

SEQ ID NO: 16104 - RNA, 20 nt, Artificial Sequence
  targeting sequence with CTCN PAM
cccagcagccugggaaucug

SEQ ID NO: 16105 - RNA, 20 nt, Artificial Sequence
  targeting sequence with CTCN PAM
gucucucccagcagccuggg

SEQ ID NO: 16106 - RNA, 20 nt, Artificial Sequence
  targeting sequence with CTCN PAM
gcucucaaccuuagaagggg

SEQ ID NO: 16107 - RNA, 20 nt, Artificial Sequence
  targeting sequence with CTCN PAM
caaccuuagaaggggacccc

SEQ ID NO: 16108 - RNA, 20 nt, Artificial Sequence
  targeting sequence with CTCN PAM
accuuagaaggggaccccga

SEQ ID NO: 16109 - RNA, 20 nt, Artificial Sequence
  targeting sequence with CTCN PAM
ggguccccuucuaagguuga

SEQ ID NO: 16110 - RNA, 20 nt, Artificial Sequence
  targeting sequence with CTCN PAM
gggucucgggguccccuucu

SEQ ID NO: 16111 - RNA, 20 nt, Artificial Sequence
  targeting sequence with CTCN PAM
caggccuggcagccaggagg

SEQ ID NO: 16112 - RNA, 20 nt, Artificial Sequence
  targeting sequence with CTCN PAM
uggcugccaggccugcgagc

SEQ ID NO: 16113 - RNA, 20 nt, Artificial Sequence
  targeting sequence with CTCN PAM
gacgccccaggcacagccuc

SEQ ID NO: 16114 - RNA, 20 nt, Artificial Sequence
  targeting sequence with CTCN PAM
acacccucagacgccccagg

SEQ ID NO: 16115 - RNA, 20 nt, Artificial Sequence
  targeting sequence with CTCN PAM
agugcccccuccacacccuc

SEQ ID NO: 16116 - RNA, 20 nt, Artificial Sequence
  targeting sequence with CTCN PAM
gccuugggccaugucccugc

SEQ ID NO: 16117 - RNA, 20 nt, Artificial Sequence
  targeting sequence with CTCN PAM
uggaacugcaucccgcccuc

SEQ ID NO: 16118 - RNA, 20 nt, Artificial Sequence
  targeting sequence with CTCN PAM
cggggccucucuccagcugc

SEQ ID NO: 16119 - RNA, 20 nt, Artificial Sequence
  targeting sequence with CTCN PAM
cuccagcugccgcaggaaau

SEQ ID NO: 16120 - RNA, 20 nt, Artificial Sequence
  targeting sequence with CTCN PAM
ccagcugccgcaggaaauca

SEQ ID NO: 16121 - RNA, 20 nt, Artificial Sequence
  targeting sequence with CTCN PAM
agcugccgcaggaaaucagc

SEQ ID NO: 16122 - RNA, 20 nt, Artificial Sequence
  targeting sequence with CTCN PAM
agcugauuuccugcggcagc

SEQ ID NO: 16123 - RNA, 20 nt, Artificial Sequence
  targeting sequence with CTCN PAM
ucaagcugauuuccugcggc

SEQ ID NO: 16124 - RNA, 20 nt, Artificial Sequence
  targeting sequence with CTCN PAM
gacccaguacugcuggggca

SEQ ID NO: 16125 - RNA, 20 nt, Artificial Sequence
  targeting sequence with CTCN PAM
ucugacccaguacugcuggg

SEQ ID NO: 16126 - RNA, 20 nt, Artificial Sequence
  targeting sequence with CTCN PAM
uuggugggggcugggcgggg

SEQ ID NO: 16127 - RNA, 20 nt, Artificial Sequence
  targeting sequence with CTCN PAM
gcccaggccagcccugccuc

SEQ ID NO: 16128 - RNA, 20 nt, Artificial Sequence
  targeting sequence with CTCN PAM
cggagccucagcuuccccac

SEQ ID NO: 16129 - RNA, 20 nt, Artificial Sequence
  targeting sequence with CTCN PAM
gagccucagcuuccccacug

SEQ ID NO: 16130 - RNA, 20 nt, Artificial Sequence
  targeting sequence with CTCN PAM
gagaggcagggcuggccugg

SEQ ID NO: 16131 - RNA, 20 nt, Artificial Sequence
  targeting sequence with CTCN PAM
gcuuccccacuggggcaugg

SEQ ID NO: 16132 - RNA, 20 nt, Artificial Sequence
  targeting sequence with CTCN PAM
cuucccacgugcacccgcac

SEQ ID NO: 16133 - RNA, 20 nt, Artificial Sequence
  targeting sequence with CTCN PAM
gcccaguguguuguccuucu

SEQ ID NO: 16134 - RNA, 20 nt, Artificial Sequence
  targeting sequence with CTCN PAM
uagacaagaaggacaacaca

SEQ ID NO: 16135 - RNA, 20 nt, Artificial Sequence
  targeting sequence with CTCN PAM
uggccagggaggcaccuuca

SEQ ID NO: 16136 - RNA, 20 nt, Artificial Sequence
  targeting sequence with CTCN PAM
cuggccaugagucucauaga

SEQ ID NO: 16137 - RNA, 20 nt, Artificial Sequence
  targeting sequence with CTCN PAM
caucagaucccugaaggugc

SEQ ID NO: 16138 - RNA, 20 nt, Artificial Sequence
  targeting sequence with CTCN PAM
ccucccaucagaucccugaa

SEQ ID NO: 16139 - RNA, 20 nt, Artificial Sequence
  targeting sequence with CTCN PAM
ccccucccaucagaucccug

SEQ ID NO: 16140 - RNA, 20 nt, Artificial Sequence
  targeting sequence with CTCN PAM
gccucuccccucccaucaga

SEQ ID NO: 16141 - RNA, 20 nt, Artificial Sequence
  targeting sequence with CTCN PAM
gaccucggccucuccccucc

SEQ ID NO: 16142 - RNA, 20 nt, Artificial Sequence
  targeting sequence with CTCN PAM
ggccucugaccucggccucu

SEQ ID NO: 16143 - RNA, 20 nt, Artificial Sequence
  targeting sequence with CTCN PAM
ugcccccaccccaaccuccg

SEQ ID NO: 16144 - RNA, 20 nt, Artificial Sequence
  targeting sequence with CTCN PAM
gugguggaagacggccgcaa

SEQ ID NO: 16145 - RNA, 20 nt, Artificial Sequence
  targeting sequence with CTCN PAM
gugugcuggaggcgaaccac

SEQ ID NO: 16146 - RNA, 20 nt, Artificial Sequence
  targeting sequence with CTCN PAM
agcacacagagcuacauccu

SEQ ID NO: 16147 - RNA, 20 nt, Artificial Sequence
  targeting sequence with CTCN PAM
gggggacaagggacaggcca

SEQ ID NO: 16148 - RNA, 20 nt, Artificial Sequence
  targeting sequence with CTCN PAM
cugcccggacccugauggcc

SEQ ID NO: 16149 - RNA, 20 nt, Artificial Sequence
  targeting sequence with CTCN PAM
ggcccagcucccugcccgga

SEQ ID NO: 16150 - RNA, 20 nt, Artificial Sequence
  targeting sequence with CTCN PAM
cuauguggcugggccgguac

SEQ ID NO: 16151 - RNA, 20 nt, Artificial Sequence
  targeting sequence with CTCN PAM
cccuauguggcugggccggu

SEQ ID NO: 16152 - RNA, 20 nt, Artificial Sequence
  targeting sequence with CTCN PAM
cgcucucuccauguaaacug

SEQ ID NO: 16153 - RNA, 20 nt, Artificial Sequence
  targeting sequence with CTCN PAM
cucucuccauguaaacugag

SEQ ID NO: 16154 - RNA, 20 nt, Artificial Sequence
  targeting sequence with CTCN PAM
cuccauguaaacugaggcaa

SEQ ID NO: 16155 - RNA, 20 nt, Artificial Sequence
  targeting sequence with CTCN PAM
ccauguaaacugaggcaagc

SEQ ID NO: 16156 - RNA, 20 nt, Artificial Sequence
  targeting sequence with CTCN PAM
auguaaacugaggcaagcca

SEQ ID NO: 16157 - RNA, 20 nt, Artificial Sequence
  targeting sequence with CTCN PAM
guuuacauggagagagcgag

SEQ ID NO: 16158 - RNA, 20 nt, Artificial Sequence
  targeting sequence with CTCN PAM
cucugagccuccauuuuccc

SEQ ID NO: 16159 - RNA, 20 nt, Artificial Sequence
  targeting sequence with CTCN PAM
cugagccuccauuuucccau

SEQ ID NO: 16160 - RNA, 20 nt, Artificial Sequence
  targeting sequence with CTCN PAM
gagccuccauuuucccaucu

SEQ ID NO: 16161 - RNA, 20 nt, Artificial Sequence
  targeting sequence with CTCN PAM
gagagagguauggcuugccu

SEQ ID NO: 16162 - RNA, 20 nt, Artificial Sequence
  targeting sequence with CTCN PAM
auuuucccaucuguaaaaug

SEQ ID NO: 16163 - RNA, 20 nt, Artificial Sequence
  targeting sequence with CTCN PAM
ccauuuuacagaugggaaaa

SEQ ID NO: 16164 - RNA, 20 nt, Artificial Sequence
  targeting sequence with CTCN PAM
uuccugcccuccccauuuua

SEQ ID NO: 16165 - RNA, 20 nt, Artificial Sequence
  targeting sequence with CTCN PAM
cccagcucuuuccugcccuc

SEQ ID NO: 16166 - RNA, 20 nt, Artificial Sequence
  targeting sequence with CTCN PAM
cccccagcucuuuccugccc

SEQ ID NO: 16167 - RNA, 20 nt, Artificial Sequence
  targeting sequence with CTCN PAM
cacucucccccagcucuuuc

SEQ ID NO: 16168 - RNA, 20 nt, Artificial Sequence
  targeting sequence with CTCN PAM
uuguacccucacacucuccc

SEQ ID NO: 16169 - RNA, 20 nt, Artificial Sequence
  targeting sequence with CTCN PAM
acccuggcaccuucucuuug

SEQ ID NO: 16170 - RNA, 20 nt, Artificial Sequence
  targeting sequence with CTCN PAM
gugcccuccacccuggcacc

SEQ ID NO: 16171 - RNA, 20 nt, Artificial Sequence
  targeting sequence with CTCN PAM
ucugugcccuccacccuggc

SEQ ID NO: 16172 - RNA, 20 nt, Artificial Sequence
  targeting sequence with CTCN PAM
uccucugugcccuccacccu

SEQ ID NO: 16173 - RNA, 20 nt, Artificial Sequence
  targeting sequence with CTCN PAM
ggaaauggccuugucugcaa

SEQ ID NO: 16174 - RNA, 20 nt, Artificial Sequence
  targeting sequence with CTCN PAM
uauaaaacccacuccaggcc

SEQ ID NO: 16175 - RNA, 20 nt, Artificial Sequence
  targeting sequence with CTCN PAM
aggccccgcgcgguggcuca

SEQ ID NO: 16176 - RNA, 20 nt, Artificial Sequence
  targeting sequence with CTCN PAM
caccuguaaucccagcacuu

SEQ ID NO: 16177 - RNA, 20 nt, Artificial Sequence
  targeting sequence with CTCN PAM
caaagugcugggauuacagg

SEQ ID NO: 16178 - RNA, 20 nt, Artificial Sequence
  targeting sequence with CTCN PAM
uccucccaaagugcugggau

SEQ ID NO: 16179 - RNA, 20 nt, Artificial Sequence
  targeting sequence with CTCN PAM
ugccucauccucccaaagug

SEQ ID NO: 16180 - RNA, 20 nt, Artificial Sequence
  targeting sequence with CTCN PAM
agcgauccuccugccucauc

SEQ ID NO: 16181 - RNA, 20 nt, Artificial Sequence
  targeting sequence with CTCN PAM
ugggcucaagcgauccuccu

SEQ ID NO: 16182 - RNA, 20 nt, Artificial Sequence
  targeting sequence with CTCN PAM
uguagucccagcuacucagg

SEQ ID NO: 16183 - RNA, 20 nt, Artificial Sequence
  targeting sequence with CTCN PAM
ggaggcugaaaugaggggau

SEQ ID NO: 16184 - RNA, 20 nt, Artificial Sequence
  targeting sequence with CTCN PAM
ugaguagcugggacuacagg

SEQ ID NO: 16185 - RNA, 20 nt, Artificial Sequence
  targeting sequence with CTCN PAM
uuucagccuccugaguagcu

SEQ ID NO: 16186 - RNA, 20 nt, Artificial Sequence
  targeting sequence with CTCN PAM
agugauccccucauuucagc

SEQ ID NO: 16187 - RNA, 20 nt, Artificial Sequence
  targeting sequence with CTCN PAM
ugggcucaagugauccccuc

SEQ ID NO: 16188 - RNA, 20 nt, Artificial Sequence
  targeting sequence with CTCN PAM
accuccugggcucaagugau

SEQ ID NO: 16189 - RNA, 20 nt, Artificial Sequence
  targeting sequence with CTCN PAM
cugcagccucgaccuccugg

SEQ ID NO: 16190 - RNA, 20 nt, Artificial Sequence
  targeting sequence with CTCN PAM
gcucacugcagccucgaccu

SEQ ID NO: 16191 - RNA, 20 nt, Artificial Sequence
  targeting sequence with CTCN PAM
agccugggugacagaaugag

SEQ ID NO: 16192 - RNA, 20 nt, Artificial Sequence
  targeting sequence with CTCN PAM
uucugucacccaggcuggag

SEQ ID NO: 16193 - RNA, 20 nt, Artificial Sequence
  targeting sequence with CTCN PAM
aaaacaaacaaacaaaccaa

SEQ ID NO: 16194 - RNA, 20 nt, Artificial Sequence
  targeting sequence with CTCN PAM
agcaucccuccuuuaggaau

SEQ ID NO: 16195 - RNA, 20 nt, Artificial Sequence
  targeting sequence with CTCN PAM
uuuaggaauuaggaagccuu

SEQ ID NO: 16196 - RNA, 20 nt, Artificial Sequence
  targeting sequence with CTCN PAM
cacugcaggacuugucuccu

SEQ ID NO: 16197 - RNA, 20 nt, Artificial Sequence
  targeting sequence with CTCN PAM
uacagaguaagagcuucuug

SEQ ID NO: 16198 - RNA, 20 nt, Artificial Sequence
  targeting sequence with CTCN PAM
guaggagacaaguccugcag

SEQ ID NO: 16199 - RNA, 20 nt, Artificial Sequence
  targeting sequence with CTCN PAM
uacucuguaggagacaaguc

SEQ ID NO: 16200 - RNA, 20 nt, Artificial Sequence
  targeting sequence with CTCN PAM
gcaagaagcucuuacucugu

SEQ ID NO: 16201 - RNA, 20 nt, Artificial Sequence
  targeting sequence with CTCN PAM
uuggauccucucaguguccc

SEQ ID NO: 16202 - RNA, 20 nt, Artificial Sequence
  targeting sequence with CTCN PAM
caguguccccacauucaugc

SEQ ID NO: 16203 - RNA, 20 nt, Artificial Sequence
  targeting sequence with CTCN PAM
guguccccacauucaugcac

SEQ ID NO: 16204 - RNA, 20 nt, Artificial Sequence
  targeting sequence with CTCN PAM
uuucaccuggcaugggugca

SEQ ID NO: 16205 - RNA, 20 nt, Artificial Sequence
  targeting sequence with CTCN PAM
gcccccauucccacccacca

SEQ ID NO: 16206 - RNA, 20 nt, Artificial Sequence
  targeting sequence with CTCN PAM
gcacgcggccacugggagua

SEQ ID NO: 16207 - RNA, 20 nt, Artificial Sequence
  targeting sequence with CTCN PAM
caguggccgcgugcagagga

SEQ ID NO: 16208 - RNA, 20 nt, Artificial Sequence
  targeting sequence with CTCN PAM
aggaucuucuccuugaccug

SEQ ID NO: 16209 - RNA, 20 nt, Artificial Sequence
  targeting sequence with CTCN PAM
uugaccugugucagcguguc

SEQ ID NO: 16210 - RNA, 20 nt, Artificial Sequence
  targeting sequence with CTCN PAM
gcgaguccaugccacagccc

SEQ ID NO: 16211 - RNA, 20 nt, Artificial Sequence
  targeting sequence with CTCN PAM
cugagcgugcgggccaugga

SEQ ID NO: 16212 - RNA, 20 nt, Artificial Sequence
  targeting sequence with CTCN PAM
cccugcagaaccugaacgug

SEQ ID NO: 16213 - RNA, 20 nt, Artificial Sequence
  targeting sequence with CTCN PAM
cccccugcagaaccugaacg

SEQ ID NO: 16214 - RNA, 20 nt, Artificial Sequence
  targeting sequence with CTCN PAM
cacucucccccugcagaacc

SEQ ID NO: 16215 - RNA, 20 nt, Artificial Sequence
  targeting sequence with CTCN PAM
cccacucucccccugcagaa

SEQ ID NO: 16216 - RNA, 20 nt, Artificial Sequence
  targeting sequence with CTCN PAM
cugaccuuucucucccacuc

SEQ ID NO: 16217 - RNA, 20 nt, Artificial Sequence
  targeting sequence with CTCN PAM
ccgcccugccgacuuacccg

SEQ ID NO: 16218 - RNA, 20 nt, Artificial Sequence
  targeting sequence with CTCN PAM
auguucucccgcagcagcca

SEQ ID NO: 16219 - RNA, 20 nt, Artificial Sequence
  targeting sequence with CTCN PAM
cgcagcagccacuccucacu

SEQ ID NO: 16220 - RNA, 20 nt, Artificial Sequence
  targeting sequence with CTCN PAM
ucacugaguguguagcgggc

SEQ ID NO: 16221 - RNA, 20 nt, Artificial Sequence
  targeting sequence with CTCN PAM
cugaguguguagcgggccuu

SEQ ID NO: 16222 - RNA, 20 nt, Artificial Sequence
  targeting sequence with CTCN PAM
gugaggaguggcugcugcgg

SEQ ID NO: 16223 - RNA, 20 nt, Artificial Sequence
  targeting sequence with CTCN PAM
aucgacgccaucacaggcaa

SEQ ID NO: 16224 - RNA, 20 nt, Artificial Sequence
  targeting sequence with CTCN PAM
cccaccgucuccugaggggc

SEQ ID NO: 16225 - RNA, 20 nt, Artificial Sequence
  targeting sequence with CTCN PAM
ugaggggcacggggguauca

SEQ ID NO: 16226 - RNA, 20 nt, Artificial Sequence
  targeting sequence with CTCN PAM
ggagacggugggggagccau

SEQ ID NO: 16227 - RNA, 20 nt, Artificial Sequence
  targeting sequence with CTCN PAM
guauuccagcccccaugcuu

SEQ ID NO: 16228 - RNA, 20 nt, Artificial Sequence
  targeting sequence with CTCN PAM
gcacuguuggcugcacagua

SEQ ID NO: 16229 - RNA, 20 nt, Artificial Sequence
  targeting sequence with CTCN PAM
gagagggcaagugaccugcc

SEQ ID NO: 16230 - RNA, 20 nt, Artificial Sequence
  targeting sequence with CTCN PAM
gagccucggcacuguuggcu

SEQ ID NO: 16231 - RNA, 20 nt, Artificial Sequence
  targeting sequence with CTCN PAM
cugagccucggcacuguugg

SEQ ID NO: 16232 - RNA, 20 nt, Artificial Sequence
  targeting sequence with CTCN PAM
gcugacucccaagccuguga

SEQ ID NO: 16233 - RNA, 20 nt, Artificial Sequence
  targeting sequence with CTCN PAM
caagccugugacuuucuacu

SEQ ID NO: 16234 - RNA, 20 nt, Artificial Sequence
  targeting sequence with CTCN PAM
cacuugggggccccccacuu

SEQ ID NO: 16235 - RNA, 20 nt, Artificial Sequence
  targeting sequence with CTCN PAM
accccacuugcaggcugaug

SEQ ID NO: 16236 - RNA, 20 nt, Artificial Sequence
  targeting sequence with CTCN PAM
auagucaucagccugcaagu

SEQ ID NO: 16237 - RNA, 20 nt, Artificial Sequence
  targeting sequence with CTCN PAM
ggaggaauggggcucaaugu

SEQ ID NO: 16238 - RNA, 20 nt, Artificial Sequence
  targeting sequence with CTCN PAM
ugagacuccauagucaucag

SEQ ID NO: 16239 - RNA, 20 nt, Artificial Sequence
  targeting sequence with CTCN PAM
augucccugcucuugcccau

SEQ ID NO: 16240 - RNA, 20 nt, Artificial Sequence
  targeting sequence with CTCN PAM
ugcccaucuccaaggguggc

SEQ ID NO: 16241 - RNA, 20 nt, Artificial Sequence
  targeting sequence with CTCN PAM
aaggguggcccuccaggcag

SEQ ID NO: 16242 - RNA, 20 nt, Artificial Sequence
  targeting sequence with CTCN PAM
aggcaguggcucugcuggac

SEQ ID NO: 16243 - RNA, 20 nt, Artificial Sequence
  targeting sequence with CTCN PAM
gcuggacccacagccaugag

SEQ ID NO: 16244 - RNA, 20 nt, Artificial Sequence
  targeting sequence with CTCN PAM
uggcuguggguccagcagag

SEQ ID NO: 16245 - RNA, 20 nt, Artificial Sequence
  targeting sequence with CTCN PAM
aggccauugcccagcaaggg

SEQ ID NO: 16246 - RNA, 20 nt, Artificial Sequence
  targeting sequence with CTCN PAM
aggucuggggcgugggaggc

SEQ ID NO: 16247 - RNA, 20 nt, Artificial Sequence
  targeting sequence with CTCN PAM
cacgccccagaccuggagaa

SEQ ID NO: 16248 - RNA, 20 nt, Artificial Sequence
  targeting sequence with CTCN PAM
aggaagcagggaaucagugc

SEQ ID NO: 16249 - RNA, 20 nt, Artificial Sequence
  targeting sequence with CTCN PAM
ucuaggaagcagggaaucag

SEQ ID NO: 16250 - RNA, 20 nt, Artificial Sequence
  targeting sequence with CTCN PAM
uaggggaaggccuggcugag

SEQ ID NO: 16251 - RNA, 20 nt, Artificial Sequence
  targeting sequence with CTCN PAM
gccaggccuuccccuaugag

SEQ ID NO: 16252 - RNA, 20 nt, Artificial Sequence
  targeting sequence with CTCN PAM
ccuggcuucuuucuguggcc

SEQ ID NO: 16253 - RNA, 20 nt, Artificial Sequence
  targeting sequence with CTCN PAM
cuccccuggcuucuuucugu

SEQ ID NO: 16254 - RNA, 20 nt, Artificial Sequence
  targeting sequence with CTCN PAM
cugugggccaucaggaacca

SEQ ID NO: 16255 - RNA, 20 nt, Artificial Sequence
  targeting sequence with CTCN PAM
gccuucugcgggcugccuca

SEQ ID NO: 16256 - RNA, 20 nt, Artificial Sequence
  targeting sequence with CTCN PAM
caggcccugccucugcucca

SEQ ID NO: 16257 - RNA, 20 nt, Artificial Sequence
  targeting sequence with CTCN PAM
gcuccaccccacuacccccu

SEQ ID NO: 16258 - RNA, 20 nt, Artificial Sequence
  targeting sequence with CTCN PAM
accccacuacccccuucccc

SEQ ID NO: 16259 - RNA, 20 nt, Artificial Sequence
  targeting sequence with CTCN PAM
ugggggaaggggguaguggg

SEQ ID NO: 16260 - RNA, 20 nt, Artificial Sequence
  targeting sequence with CTCN PAM
uccugggggaaggggguagu

SEQ ID NO: 16261 - RNA, 20 nt, Artificial Sequence
  targeting sequence with CTCN PAM
cccaggcuacuuggcccuca

SEQ ID NO: 16262 - RNA, 20 nt, Artificial Sequence
  targeting sequence with CTCN PAM
agccccaggcucaggggcag

SEQ ID NO: 16263 - RNA, 20 nt, Artificial Sequence
  targeting sequence with CTCN PAM
ggggcagaggccccauuuga

SEQ ID NO: 16264 - RNA, 20 nt, Artificial Sequence
  targeting sequence with CTCN PAM
gccccugagccuggggcuug

SEQ ID NO: 16265 - RNA, 20 nt, Artificial Sequence
  targeting sequence with CTCN PAM
gugggccuugguuuccuucu

SEQ ID NO: 16266 - RNA, 20 nt, Artificial Sequence
  targeting sequence with CTCN PAM
uugcccucugugggccuugg

SEQ ID NO: 16267 - RNA, 20 nt, Artificial Sequence
  targeting sequence with CTCN PAM
gggcuacucauugcccucug

SEQ ID NO: 16268 - RNA, 20 nt, Artificial Sequence
  targeting sequence with CTCN PAM
agcccaggacaucuuggcug

SEQ ID NO: 16269 - RNA, 20 nt, Artificial Sequence
  targeting sequence with CTCN PAM
ccccuguaaucccagcacuu

SEQ ID NO: 16270 - RNA, 20 nt, Artificial Sequence
  targeting sequence with CTCN PAM
caaagugcugggauuacagg

SEQ ID NO: 16271 - RNA, 20 nt, Artificial Sequence
  targeting sequence with CTCN PAM
cgcuuuggccucccaaagug

SEQ ID NO: 16272 - RNA, 20 nt, Artificial Sequence
  targeting sequence with CTCN PAM
agcaauccucccgcuuuggc

SEQ ID NO: 16273 - RNA, 20 nt, Artificial Sequence
  targeting sequence with CTCN PAM
ggaguuugggaccagccugu

SEQ ID NO: 16274 - RNA, 20 nt, Artificial Sequence
  targeting sequence with CTCN PAM
ugagcucaagcaauccuccc

SEQ ID NO: 16275 - RNA, 20 nt, Artificial Sequence
  targeting sequence with CTCN PAM
ucaaaaauuaauaacaaaaa

SEQ ID NO: 16276 - RNA, 20 nt, Artificial Sequence
  targeting sequence with CTCN PAM
gauguucuguuuuuuguuau

SEQ ID NO: 16277 - RNA, 20 nt, Artificial Sequence
  targeting sequence with CTCN PAM
aggcaggccuuugccuuucu

SEQ ID NO: 16278 - RNA, 20 nt, Artificial Sequence
  targeting sequence with CTCN PAM
cacaauccuccaggcagccc

SEQ ID NO: 16279 - RNA, 20 nt, Artificial Sequence
  targeting sequence with CTCN PAM
aggcagcccucuagccucug

SEQ ID NO: 16280 - RNA, 20 nt, Artificial Sequence
  targeting sequence with CTCN PAM
agccucugccaccauagggc

SEQ ID NO: 16281 - RNA, 20 nt, Artificial Sequence
  targeting sequence with CTCN PAM
gccaccauagggcagcugga

SEQ ID NO: 16282 - RNA, 20 nt, Artificial Sequence
  targeting sequence with CTCN PAM
uguccugucccacuguccag

SEQ ID NO: 16283 - RNA, 20 nt, Artificial Sequence
  targeting sequence with CTCN PAM
gcgaagagagcuuauggggg

SEQ ID NO: 16284 - RNA, 20 nt, Artificial Sequence
  targeting sequence with CTCN PAM
ucgcagagcaaggguugcuu

SEQ ID NO: 16285 - RNA, 20 nt, Artificial Sequence
  targeting sequence with CTCN PAM
cuucgcagagcaaggguugc

SEQ ID NO: 16286 - RNA, 20 nt, Artificial Sequence
  targeting sequence with CTCN PAM
gccagaaggacccccauaag

SEQ ID NO: 16287 - RNA, 20 nt, Artificial Sequence
  targeting sequence with CTCN PAM
ugcacucugccagaaggacc

SEQ ID NO: 16288 - RNA, 20 nt, Artificial Sequence
  targeting sequence with CTCN PAM
ucccagccuccgcucucauc

SEQ ID NO: 16289 - RNA, 20 nt, Artificial Sequence
  targeting sequence with CTCN PAM
gcucucauccagaagauucu

SEQ ID NO: 16290 - RNA, 20 nt, Artificial Sequence
  targeting sequence with CTCN PAM
cauccagaagauucuuuggc

SEQ ID NO: 16291 - RNA, 20 nt, Artificial Sequence
  targeting sequence with CTCN PAM
uccagaagauucuuuggccu

SEQ ID NO: 16292 - RNA, 20 nt, Artificial Sequence
  targeting sequence with CTCN PAM
ucccggccucugcccuugug

SEQ ID NO: 16293 - RNA, 20 nt, Artificial Sequence
  targeting sequence with CTCN PAM
cggccucugcccuugugcug

SEQ ID NO: 16294 - RNA, 20 nt, Artificial Sequence
  targeting sequence with CTCN PAM
gcccuugugcuguacccgau

SEQ ID NO: 16295 - RNA, 20 nt, Artificial Sequence
  targeting sequence with CTCN PAM
aggcaucggguacagcacaa

SEQ ID NO: 16296 - RNA, 20 nt, Artificial Sequence
  targeting sequence with CTCN PAM
ccaccacuccucgccuggcu

SEQ ID NO: 16297 - RNA, 20 nt, Artificial Sequence
  targeting sequence with CTCN PAM
ucgccuggcucacucucuua

SEQ ID NO: 16298 - RNA, 20 nt, Artificial Sequence
  targeting sequence with CTCN PAM
ccuggcucacucucuuaggu

SEQ ID NO: 16299 - RNA, 20 nt, Artificial Sequence
  targeting sequence with CTCN PAM
cucucuuaggucucagcaca

SEQ ID NO: 16300 - RNA, 20 nt, Artificial Sequence
  targeting sequence with CTCN PAM
cuuaggucucagcacagggu

SEQ ID NO: 16301 - RNA, 20 nt, Artificial Sequence
  targeting sequence with CTCN PAM
uaggucucagcacaggguug

SEQ ID NO: 16302 - RNA, 20 nt, Artificial Sequence
  targeting sequence with CTCN PAM
gcacaggguugccugcucca

SEQ ID NO: 16303 - RNA, 20 nt, Artificial Sequence
  targeting sequence with CTCN PAM
aggaagccaccuugaagccu

SEQ ID NO: 16304 - RNA, 20 nt, Artificial Sequence
  targeting sequence with CTCN PAM
gucugaaggcuucaaggugg

SEQ ID NO: 16305 - RNA, 20 nt, Artificial Sequence
  targeting sequence with CTCN PAM
cucugucugaaggcuucaag

SEQ ID NO: 16306 - RNA, 20 nt, Artificial Sequence
  targeting sequence with CTCN PAM
ugagcugagcucugcugcga

SEQ ID NO: 16307 - RNA, 20 nt, Artificial Sequence
  targeting sequence with CTCN PAM
cgaggccucccucugucuga

SEQ ID NO: 16308 - RNA, 20 nt, Artificial Sequence
  targeting sequence with CTCN PAM
gcucacgaggccucccucug

SEQ ID NO: 16309 - RNA, 20 nt, Artificial Sequence
  targeting sequence with CTCN PAM
gcugcgaggcacuggccacc

SEQ ID NO: 16310 - RNA, 20 nt, Artificial Sequence
  targeting sequence with CTCN PAM
cagcagagcucagcucacga

SEQ ID NO: 16311 - RNA, 20 nt, Artificial Sequence
  targeting sequence with CTCN PAM
ccuagccuagggcugggaga

SEQ ID NO: 16312 - RNA, 20 nt, Artificial Sequence
  targeting sequence with CTCN PAM
cagcccuaggcuaggcgaga

SEQ ID NO: 16313 - RNA, 20 nt, Artificial Sequence
  targeting sequence with CTCN PAM
cccagcccuaggcuaggcga

SEQ ID NO: 16314 - RNA, 20 nt, Artificial Sequence
  targeting sequence with CTCN PAM
agggccagccaggggcugau

SEQ ID NO: 16315 - RNA, 20 nt, Artificial Sequence
  targeting sequence with CTCN PAM
ugaauccagagcagggaagg

SEQ ID NO: 16316 - RNA, 20 nt, Artificial Sequence
  targeting sequence with CTCN PAM
ggauucaggagaugaaauca

SEQ ID NO: 16317 - RNA, 20 nt, Artificial Sequence
  targeting sequence with CTCN PAM
gucauccacccuucccugcu

SEQ ID NO: 16318 - RNA, 20 nt, Artificial Sequence
  targeting sequence with CTCN PAM
guuaugccccaagcauccgu

SEQ ID NO: 16319 - RNA, 20 nt, Artificial Sequence
  targeting sequence with CTCN PAM
acggaugcuuggggcauaac

SEQ ID NO: 16320 - RNA, 20 nt, Artificial Sequence
  targeting sequence with CTCN PAM
ccucucugcauaacaggucc

SEQ ID NO: 16321 - RNA, 20 nt, Artificial Sequence
  targeting sequence with CTCN PAM
cugcauaacagguccuacgg

SEQ ID NO: 16322 - RNA, 20 nt, Artificial Sequence
  targeting sequence with CTCN PAM
gcauaacagguccuacgggc

SEQ ID NO: 16323 - RNA, 20 nt, Artificial Sequence
  targeting sequence with CTCN PAM
ugcaacacucccuccuggca

SEQ ID NO: 16324 - RNA, 20 nt, Artificial Sequence
  targeting sequence with CTCN PAM
cuccuggcagagcuggccug

SEQ ID NO: 16325 - RNA, 20 nt, Artificial Sequence
  targeting sequence with CTCN PAM
uggcagagcuggccugaggg

SEQ ID NO: 16326 - RNA, 20 nt, Artificial Sequence
  targeting sequence with CTCN PAM
gccaggagggaguguugcau

SEQ ID NO: 16327 - RNA, 20 nt, Artificial Sequence
  targeting sequence with CTCN PAM
ggccagcucugccaggaggg

SEQ ID NO: 16328 - RNA, 20 nt, Artificial Sequence
  targeting sequence with CTCN PAM
caggccuucccuggcacccu

SEQ ID NO: 16329 - RNA, 20 nt, Artificial Sequence
  targeting sequence with CTCN PAM
gcggcagugaccccacggcc

SEQ ID NO: 16330 - RNA, 20 nt, Artificial Sequence
  targeting sequence with CTCN PAM
gucuguccccaggcagccuc

SEQ ID NO: 16331 - RNA, 20 nt, Artificial Sequence
  targeting sequence with CTCN PAM
cccgcagacagcuguacaug

SEQ ID NO: 16332 - RNA, 20 nt, Artificial Sequence
  targeting sequence with CTCN PAM
ccaacuggauguccaucugc

SEQ ID NO: 16333 - RNA, 20 nt, Artificial Sequence
  targeting sequence with CTCN PAM
accacagacucugugcgccg

SEQ ID NO: 16334 - RNA, 20 nt, Artificial Sequence
  targeting sequence with CTCN PAM
gugcgccgcagcaugagcuu

SEQ ID NO: 16335 - RNA, 20 nt, Artificial Sequence
  targeting sequence with CTCN PAM
ugcugcggcgcacagagucu

SEQ ID NO: 16336 - RNA, 20 nt, Artificial Sequence
  targeting sequence with CTCN PAM
gccgccaagaaccccaagcu

SEQ ID NO: 16337 - RNA, 20 nt, Artificial Sequence
  targeting sequence with CTCN PAM
uugacgccucggccgccaag

SEQ ID NO: 16338 - RNA, 20 nt, Artificial Sequence
  targeting sequence with CTCN PAM
uucaugaugcugguguagua

SEQ ID NO: 16339 - RNA, 20 nt, Artificial Sequence
  targeting sequence with CTCN PAM
agcuugccgugcagcgcgau

SEQ ID NO: 16340 - RNA, 20 nt, Artificial Sequence
  targeting sequence with CTCN PAM
cugcugaccaucgcgcugca

SEQ ID NO: 16341 - RNA, 20 nt, Artificial Sequence
  targeting sequence with CTCN PAM
caggugcagccuggccucgc

SEQ ID NO: 16342 - RNA, 20 nt, Artificial Sequence
  targeting sequence with CTCN PAM
cgcucacaggugcagccugg

SEQ ID NO: 16343 - RNA, 20 nt, Artificial Sequence
  targeting sequence with CTCN PAM
aggugcaguugacaccugcc

SEQ ID NO: 16344 - RNA, 20 nt, Artificial Sequence
  targeting sequence with CTCN PAM
uagggccucaaggugcaguu

SEQ ID NO: 16345 - RNA, 20 nt, Artificial Sequence
  targeting sequence with CTCN PAM
ucuucccuaccccaccccag

SEQ ID NO: 16346 - RNA, 20 nt, Artificial Sequence
  targeting sequence with CTCN PAM
ucccuaccccaccccagucu

SEQ ID NO: 16347 - RNA, 20 nt, Artificial Sequence
  targeting sequence with CTCN PAM
agcgcguggacaaagacgau

SEQ ID NO: 16348 - RNA, 20 nt, Artificial Sequence
  targeting sequence with CTCN PAM
ucgucuuuguccacgcgcug

SEQ ID NO: 16349 - RNA, 20 nt, Artificial Sequence
  targeting sequence with CTCN PAM
acaacaagcacuuccucauc

SEQ ID NO: 16350 - RNA, 20 nt, Artificial Sequence
  targeting sequence with CTCN PAM
cuacucaacaacaagcacuu

SEQ ID NO: 16351 - RNA, 20 nt, Artificial Sequence
  targeting sequence with CTCN PAM
ucacuacucaacaacaagca

SEQ ID NO: 16352 - RNA, 20 nt, Artificial Sequence
  targeting sequence with CTCN PAM
uccauguugggccggcagcu

SEQ ID NO: 16353 - RNA, 20 nt, Artificial Sequence
  targeting sequence with CTCN PAM
caggaaucuguggaagcaac

SEQ ID NO: 16354 - RNA, 20 nt, Artificial Sequence
  targeting sequence with CTCN PAM
ggaaucuguggaagcaacug

SEQ ID NO: 16355 - RNA, 20 nt, Artificial Sequence
  targeting sequence with CTCN PAM
ggacaccccaucaccaguug

SEQ ID NO: 16356 - RNA, 20 nt, Artificial Sequence
  targeting sequence with CTCN PAM
ugggauggggagcucauuac

SEQ ID NO: 16357 - RNA, 20 nt, Artificial Sequence
  targeting sequence with CTCN PAM
ccaucccaggaggcauacaa

SEQ ID NO: 16358 - RNA, 20 nt, Artificial Sequence
  targeting sequence with CTCN PAM
uuaccuuccacgguggaugc

SEQ ID NO: 16359 - RNA, 20 nt, Artificial Sequence
  targeting sequence with CTCN PAM
ccuuccacucucccagcagu

SEQ ID NO: 16360 - RNA, 20 nt, Artificial Sequence
  targeting sequence with CTCN PAM
cccagcaguggguggguuuc

SEQ ID NO: 16361 - RNA, 20 nt, Artificial Sequence
  targeting sequence with CTCN PAM
cagcaguggguggguuuccu

SEQ ID NO: 16362 - RNA, 20 nt, Artificial Sequence
  targeting sequence with CTCN PAM
caggcacaggaaacccaccc

SEQ ID NO: 16363 - RNA, 20 nt, Artificial Sequence
  targeting sequence with CTCN PAM
cagggcagcucccaggcaca

SEQ ID NO: 16364 - RNA, 20 nt, Artificial Sequence
  targeting sequence with CTCN PAM
acucccagggcagcucccag

SEQ ID NO: 16365 - RNA, 20 nt, Artificial Sequence
  targeting sequence with CTCN PAM
cagacccucaacucccaggg

SEQ ID NO: 16366 - RNA, 20 nt, Artificial Sequence
  targeting sequence with CTCN PAM
ucauaaagggaggaacacug

SEQ ID NO: 16367 - RNA, 20 nt, Artificial Sequence
  targeting sequence with CTCN PAM
cuuuaugaagagcguuacgu

SEQ ID NO: 16368 - RNA, 20 nt, Artificial Sequence
  targeting sequence with CTCN PAM
gcaguguuccucccuuuaug

SEQ ID NO: 16369 - RNA, 20 nt, Artificial Sequence
  targeting sequence with CTCN PAM
gcggggcuggacacccccug

SEQ ID NO: 16370 - RNA, 20 nt, Artificial Sequence
  targeting sequence with CTCN PAM
cacagaaaggggcacuggcu

SEQ ID NO: 16371 - RNA, 20 nt, Artificial Sequence
  targeting sequence with CTCN PAM
ccauaaaggacuaagaggca

SEQ ID NO: 16372 - RNA, 20 nt, Artificial Sequence
  targeting sequence with CTCN PAM
uaguccuuuauggggagcua

SEQ ID NO: 16373 - RNA, 20 nt, Artificial Sequence
  targeting sequence with CTCN PAM
augugcaaugggggaaacug

SEQ ID NO: 16374 - RNA, 20 nt, Artificial Sequence
  targeting sequence with CTCN PAM
guuucccccauugcacaugg

SEQ ID NO: 16375 - RNA, 20 nt, Artificial Sequence
  targeting sequence with CTCN PAM
cagccuuucugccucaguuu

SEQ ID NO: 16376 - RNA, 20 nt, Artificial Sequence
  targeting sequence with CTCN PAM
gacucccagccuuucugccu

SEQ ID NO: 16377 - RNA, 20 nt, Artificial Sequence
  targeting sequence with CTCN PAM
ggcuaaagcucagacuccca

SEQ ID NO: 16378 - RNA, 20 nt, Artificial Sequence
  targeting sequence with CTCN PAM
aguagcuuuucccagccuca

SEQ ID NO: 16379 - RNA, 20 nt, Artificial Sequence
  targeting sequence with CTCN PAM
ccuguccacaccauucccca

SEQ ID NO: 16380 - RNA, 20 nt, Artificial Sequence
  targeting sequence with CTCN PAM
ccccuguccacaccauuccc

SEQ ID NO: 16381 - RNA, 20 nt, Artificial Sequence
  targeting sequence with CTCN PAM
cuccccuguccacaccauuc

SEQ ID NO: 16382 - RNA, 20 nt, Artificial Sequence
  targeting sequence with CTCN PAM
uagugguaccacccucucuc

SEQ ID NO: 16383 - RNA, 20 nt, Artificial Sequence
  targeting sequence with CTCN PAM
accuccuagugguaccaccc

SEQ ID NO: 16384 - RNA, 20 nt, Artificial Sequence
  targeting sequence with CTCN PAM
cucuaccuccuagugguacc

SEQ ID NO: 16385 - RNA, 20 nt, Artificial Sequence
  targeting sequence with CTCN PAM
ccuugcccuuccagggucca

SEQ ID NO: 16386 - RNA, 20 nt, Artificial Sequence
  targeting sequence with CTCN PAM
ugccuccccuugcccuucca

SEQ ID NO: 16387 - RNA, 20 nt, Artificial Sequence
  targeting sequence with CTCN PAM
caugccuccccuugcccuuc

SEQ ID NO: 16388 - RNA, 20 nt, Artificial Sequence
  targeting sequence with CTCN PAM
ugccccaucccuuccaugcc

SEQ ID NO: 16389 - RNA, 20 nt, Artificial Sequence
  targeting sequence with CTCN PAM
uguccacuggacuccugccc

SEQ ID NO: 16390 - RNA, 20 nt, Artificial Sequence
  targeting sequence with CTCN PAM
uccuguccacuggacuccug

SEQ ID NO: 16391 - RNA, 20 nt, Artificial Sequence
  targeting sequence with CTCN PAM
cuccuccuguccacuggacu

SEQ ID NO: 16392 - RNA, 20 nt, Artificial Sequence
  targeting sequence with CTCN PAM
acacucccuccuccugucca

SEQ ID NO: 16393 - RNA, 20 nt, Artificial Sequence
  targeting sequence with CTCN PAM
ucccagccaggcuucccuug

SEQ ID NO: 16394 - RNA, 20 nt, Artificial Sequence
  targeting sequence with CTCN PAM
uuccugugccucuucccagc

SEQ ID NO: 16395 - RNA, 20 nt, Artificial Sequence
  targeting sequence with CTCN PAM
ccuuccugugccucuuccca

SEQ ID NO: 16396 - RNA, 20 nt, Artificial Sequence
  targeting sequence with CTCN PAM
cuccuuccugugccucuucc

SEQ ID NO: 16397 - RNA, 20 nt, Artificial Sequence
  targeting sequence with CTCN PAM
ccuuuucaagguggggcaga

SEQ ID NO: 16398 - RNA, 20 nt, Artificial Sequence
  targeting sequence with CTCN PAM
ccccuuuucaagguggggca

SEQ ID NO: 16399 - RNA, 20 nt, Artificial Sequence
  targeting sequence with CTCN PAM
cuugauguuuaacaguccau

SEQ ID NO: 16400 - RNA, 20 nt, Artificial Sequence
  targeting sequence with CTCN PAM
gcucacuugauguuuaacag

SEQ ID NO: 16401 - RNA, 20 nt, Artificial Sequence
  targeting sequence with CTCN PAM
acugucauucucugcucacu

SEQ ID NO: 16402 - RNA, 20 nt, Artificial Sequence
  targeting sequence with CTCN PAM
aacccuucuccccguggcag

SEQ ID NO: 16403 - RNA, 20 nt, Artificial Sequence
  targeting sequence with CTCN PAM
ccguggcaggccagggcaag

SEQ ID NO: 16404 - RNA, 20 nt, Artificial Sequence
  targeting sequence with CTCN PAM
agggacccuauaggcuggca

SEQ ID NO: 16405 - RNA, 20 nt, Artificial Sequence
  targeting sequence with CTCN PAM
gagaggucgaguugccuuga

SEQ ID NO: 16406 - RNA, 20 nt, Artificial Sequence
  targeting sequence with CTCN PAM
gagcccugccagccuauagg

SEQ ID NO: 16407 - RNA, 20 nt, Artificial Sequence
  targeting sequence with CTCN PAM
cugagcccugccagccuaua

SEQ ID NO: 16408 - RNA, 20 nt, Artificial Sequence
  targeting sequence with CTCN PAM
accucucugagcccugccag

SEQ ID NO: 16409 - RNA, 20 nt, Artificial Sequence
  targeting sequence with CTCN PAM
aggcaacucgaccucucuga

SEQ ID NO: 16410 - RNA, 20 nt, Artificial Sequence
  targeting sequence with CTCN PAM
ggcucgggcugaccuugggg

SEQ ID NO: 16411 - RNA, 20 nt, Artificial Sequence
  targeting sequence with CTCN PAM
ggcugaccuuggggaagaag

SEQ ID NO: 16412 - RNA, 20 nt, Artificial Sequence
  targeting sequence with CTCN PAM
aggaaggggaugcccuggcu

SEQ ID NO: 16413 - RNA, 20 nt, Artificial Sequence
  targeting sequence with CTCN PAM
uuggugagaucugucauguc

SEQ ID NO: 16414 - RNA, 20 nt, Artificial Sequence
  targeting sequence with CTCN PAM
ccaaggagcugaaccgcagc

SEQ ID NO: 16415 - RNA, 20 nt, Artificial Sequence
  targeting sequence with CTCN PAM
gcgaagccuggcggacacac

SEQ ID NO: 16416 - RNA, 20 nt, Artificial Sequence
  targeting sequence with CTCN PAM
cggcuguccguguguccgcc

SEQ ID NO: 16417 - RNA, 20 nt, Artificial Sequence
  targeting sequence with CTCN PAM
ggccgcucacggcuguccgu

SEQ ID NO: 16418 - RNA, 20 nt, Artificial Sequence
  targeting sequence with CTCN PAM
uaggggauggguucucgggc

SEQ ID NO: 16419 - RNA, 20 nt, Artificial Sequence
  targeting sequence with CTCN PAM
acuuucccuccuaggggaug

SEQ ID NO: 16420 - RNA, 20 nt, Artificial Sequence
  targeting sequence with CTCN PAM
cggaucugagauuccaucuc

SEQ ID NO: 16421 - RNA, 20 nt, Artificial Sequence
  targeting sequence with CTCN PAM
gaucugagauuccaucuccu

SEQ ID NO: 16422 - RNA, 20 nt, Artificial Sequence
  targeting sequence with CTCN PAM
gauccgagaggaaauccgca

SEQ ID NO: 16423 - RNA, 20 nt, Artificial Sequence
  targeting sequence with CTCN PAM
uccaucugcagcagcgucuu

SEQ ID NO: 16424 - RNA, 20 nt, Artificial Sequence
  targeting sequence with CTCN PAM
aucugcagcagcgucuucug

SEQ ID NO: 16425 - RNA, 20 nt, Artificial Sequence
  targeting sequence with CTCN PAM
gcacgucggcucuugguaca

SEQ ID NO: 16426 - RNA, 20 nt, Artificial Sequence
  targeting sequence with CTCN PAM
ugguacagaagacgaacagg

SEQ ID NO: 16427 - RNA, 20 nt, Artificial Sequence
  targeting sequence with CTCN PAM
acugcccgcagcccuguucg

SEQ ID NO: 16428 - RNA, 20 nt, Artificial Sequence
  targeting sequence with CTCN PAM
ccacugcccgcagcccuguu

SEQ ID NO: 16429 - RNA, 20 nt, Artificial Sequence
  targeting sequence with CTCN PAM
ggugcccuuuggaaagccuu

SEQ ID NO: 16430 - RNA, 20 nt, Artificial Sequence
  targeting sequence with CTCN PAM
gcuccagcuccucugggcag

SEQ ID NO: 16431 - RNA, 20 nt, Artificial Sequence
  targeting sequence with CTCN PAM
agcuccucugggcagggugu

SEQ ID NO: 16432 - RNA, 20 nt, Artificial Sequence
  targeting sequence with CTCN PAM
ucugggcagggugugggagg

SEQ ID NO: 16433 - RNA, 20 nt, Artificial Sequence
  targeting sequence with CTCN PAM
gggcagggugugggaggagg

SEQ ID NO: 16434 - RNA, 20 nt, Artificial Sequence
  targeting sequence with CTCN PAM
cacacccugcccagaggagc

SEQ ID NO: 16435 - RNA, 20 nt, Artificial Sequence
  targeting sequence with CTCN PAM
ucccacacccugcccagagg

SEQ ID NO: 16436 - RNA, 20 nt, Artificial Sequence
  targeting sequence with CTCN PAM
cuccugggcaggguuggggu

SEQ ID NO: 16437 - RNA, 20 nt, Artificial Sequence
  targeting sequence with CTCN PAM
ugggcaggguuggggugggg

SEQ ID NO: 16438 - RNA, 20 nt, Artificial Sequence
  targeting sequence with CTCN PAM
ccaccccccaccccaacccu

SEQ ID NO: 16439 - RNA, 20 nt, Artificial Sequence
  targeting sequence with CTCN PAM
ccgcaacuccccacccccca

SEQ ID NO: 16440 - RNA, 20 nt, Artificial Sequence
  targeting sequence with CTCN PAM
cccguggacagagggcuugg

SEQ ID NO: 16441 - RNA, 20 nt, Artificial Sequence
  targeting sequence with CTCN PAM
cguggacagagggcuugggg

SEQ ID NO: 16442 - RNA, 20 nt, Artificial Sequence
  targeting sequence with CTCN PAM
guccacgggagagcuccccg

SEQ ID NO: 16443 - RNA, 20 nt, Artificial Sequence
  targeting sequence with CTCN PAM
guuagaauuugucuagcccc

SEQ ID NO: 16444 - RNA, 20 nt, Artificial Sequence
  targeting sequence with CTCN PAM
cacccaggaaagccacuguu

SEQ ID NO: 16445 - RNA, 20 nt, Artificial Sequence
  targeting sequence with CTCN PAM
aaagcagaaaguaaaccgaa

SEQ ID NO: 16446 - RNA, 20 nt, Artificial Sequence
  targeting sequence with CTCN PAM
agugagccacccaccuuggc

SEQ ID NO: 16447 - RNA, 20 nt, Artificial Sequence
  targeting sequence with CTCN PAM
cuugagcccaggaguucaag

SEQ ID NO: 16448 - RNA, 20 nt, Artificial Sequence
  targeting sequence with CTCN PAM
caaagugcugggacuacagg

SEQ ID NO: 16449 - RNA, 20 nt, Artificial Sequence
  targeting sequence with CTCN PAM
guggcuuaugccuguagucc

SEQ ID NO: 16450 - RNA, 20 nt, Artificial Sequence
  targeting sequence with CTCN PAM
gugaauauacuagaaaccau

SEQ ID NO: 16451 - RNA, 20 nt, Artificial Sequence
  targeting sequence with CTCN PAM
aaaauuaguggugaugguug

SEQ ID NO: 16452 - RNA, 20 nt, Artificial Sequence
  targeting sequence with CTCN PAM
ccauucguguucucccuagu

SEQ ID NO: 16453 - RNA, 20 nt, Artificial Sequence
  targeting sequence with CTCN PAM
cuagucccuggcaaucacca

SEQ ID NO: 16454 - RNA, 20 nt, Artificial Sequence
  targeting sequence with CTCN PAM
augaauuucccuauucuaaa

SEQ ID NO: 16455 - RNA, 20 nt, Artificial Sequence
  targeting sequence with CTCN PAM
ggaaaaauuaaccuacaugu

SEQ ID NO: 16456 - RNA, 20 nt, Artificial Sequence
  targeting sequence with CTCN PAM
cuuaaguaccuucaguagcu

SEQ ID NO: 16457 - RNA, 20 nt, Artificial Sequence
  targeting sequence with CTCN PAM
uaaguaccuucaguagcucu

SEQ ID NO: 16458 - RNA, 20 nt, Artificial Sequence
  targeting sequence with CTCN PAM
cuauugacuggagaacaugg

SEQ ID NO: 16459 - RNA, 20 nt, Artificial Sequence
  targeting sequence with CTCN PAM
auugacuggagaacaugguu

SEQ ID NO: 16460 - RNA, 20 nt, Artificial Sequence
  targeting sequence with CTCN PAM
agucaauagagagcuacuga

SEQ ID NO: 16461 - RNA, 20 nt, Artificial Sequence
  targeting sequence with CTCN PAM
gcuugagauucagggaccug

SEQ ID NO: 16462 - RNA, 20 nt, Artificial Sequence
  targeting sequence with CTCN PAM
agcagagaaauuuggaacca

SEQ ID NO: 16463 - RNA, 20 nt, Artificial Sequence
  targeting sequence with CTCN PAM
agcaccaauggguagaagau

SEQ ID NO: 16464 - RNA, 20 nt, Artificial Sequence
  targeting sequence with CTCN PAM
cccaaccucugggugccuaa

SEQ ID NO: 16465 - RNA, 20 nt, Artificial Sequence
  targeting sequence with CTCN PAM
gggugccuaaccuguuccca

SEQ ID NO: 16466 - RNA, 20 nt, Artificial Sequence
  targeting sequence with CTCN PAM
caucugccaaucuucagagg

SEQ ID NO: 16467 - RNA, 20 nt, Artificial Sequence
  targeting sequence with CTCN PAM
gaagauuggcagaugggaga

SEQ ID NO: 16468 - RNA, 20 nt, Artificial Sequence
  targeting sequence with CTCN PAM
aagguguccugagggugggg

SEQ ID NO: 16469 - RNA, 20 nt, Artificial Sequence
  targeting sequence with CTCN PAM
ggacaccuuggagggcaggc

SEQ ID NO: 16470 - RNA, 20 nt, Artificial Sequence
  targeting sequence with CTCN PAM
uuacccaccacggagagcag

SEQ ID NO: 16471 - RNA, 20 nt, Artificial Sequence
  targeting sequence with CTCN PAM
gugguggguaaggagcccca

SEQ ID NO: 16472 - RNA, 20 nt, Artificial Sequence
  targeting sequence with CTCN PAM
ccgugguggguaaggagccc

SEQ ID NO: 16473 - RNA, 20 nt, Artificial Sequence
  targeting sequence with CTCN PAM
cugccccccagcugcagugu

SEQ ID NO: 16474 - RNA, 20 nt, Artificial Sequence
  targeting sequence with CTCN PAM
gcacagauccagguagggaa

SEQ ID NO: 16475 - RNA, 20 nt, Artificial Sequence
  targeting sequence with CTCN PAM
aguucugcuccucacuugcu

SEQ ID NO: 16476 - RNA, 20 nt, Artificial Sequence
  targeting sequence with CTCN PAM
ucacuugcuguguggcccug

SEQ ID NO: 16477 - RNA, 20 nt, Artificial Sequence
  targeting sequence with CTCN PAM
cuugcuguguggcccugggu

SEQ ID NO: 16478 - RNA, 20 nt, Artificial Sequence
  targeting sequence with CTCN PAM
cugagccucaggugccacac

SEQ ID NO: 16479 - RNA, 20 nt, Artificial Sequence
  targeting sequence with CTCN PAM
gagccucaggugccacacug

SEQ ID NO: 16480 - RNA, 20 nt, Artificial Sequence
  targeting sequence with CTCN PAM
gagagguuagguaauuuacc

SEQ ID NO: 16481 - RNA, 20 nt, Artificial Sequence
  targeting sequence with CTCN PAM
ggugccacacugauaacaua

SEQ ID NO: 16482 - RNA, 20 nt, Artificial Sequence
  targeting sequence with CTCN PAM
auguuaucaguguggcaccu

SEQ ID NO: 16483 - RNA, 20 nt, Artificial Sequence
  targeting sequence with CTCN PAM
uggggacacugggaaggcua

SEQ ID NO: 16484 - RNA, 20 nt, Artificial Sequence
  targeting sequence with CTCN PAM
uuuagccuucccaguguccc

SEQ ID NO: 16485 - RNA, 20 nt, Artificial Sequence
  targeting sequence with CTCN PAM
gugccaggcccaggaccaag

SEQ ID NO: 16486 - RNA, 20 nt, Artificial Sequence
  targeting sequence with CTCN PAM
augcagggggcugugauuau

SEQ ID NO: 16487 - RNA, 20 nt, Artificial Sequence
  targeting sequence with CTCN PAM
caggcuguaaugauaaucac

SEQ ID NO: 16488 - RNA, 20 nt, Artificial Sequence
  targeting sequence with CTCN PAM
ucccaggcuguaaugauaau

SEQ ID NO: 16489 - RNA, 20 nt, Artificial Sequence
  targeting sequence with CTCN PAM
cuacuccucccaggcuguaa

SEQ ID NO: 16490 - RNA, 20 nt, Artificial Sequence
  targeting sequence with CTCN PAM
cucacuacuccucccaggcu

SEQ ID NO: 16491 - RNA, 20 nt, Artificial Sequence
  targeting sequence with CTCN PAM
ugcucacucacuacuccucc

SEQ ID NO: 16492 - RNA, 20 nt, Artificial Sequence
  targeting sequence with CTCN PAM
ccuacccccuggucccaggg

SEQ ID NO: 16493 - RNA, 20 nt, Artificial Sequence
  targeting sequence with CTCN PAM
uaccucaccuacccccuggu

SEQ ID NO: 16494 - RNA, 20 nt, Artificial Sequence
  targeting sequence with CTCN PAM
gagugcaggacugggacuga

SEQ ID NO: 16495 - RNA, 20 nt, Artificial Sequence
  targeting sequence with CTCN PAM
gaguccucauaccucaccua

SEQ ID NO: 16496 - RNA, 20 nt, Artificial Sequence
  targeting sequence with CTCN PAM
gucccaguccugcacucuga

SEQ ID NO: 16497 - RNA, 20 nt, Artificial Sequence
  targeting sequence with CTCN PAM
gacugggaaagcuuucuuuc

SEQ ID NO: 16498 - RNA, 20 nt, Artificial Sequence
  targeting sequence with CTCN PAM
caagcagcgugugccacccc

SEQ ID NO: 16499 - RNA, 20 nt, Artificial Sequence
  targeting sequence with CTCN PAM
cccaagcagcgugugccacc

SEQ ID NO: 16500 - RNA, 20 nt, Artificial Sequence
  targeting sequence with CTCN PAM
cucccaagcagcgugugcca

SEQ ID NO: 16501 - RNA, 20 nt, Artificial Sequence
  targeting sequence with CTCN PAM
cucucucccaagcagcgugu

SEQ ID NO: 16502 - RNA, 20 nt, Artificial Sequence
  targeting sequence with CTCN PAM
ccaucccaggagacaugcaa

SEQ ID NO: 16503 - RNA, 20 nt, Artificial Sequence
  targeting sequence with CTCN PAM
ugggauggggagcucacucu

SEQ ID NO: 16504 - RNA, 20 nt, Artificial Sequence
  targeting sequence with CTCN PAM
uugcaugucuccugggaugg

SEQ ID NO: 16505 - RNA, 20 nt, Artificial Sequence
  targeting sequence with CTCN PAM
cugcuccuccugcuccccug

SEQ ID NO: 16506 - RNA, 20 nt, Artificial Sequence
  targeting sequence with CTCN PAM
gcuccuccugcuccccugcc

SEQ ID NO: 16507 - RNA, 20 nt, Artificial Sequence
  targeting sequence with CTCN PAM
uccugcuccccugccucuac

SEQ ID NO: 16508 - RNA, 20 nt, Artificial Sequence
  targeting sequence with CTCN PAM
ugcuccccugccucuacaug

SEQ ID NO: 16509 - RNA, 20 nt, Artificial Sequence
  targeting sequence with CTCN PAM
ccugccucuacauggugccu

SEQ ID NO: 16510 - RNA, 20 nt, Artificial Sequence
  targeting sequence with CTCN PAM
acauggugccuggcagccca

SEQ ID NO: 16511 - RNA, 20 nt, Artificial Sequence
  targeting sequence with CTCN PAM
aggauagacgccaaggggga

SEQ ID NO: 16512 - RNA, 20 nt, Artificial Sequence
  targeting sequence with CTCN PAM
agcaagucacuaaguucuug

SEQ ID NO: 16513 - RNA, 20 nt, Artificial Sequence
  targeting sequence with CTCN PAM
guuuccucauaugucaagug

SEQ ID NO: 16514 - RNA, 20 nt, Artificial Sequence
  targeting sequence with CTCN PAM
uaugucaaguggggauguaa

SEQ ID NO: 16515 - RNA, 20 nt, Artificial Sequence
  targeting sequence with CTCN PAM
gcuuugcuggacugagcugu

SEQ ID NO: 16516 - RNA, 20 nt, Artificial Sequence
  targeting sequence with CTCN PAM
guccagcaaagcagagcuuu

SEQ ID NO: 16517 - RNA, 20 nt, Artificial Sequence
  targeting sequence with CTCN PAM
acagcucaguccagcaaagc

SEQ ID NO: 16518 - RNA, 20 nt, Artificial Sequence
  targeting sequence with CTCN PAM
gugaauucaggugcugggug

SEQ ID NO: 16519 - RNA, 20 nt, Artificial Sequence
  targeting sequence with CTCN PAM
cccagcaccugaauucacug

SEQ ID NO: 16520 - RNA, 20 nt, Artificial Sequence
  targeting sequence with CTCN PAM
ggcgccccauccacucacug

SEQ ID NO: 16521 - RNA, 20 nt, Artificial Sequence
  targeting sequence with CTCN PAM
cugugaugggcagcugcccc

SEQ ID NO: 16522 - RNA, 20 nt, Artificial Sequence
  targeting sequence with CTCN PAM
uugaccgagcaguggaugau

SEQ ID NO: 16523 - RNA, 20 nt, Artificial Sequence
  targeting sequence with CTCN PAM
gucaacgagucccugggcgc

SEQ ID NO: 16524 - RNA, 20 nt, Artificial Sequence
  targeting sequence with CTCN PAM
gacagaaucauccacugcuc

SEQ ID NO: 16525 - RNA, 20 nt, Artificial Sequence
  targeting sequence with CTCN PAM
ugacucuggagccccaggcu

SEQ ID NO: 16526 - RNA, 20 nt, Artificial Sequence
  targeting sequence with CTCN PAM
ggagccccaggcuguccugc

SEQ ID NO: 16527 - RNA, 20 nt, Artificial Sequence
  targeting sequence with CTCN PAM
agagucacgaguaccggguc

SEQ ID NO: 16528 - RNA, 20 nt, Artificial Sequence
  targeting sequence with CTCN PAM
uucugugggugcaaaggggg

SEQ ID NO: 16529 - RNA, 20 nt, Artificial Sequence
  targeting sequence with CTCN PAM
cccuuugcacccacagaagg

SEQ ID NO: 16530 - RNA, 20 nt, Artificial Sequence
  targeting sequence with CTCN PAM
uggggaagugcucccgaggc

SEQ ID NO: 16531 - RNA, 20 nt, Artificial Sequence
  targeting sequence with CTCN PAM
cgaggcccacagcugaggcu

SEQ ID NO: 16532 - RNA, 20 nt, Artificial Sequence
  targeting sequence with CTCN PAM
ggagcacuuccccaugagca

SEQ ID NO: 16533 - RNA, 20 nt, Artificial Sequence
  targeting sequence with CTCN PAM
gcugugggccucgggagcac

SEQ ID NO: 16534 - RNA, 20 nt, Artificial Sequence
  targeting sequence with CTCN PAM
cuugcccccgccuaccccgg

SEQ ID NO: 16535 - RNA, 20 nt, Artificial Sequence
  targeting sequence with CTCN PAM
cguggauaacgagggugaga

SEQ ID NO: 16536 - RNA, 20 nt, Artificial Sequence
  targeting sequence with CTCN PAM
uuauccacgugagcaccaaa

SEQ ID NO: 16537 - RNA, 20 nt, Artificial Sequence
  targeting sequence with CTCN PAM
cccucguuauccacgugagc

SEQ ID NO: 16538 - RNA, 20 nt, Artificial Sequence
  targeting sequence with CTCN PAM
cacccucguuauccacguga

SEQ ID NO: 16539 - RNA, 20 nt, Artificial Sequence
  targeting sequence with CTCN PAM
ccgggguggugcuugaucca

SEQ ID NO: 16540 - RNA, 20 nt, Artificial Sequence
  targeting sequence with CTCN PAM
cucuuggccguagagaacug

SEQ ID NO: 16541 - RNA, 20 nt, Artificial Sequence
  targeting sequence with CTCN PAM
uggccguagagaacuguggg

SEQ ID NO: 16542 - RNA, 20 nt, Artificial Sequence
  targeting sequence with CTCN PAM
acggccaagagggagaagug

SEQ ID NO: 16543 - RNA, 20 nt, Artificial Sequence
  targeting sequence with CTCN PAM
ccaacccacaguucucuacg

SEQ ID NO: 16544 - RNA, 20 nt, Artificial Sequence
  targeting sequence with CTCN PAM
ucgggguccaguagcuccuc

SEQ ID NO: 16545 - RNA, 20 nt, Artificial Sequence
  targeting sequence with CTCN PAM
ggguccaguagcuccucagc

SEQ ID NO: 16546 - RNA, 20 nt, Artificial Sequence
  targeting sequence with CTCN PAM
ucagccacagccaccucguc

SEQ ID NO: 16547 - RNA, 20 nt, Artificial Sequence
  targeting sequence with CTCN PAM
gccacagccaccucgucugc

SEQ ID NO: 16548 - RNA, 20 nt, Artificial Sequence
  targeting sequence with CTCN PAM
ucugcguaggcccgcccauu

SEQ ID NO: 16549 - RNA, 20 nt, Artificial Sequence
  targeting sequence with CTCN PAM
gggccccgggggacgggcag

SEQ ID NO: 16550 - RNA, 20 nt, Artificial Sequence
  targeting sequence with CTCN PAM
ucaccugcccgucccccggg

SEQ ID NO: 16551 - RNA, 20 nt, Artificial Sequence
  targeting sequence with CTCN PAM
acccucaucaccugcccguc

SEQ ID NO: 16552 - RNA, 20 nt, Artificial Sequence
  targeting sequence with CTCN PAM
acuccacccucaucaccugc

SEQ ID NO: 16553 - RNA, 20 nt, Artificial Sequence
  targeting sequence with CTCN PAM
gcaagguucucaacuccacc

SEQ ID NO: 16554 - RNA, 20 nt, Artificial Sequence
  targeting sequence with CTCN PAM
ugcaccagcucugcaagguu

SEQ ID NO: 16555 - RNA, 20 nt, Artificial Sequence
  targeting sequence with CTCN PAM
ccugcaccagcucugcaagg

SEQ ID NO: 16556 - RNA, 20 nt, Artificial Sequence
  targeting sequence with CTCN PAM
augcccaucuguccauccug

SEQ ID NO: 16557 - RNA, 20 nt, Artificial Sequence
  targeting sequence with CTCN PAM
ccaccguuucuccaugccca

SEQ ID NO: 16558 - RNA, 20 nt, Artificial Sequence
  targeting sequence with CTCN PAM
aaccccacuccccaccguuu

SEQ ID NO: 16559 - RNA, 20 nt, Artificial Sequence
  targeting sequence with CTCN PAM
ucaaaccccacuccccaccg

SEQ ID NO: 16560 - RNA, 20 nt, Artificial Sequence
  targeting sequence with CTCN PAM
gugucuccucaaaccccacu

SEQ ID NO: 16561 - RNA, 20 nt, Artificial Sequence
  targeting sequence with CTCN PAM
gccucugugucuccucaaac

SEQ ID NO: 16562 - RNA, 20 nt, Artificial Sequence
  targeting sequence with CTCN PAM
cucugccucugugucuccuc

SEQ ID NO: 16563 - RNA, 20 nt, Artificial Sequence
  targeting sequence with CTCN PAM
uccucccucugccucugugu

SEQ ID NO: 16564 - RNA, 20 nt, Artificial Sequence
  targeting sequence with CTCN PAM
guccccucuuccucccucug

SEQ ID NO: 16565 - RNA, 20 nt, Artificial Sequence
  targeting sequence with CTCN PAM
cacugcaucucuguccccuc

SEQ ID NO: 16566 - RNA, 20 nt, Artificial Sequence
  targeting sequence with CTCN PAM
ucccacugcaucucuguccc

SEQ ID NO: 16567 - RNA, 20 nt, Artificial Sequence
  targeting sequence with CTCN PAM
cacccaucaggcccccgaau

SEQ ID NO: 16568 - RNA, 20 nt, Artificial Sequence
  targeting sequence with CTCN PAM
ccgugggcucccggccaaug

SEQ ID NO: 16569 - RNA, 20 nt, Artificial Sequence
  targeting sequence with CTCN PAM
cggccaaugugguggacggc

SEQ ID NO: 16570 - RNA, 20 nt, Artificial Sequence
  targeting sequence with CTCN PAM
ccagccacugugaugguccu

SEQ ID NO: 16571 - RNA, 20 nt, Artificial Sequence
  targeting sequence with CTCN PAM
ggggcugcaggugcacugau

SEQ ID NO: 16572 - RNA, 20 nt, Artificial Sequence
  targeting sequence with CTCN PAM
cuggggcugcaggugcacug

SEQ ID NO: 16573 - RNA, 20 nt, Artificial Sequence
  targeting sequence with CTCN PAM
ccugacagggcugcggcggg

SEQ ID NO: 16574 - RNA, 20 nt, Artificial Sequence
  targeting sequence with CTCN PAM
ccuucugguacaugcagaac

SEQ ID NO: 16575 - RNA, 20 nt, Artificial Sequence
  targeting sequence with CTCN PAM
aagcgcacacacacaggcac

SEQ ID NO: 16576 - RNA, 20 nt, Artificial Sequence
  targeting sequence with CTCN PAM
ggugccugugugugugcgcu

SEQ ID NO: 16577 - RNA, 20 nt, Artificial Sequence
  targeting sequence with CTCN PAM
ggcauggugcaggcgaugcu

SEQ ID NO: 16578 - RNA, 20 nt, Artificial Sequence
  targeting sequence with CTCN PAM
ccccaggcgcacagauacca

SEQ ID NO: 16579 - RNA, 20 nt, Artificial Sequence
  targeting sequence with CTCN PAM
cccaccgccaaugccccuga

SEQ ID NO: 16580 - RNA, 20 nt, Artificial Sequence
  targeting sequence with CTCN PAM
ggggcauuggcgguggguga

SEQ ID NO: 16581 - RNA, 20 nt, Artificial Sequence
  targeting sequence with CTCN PAM
uugacuggucccaacucauc

SEQ ID NO: 16582 - RNA, 20 nt, Artificial Sequence
  targeting sequence with CTCN PAM
ucuucugcccaguuagugcc

SEQ ID NO: 16583 - RNA, 20 nt, Artificial Sequence
  targeting sequence with CTCN PAM
uccaggaagccuucccaggu

SEQ ID NO: 16584 - RNA, 20 nt, Artificial Sequence
  targeting sequence with CTCN PAM
aggaagccuucccaggucuu

SEQ ID NO: 16585 - RNA, 20 nt, Artificial Sequence
  targeting sequence with CTCN PAM
cccgccuccaacccugguga

SEQ ID NO: 16586 - RNA, 20 nt, Artificial Sequence
  targeting sequence with CTCN PAM
cgccuccaacccuggugaag

SEQ ID NO: 16587 - RNA, 20 nt, Artificial Sequence
  targeting sequence with CTCN PAM
aacccuggugaagucucucu

SEQ ID NO: 16588 - RNA, 20 nt, Artificial Sequence
  targeting sequence with CTCN PAM
cuccccagaucccugaaggc

SEQ ID NO: 16589 - RNA, 20 nt, Artificial Sequence
  targeting sequence with CTCN PAM
ccccagaucccugaaggcac

SEQ ID NO: 16590 - RNA, 20 nt, Artificial Sequence
  targeting sequence with CTCN PAM
ccagaucccugaaggcacug

SEQ ID NO: 16591 - RNA, 20 nt, Artificial Sequence
  targeting sequence with CTCN PAM
caauccuagccccacuggau

SEQ ID NO: 16592 - RNA, 20 nt, Artificial Sequence
  targeting sequence with CTCN PAM
agggaagggcagacauaccc

SEQ ID NO: 16593 - RNA, 20 nt, Artificial Sequence
  targeting sequence with CTCN PAM
ucuuggugucccagcaaugc

SEQ ID NO: 16594 - RNA, 20 nt, Artificial Sequence
  targeting sequence with CTCN PAM
uggugucccagcaaugccca

SEQ ID NO: 16595 - RNA, 20 nt, Artificial Sequence
  targeting sequence with CTCN PAM
aaccacaccccugccacuca

SEQ ID NO: 16596 - RNA, 20 nt, Artificial Sequence
  targeting sequence with CTCN PAM
ccacaccccugggccagcca

SEQ ID NO: 16597 - RNA, 20 nt, Artificial Sequence
  targeting sequence with CTCN PAM
uuacagcuaucacuuaugga

SEQ ID NO: 16598 - RNA, 20 nt, Artificial Sequence
  targeting sequence with CTCN PAM
auaagugauagcuguaauga

SEQ ID NO: 16599 - RNA, 20 nt, Artificial Sequence
  targeting sequence with CTCN PAM
gcugguaagaauaguaccag

SEQ ID NO: 16600 - RNA, 20 nt, Artificial Sequence
  targeting sequence with CTCN PAM
guuuccucagcugguaagaa

SEQ ID NO: 16601 - RNA, 20 nt, Artificial Sequence
  targeting sequence with CTCN PAM
gagaggagaaggggcuuggc

SEQ ID NO: 16602 - RNA, 20 nt, Artificial Sequence
  targeting sequence with CTCN PAM
gagccucaguuuccucagcu

SEQ ID NO: 16603 - RNA, 20 nt, Artificial Sequence
  targeting sequence with CTCN PAM
cugagccucaguuuccucag

SEQ ID NO: 16604 - RNA, 20 nt, Artificial Sequence
  targeting sequence with CTCN PAM
ucucugagccucaguuuccu

SEQ ID NO: 16605 - RNA, 20 nt, Artificial Sequence
  targeting sequence with CTCN PAM
ugggucuucauuggcugugu

SEQ ID NO: 16606 - RNA, 20 nt, Artificial Sequence
  targeting sequence with CTCN PAM
cuugggucuucauuggcugu

SEQ ID NO: 16607 - RNA, 20 nt, Artificial Sequence
  targeting sequence with CTCN PAM
aggaugucaccuccagcccg

SEQ ID NO: 16608 - RNA, 20 nt, Artificial Sequence
  targeting sequence with CTCN PAM
agcccgccagcccccaagcc

SEQ ID NO: 16609 - RNA, 20 nt, Artificial Sequence
  targeting sequence with CTCN PAM
gggcuggaagggaugggcca

SEQ ID NO: 16610 - RNA, 20 nt, Artificial Sequence
  targeting sequence with CTCN PAM
gggccuggcccaucccuucc

SEQ ID NO: 16611 - RNA, 20 nt, Artificial Sequence
  targeting sequence with CTCN PAM
gugcaggggucugugucguu

SEQ ID NO: 16612 - RNA, 20 nt, Artificial Sequence
  targeting sequence with CTCN PAM
agguccuggugaacgacaca

SEQ ID NO: 16613 - RNA, 20 nt, Artificial Sequence
  targeting sequence with CTCN PAM
gagccuacauggaggucauu

SEQ ID NO: 16614 - RNA, 20 nt, Artificial Sequence
  targeting sequence with CTCN PAM
gagcuccagguccuggugaa

SEQ ID NO: 16615 - RNA, 20 nt, Artificial Sequence
  targeting sequence with CTCN PAM
auguaggcuccgagcuccag

SEQ ID NO: 16616 - RNA, 20 nt, Artificial Sequence
  targeting sequence with CTCN PAM
agggaguggaccaggggcag

SEQ ID NO: 16617 - RNA, 20 nt, Artificial Sequence
  targeting sequence with CTCN PAM
cuggagccuaccaugggccc

SEQ ID NO: 16618 - RNA, 20 nt, Artificial Sequence
  targeting sequence with CTCN PAM
cacagcugccccugguccac

SEQ ID NO: 16619 - RNA, 20 nt, Artificial Sequence
  targeting sequence with CTCN PAM
ggccagcccccgggagugug

SEQ ID NO: 16620 - RNA, 20 nt, Artificial Sequence
  targeting sequence with CTCN PAM
cgggggcuggcccgaggccc

SEQ ID NO: 16621 - RNA, 20 nt, Artificial Sequence
  targeting sequence with CTCN PAM
uacgugguaagggggggcug

SEQ ID NO: 16622 - RNA, 20 nt, Artificial Sequence
  targeting sequence with CTCN PAM
uuagaggcguucacggucac

SEQ ID NO: 16623 - RNA, 20 nt, Artificial Sequence
  targeting sequence with CTCN PAM
aaggagggcaagucccggga

SEQ ID NO: 16624 - RNA, 20 nt, Artificial Sequence
  targeting sequence with CTCN PAM
gguguggugaccgugaacgc

SEQ ID NO: 16625 - RNA, 20 nt, Artificial Sequence
  targeting sequence with CTCN PAM
cagguguggugaccgugaac

SEQ ID NO: 16626 - RNA, 20 nt, Artificial Sequence
  targeting sequence with CTCN PAM
ggaucgugugugucacaggg

SEQ ID NO: 16627 - RNA, 20 nt, Artificial Sequence
  targeting sequence with CTCN PAM
ccucaggaucguguguguca

SEQ ID NO: 16628 - RNA, 20 nt, Artificial Sequence
  targeting sequence with CTCN PAM
aggguggccgugggggccaa

SEQ ID NO: 16629 - RNA, 20 nt, Artificial Sequence
  targeting sequence with CTCN PAM
gggaucgccccauuccacgc

SEQ ID NO: 16630 - RNA, 20 nt, Artificial Sequence
  targeting sequence with CTCN PAM
gaucaugagaacgucugcug

SEQ ID NO: 16631 - RNA, 20 nt, Artificial Sequence
  targeting sequence with CTCN PAM
ugaucagagacccuuuuguc

SEQ ID NO: 16632 - RNA, 20 nt, Artificial Sequence
  targeting sequence with CTCN PAM
uccacacgccugaugcacgg

SEQ ID NO: 16633 - RNA, 20 nt, Artificial Sequence
  targeting sequence with CTCN PAM
caaaaggaaagccaguucag

SEQ ID NO: 16634 - RNA, 20 nt, Artificial Sequence
  targeting sequence with CTCN PAM
gcucacgcguauuuccuacg

SEQ ID NO: 16635 - RNA, 20 nt, Artificial Sequence
  targeting sequence with CTCN PAM
cgcguauuuccuacggcccc

SEQ ID NO: 16636 - RNA, 20 nt, Artificial Sequence
  targeting sequence with CTCN PAM
gggccagucacagaucucua

SEQ ID NO: 16637 - RNA, 20 nt, Artificial Sequence
  targeting sequence with CTCN PAM
aaaccaugccaguagcccca

SEQ ID NO: 16638 - RNA, 20 nt, Artificial Sequence
  targeting sequence with CTCN PAM
gagcaaggcuuagguggaag

SEQ ID NO: 16639 - RNA, 20 nt, Artificial Sequence
  targeting sequence with CTCN PAM
gaggaaaaucauuugcaauu

SEQ ID NO: 16640 - RNA, 20 nt, Artificial Sequence
  targeting sequence with CTCN PAM
caggcugcccuagcacagcc

SEQ ID NO: 16641 - RNA, 20 nt, Artificial Sequence
  targeting sequence with CTCN PAM
gggaagcccucacaggcugc

SEQ ID NO: 16642 - RNA, 20 nt, Artificial Sequence
  targeting sequence with CTCN PAM
ucugggaagcccucacaggc

SEQ ID NO: 16643 - RNA, 20 nt, Artificial Sequence
  targeting sequence with CTCN PAM
gaugcccacuccucugggaa

SEQ ID NO: 16644 - RNA, 20 nt, Artificial Sequence
  targeting sequence with CTCN PAM
ggcucugaugcccacuccuc

SEQ ID NO: 16645 - RNA, 20 nt, Artificial Sequence
  targeting sequence with CTCN PAM
agcucuggcucugaugccca

SEQ ID NO: 16646 - RNA, 20 nt, Artificial Sequence
  targeting sequence with CTCN PAM
aggccugugccgaagccauu

SEQ ID NO: 16647 - RNA, 20 nt, Artificial Sequence
  targeting sequence with CTCN PAM
gcugcuuucuggaagacugu

SEQ ID NO: 16648 - RNA, 20 nt, Artificial Sequence
  targeting sequence with CTCN PAM
cucugcugcuuucuggaaga

SEQ ID NO: 16649 - RNA, 20 nt, Artificial Sequence
  targeting sequence with CTCN PAM
guccucacucugcugcuuuc

SEQ ID NO: 16650 - RNA, 20 nt, Artificial Sequence
  targeting sequence with CTCN PAM
ccauccucuguccucacucu

SEQ ID NO: 16651 - RNA, 20 nt, Artificial Sequence
  targeting sequence with CTCN PAM
cuccccauccucuguccuca

SEQ ID NO: 16652 - RNA, 20 nt, Artificial Sequence
  targeting sequence with CTCN PAM
ucccuccccauccucugucc

SEQ ID NO: 16653 - RNA, 20 nt, Artificial Sequence
  targeting sequence with CTCN PAM
cuccucccuccccauccucu

SEQ ID NO: 16654 - RNA, 20 nt, Artificial Sequence
  targeting sequence with CTCN PAM
ucacuccucccuccccaucc

SEQ ID NO: 16655 - RNA, 20 nt, Artificial Sequence
  targeting sequence with CTCN PAM
guccuccucacuccucccuc

SEQ ID NO: 16656 - RNA, 20 nt, Artificial Sequence
  targeting sequence with CTCN PAM
gcucuguccuccucacuccu

SEQ ID NO: 16657 - RNA, 20 nt, Artificial Sequence
  targeting sequence with CTCN PAM
agcagugccagccucugcuc

SEQ ID NO: 16658 - RNA, 20 nt, Artificial Sequence
  targeting sequence with CTCN PAM
cuccuccgacaccguguauc

SEQ ID NO: 16659 - RNA, 20 nt, Artificial Sequence
  targeting sequence with CTCN PAM
uccgacaccguguaucuguc

SEQ ID NO: 16660 - RNA, 20 nt, Artificial Sequence
  targeting sequence with CTCN PAM
gacaccguguaucugucagg

SEQ ID NO: 16661 - RNA, 20 nt, Artificial Sequence
  targeting sequence with CTCN PAM
caggccacaccaccaaucca

SEQ ID NO: 16662 - RNA, 20 nt, Artificial Sequence
  targeting sequence with CTCN PAM
gugacguggcccacggcgug

SEQ ID NO: 16663 - RNA, 20 nt, Artificial Sequence
  targeting sequence with CTCN PAM
gauggucagcagggucccac

SEQ ID NO: 16664 - RNA, 20 nt, Artificial Sequence
  targeting sequence with CTCN PAM
ggggcucaaucugccaggug

SEQ ID NO: 16665 - RNA, 20 nt, Artificial Sequence
  targeting sequence with CTCN PAM
aucugccaggugacccgaga

SEQ ID NO: 16666 - RNA, 20 nt, Artificial Sequence
  targeting sequence with CTCN PAM
ggucaccuggcagauugagc

SEQ ID NO: 16667 - RNA, 20 nt, Artificial Sequence
  targeting sequence with CTCN PAM
cgggucaccuggcagauuga

SEQ ID NO: 16668 - RNA, 20 nt, Artificial Sequence
  targeting sequence with CTCN PAM
cucgggucaccuggcagauu

SEQ ID NO: 16669 - RNA, 20 nt, Artificial Sequence
  targeting sequence with CTCN PAM
gaucccauucgccccucucu

SEQ ID NO: 16670 - RNA, 20 nt, Artificial Sequence
  targeting sequence with CTCN PAM
aagcagugggucugcacggc

SEQ ID NO: 16671 - RNA, 20 nt, Artificial Sequence
  targeting sequence with CTCN PAM
agaccuuccucuaagcagug

SEQ ID NO: 16672 - RNA, 20 nt, Artificial Sequence
  targeting sequence with CTCN PAM
gguggggcugggacuguggc

SEQ ID NO: 16673 - RNA, 20 nt, Artificial Sequence
  targeting sequence with CTCN PAM
uugccagcacagugaccugc

SEQ ID NO: 16674 - RNA, 20 nt, Artificial Sequence
  targeting sequence with CTCN PAM
guaaugcacacccacauccu

SEQ ID NO: 16675 - RNA, 20 nt, Artificial Sequence
  targeting sequence with CTCN PAM
uggaggaugcugaggucagc

SEQ ID NO: 16676 - RNA, 20 nt, Artificial Sequence
  targeting sequence with CTCN PAM
aggagacccccuaaguagcg

SEQ ID NO: 16677 - RNA, 20 nt, Artificial Sequence
  targeting sequence with CTCN PAM
gcauccuccaggagaccccc

SEQ ID NO: 16678 - RNA, 20 nt, Artificial Sequence
  targeting sequence with CTCN PAM
uggaagcugaccucagcauc

SEQ ID NO: 16679 - RNA, 20 nt, Artificial Sequence
  targeting sequence with CTCN PAM
gugucuccuccacgccacac

SEQ ID NO: 16680 - RNA, 20 nt, Artificial Sequence
  targeting sequence with CTCN PAM
ggcacggcgcaugcgcagug

SEQ ID NO: 16681 - RNA, 20 nt, Artificial Sequence
  targeting sequence with CTCN PAM
acugggcaugcuuaccgcgu

SEQ ID NO: 16682 - RNA, 20 nt, Artificial Sequence
  targeting sequence with CTCN PAM
ggggcggggcaggugccagc

SEQ ID NO: 16683 - RNA, 20 nt, Artificial Sequence
  targeting sequence with CTCN PAM
gcagcccauggcuggcaccu

SEQ ID NO: 16684 - RNA, 20 nt, Artificial Sequence
  targeting sequence with CTCN PAM
acaugcacaggugacccagg

SEQ ID NO: 16685 - RNA, 20 nt, Artificial Sequence
  targeting sequence with CTCN PAM
ccagucauggucuauaacug

SEQ ID NO: 16686 - RNA, 20 nt, Artificial Sequence
  targeting sequence with CTCN PAM
gucagccccgcucugcggug

SEQ ID NO: 16687 - RNA, 20 nt, Artificial Sequence
  targeting sequence with CTCN PAM
gcggugcaugccccaacacc

SEQ ID NO: 16688 - RNA, 20 nt, Artificial Sequence
  targeting sequence with CTCN PAM
gggccucagugcagugggug

SEQ ID NO: 16689 - RNA, 20 nt, Artificial Sequence
  targeting sequence with CTCN PAM
gggcuguccaggaaucgggc

SEQ ID NO: 16690 - RNA, 20 nt, Artificial Sequence
  targeting sequence with CTCN PAM
aacuaaaggggcggccagcc

SEQ ID NO: 16691 - RNA, 20 nt, Artificial Sequence
  targeting sequence with CTCN PAM
gccuccaacuaaaggggcgg

SEQ ID NO: 16692 - RNA, 20 nt, Artificial Sequence
  targeting sequence with CTCN PAM
uccgggucgugugcagcugc

SEQ ID NO: 16693 - RNA, 20 nt, Artificial Sequence
  targeting sequence with CTCN PAM
uuucugcccuuuugcagcug

SEQ ID NO: 16694 - RNA, 20 nt, Artificial Sequence
  targeting sequence with CTCN PAM
gcccaugcuggagucacccc

SEQ ID NO: 16695 - RNA, 20 nt, Artificial Sequence
  targeting sequence with CTCN PAM
agcaugggcggagggcgggc

SEQ ID NO: 16696 - RNA, 20 nt, Artificial Sequence
  targeting sequence with CTCN PAM
ccaccaccuggucacagcgu

SEQ ID NO: 16697 - RNA, 20 nt, Artificial Sequence
  targeting sequence with CTCN PAM
uucacccacacagccucgaa

SEQ ID NO: 16698 - RNA, 20 nt, Artificial Sequence
  targeting sequence with CTCN PAM
aagaucuccuccagcccaaa

SEQ ID NO: 16699 - RNA, 20 nt, Artificial Sequence
  targeting sequence with CTCN PAM
uccagcccaaaacuacacuc

SEQ ID NO: 16700 - RNA, 20 nt, Artificial Sequence
  targeting sequence with CTCN PAM
agcccaaaacuacacuccag

SEQ ID NO: 16701 - RNA, 20 nt, Artificial Sequence
  targeting sequence with CTCN PAM
agggcugcacccugugggaa

SEQ ID NO: 16702 - RNA, 20 nt, Artificial Sequence
  targeting sequence with CTCN PAM
cuguuucccacagggugcag

SEQ ID NO: 16703 - RNA, 20 nt, Artificial Sequence
  targeting sequence with CTCN PAM
cacucccuguuucccacagg

SEQ ID NO: 16704 - RNA, 20 nt, Artificial Sequence
  targeting sequence with CTCN PAM
aacccgccucccacucccug

SEQ ID NO: 16705 - RNA, 20 nt, Artificial Sequence
  targeting sequence with CTCN PAM
ucaaacccgccucccacucc

SEQ ID NO: 16706 - RNA, 20 nt, Artificial Sequence
  targeting sequence with CTCN PAM
acacagccuucaggauccag

SEQ ID NO: 16707 - RNA, 20 nt, Artificial Sequence
  targeting sequence with CTCN PAM
ggagcagcaccaauacauau

SEQ ID NO: 16708 - RNA, 20 nt, Artificial Sequence
  targeting sequence with CTCN PAM
ugagaaggccagaugagccu

SEQ ID NO: 16709 - RNA, 20 nt, Artificial Sequence
  targeting sequence with CTCN PAM
gcaaauauguauuggugcug

SEQ ID NO: 16710 - RNA, 20 nt, Artificial Sequence
  targeting sequence with CTCN PAM
gguuuuguguauuacgccaa

SEQ ID NO: 16711 - RNA, 20 nt, Artificial Sequence
  targeting sequence with CTCN PAM
gccacgcagcuggcugggug

SEQ ID NO: 16712 - RNA, 20 nt, Artificial Sequence
  targeting sequence with CTCN PAM
uggcaggggcuggagcucug

SEQ ID NO: 16713 - RNA, 20 nt, Artificial Sequence
  targeting sequence with CTCN PAM
cacgggccucagcuccucca

SEQ ID NO: 16714 - RNA, 20 nt, Artificial Sequence
  targeting sequence with CTCN PAM
cgggccucagcuccuccaug

SEQ ID NO: 16715 - RNA, 20 nt, Artificial Sequence
  targeting sequence with CTCN PAM
gcuccuccauggaaguaaca

SEQ ID NO: 16716 - RNA, 20 nt, Artificial Sequence
  targeting sequence with CTCN PAM
uccauggaaguaacagaugg

SEQ ID NO: 16717 - RNA, 20 nt, Artificial Sequence
  targeting sequence with CTCN PAM
auggaaguaacagauggcga

SEQ ID NO: 16718 - RNA, 20 nt, Artificial Sequence
  targeting sequence with CTCN PAM
ccaucuguuacuuccaugga

SEQ ID NO: 16719 - RNA, 20 nt, Artificial Sequence
  targeting sequence with CTCN PAM
cuggaacucgccaucuguua

SEQ ID NO: 16720 - RNA, 20 nt, Artificial Sequence
  targeting sequence with CTCN PAM
ccaccucccuggaacucgcc

SEQ ID NO: 16721 - RNA, 20 nt, Artificial Sequence
  targeting sequence with CTCN PAM
aggacucgucaacgcuuccc

SEQ ID NO: 16722 - RNA, 20 nt, Artificial Sequence
  targeting sequence with CTCN PAM
ucaacgcuucccacccagga

SEQ ID NO: 16723 - RNA, 20 nt, Artificial Sequence
  targeting sequence with CTCN PAM
aggagggguccagaaaggag

SEQ ID NO: 16724 - RNA, 20 nt, Artificial Sequence
  targeting sequence with CTCN PAM
uggaggcgcguccugggugg

SEQ ID NO: 16725 - RNA, 20 nt, Artificial Sequence
  targeting sequence with CTCN PAM
uuucuggaccccuccuggag

SEQ ID NO: 16726 - RNA, 20 nt, Artificial Sequence
  targeting sequence with CTCN PAM
ucuuugcaacuagccccgcc

SEQ ID NO: 16727 - RNA, 20 nt, Artificial Sequence
  targeting sequence with CTCN PAM
ccaaccagugcucgucuuug

SEQ ID NO: 16728 - RNA, 20 nt, Artificial Sequence
  targeting sequence with CTCN PAM
ggacuccccaaccagugcuc

SEQ ID NO: 16729 - RNA, 20 nt, Artificial Sequence
  targeting sequence with CTCN PAM
uggccccacccggcgcuggc

SEQ ID NO: 16730 - RNA, 20 nt, Artificial Sequence
  targeting sequence with CTCN PAM
ggccaacacugccuuuuucc

SEQ ID NO: 16731 - RNA, 20 nt, Artificial Sequence
  targeting sequence with CTCN PAM
cagaacauccuggugccucu

SEQ ID NO: 16732 - RNA, 20 nt, Artificial Sequence
  targeting sequence with CTCN PAM
ccccuggcacccgugccuac

SEQ ID NO: 16733 - RNA, 20 nt, Artificial Sequence
  targeting sequence with CTCN PAM
caccccuggcacccgugccu

SEQ ID NO: 16734 - RNA, 20 nt, Artificial Sequence
  targeting sequence with CTCN PAM
ggacugcccccggacccugc

SEQ ID NO: 16735 - RNA, 20 nt, Artificial Sequence
  targeting sequence with CTCN PAM
gcagaggaaacagaaggaga

SEQ ID NO: 16736 - RNA, 20 nt, Artificial Sequence
  targeting sequence with CTCN PAM
gcagagcccucaggacugcc

SEQ ID NO: 16737 - RNA, 20 nt, Artificial Sequence
  targeting sequence with CTCN PAM
uucuguuuccucugcagagc

SEQ ID NO: 16738 - RNA, 20 nt, Artificial Sequence
  targeting sequence with CTCN PAM
ccuucuguuuccucugcaga

SEQ ID NO: 16739 - RNA, 20 nt, Artificial Sequence
  targeting sequence with CTCN PAM
aggcccagcuccucccuguc

SEQ ID NO: 16740 - RNA, 20 nt, Artificial Sequence
  targeting sequence with CTCN PAM
ucccugucucugggccucac

SEQ ID NO: 16741 - RNA, 20 nt, Artificial Sequence
  targeting sequence with CTCN PAM
cugucucugggccucaccuu

SEQ ID NO: 16742 - RNA, 20 nt, Artificial Sequence
  targeting sequence with CTCN PAM
gggccucaccuuucccaaua

SEQ ID NO: 16743 - RNA, 20 nt, Artificial Sequence
  targeting sequence with CTCN PAM
ccuuucccaauaguagaaca

SEQ ID NO: 16744 - RNA, 20 nt, Artificial Sequence
  targeting sequence with CTCN PAM
guuucuuauucuguacagug

SEQ ID NO: 16745 - RNA, 20 nt, Artificial Sequence
  targeting sequence with CTCN PAM
cccaggccucaguuucuuau

SEQ ID NO: 16746 - RNA, 20 nt, Artificial Sequence
  targeting sequence with CTCN PAM
gccccucccccaggccucag

SEQ ID NO: 16747 - RNA, 20 nt, Artificial Sequence
  targeting sequence with CTCN PAM
ggucucugccccucccccag

SEQ ID NO: 16748 - RNA, 20 nt, Artificial Sequence
  targeting sequence with CTCN PAM
gagcugggagguauggaccc

SEQ ID NO: 16749 - RNA, 20 nt, Artificial Sequence
  targeting sequence with CTCN PAM
gagcgaucacuaagguggac

SEQ ID NO: 16750 - RNA, 20 nt, Artificial Sequence
  targeting sequence with CTCN PAM
cagcucagagcgaucacuaa

SEQ ID NO: 16751 - RNA, 20 nt, Artificial Sequence
  targeting sequence with CTCN PAM
uauuuugucccaaggccuuu

SEQ ID NO: 16752 - RNA, 20 nt, Artificial Sequence
  targeting sequence with CTCN PAM
ucugguguagaauaaagaag

SEQ ID NO: 16753 - RNA, 20 nt, Artificial Sequence
  targeting sequence with CTCN PAM
caucugguguagaauaaaga

SEQ ID NO: 16754 - RNA, 20 nt, Artificial Sequence
  targeting sequence with CTCN PAM
gggaccccagcccaaaaccg

SEQ ID NO: 16755 - RNA, 20 nt, Artificial Sequence
  targeting sequence with CTCN PAM
uuccacuguaggcaaacugc

SEQ ID NO: 16756 - RNA, 20 nt, Artificial Sequence
  targeting sequence with CTCN PAM
aguuguccagaccauuugcu

SEQ ID NO: 16757 - RNA, 20 nt, Artificial Sequence
  targeting sequence with CTCN PAM
gauuccgugggguuuacaca

SEQ ID NO: 16758 - RNA, 20 nt, Artificial Sequence
  targeting sequence with CTCN PAM
ggccucgaagccacugccag

SEQ ID NO: 16759 - RNA, 20 nt, Artificial Sequence
  targeting sequence with CTCN PAM
aagccacugccaggucugcu

SEQ ID NO: 16760 - RNA, 20 nt, Artificial Sequence
  targeting sequence with CTCN PAM
guccuccuggccccagccca

SEQ ID NO: 16761 - RNA, 20 nt, Artificial Sequence
  targeting sequence with CTCN PAM
uggccccagcccacccggug

SEQ ID NO: 16762 - RNA, 20 nt, Artificial Sequence
  targeting sequence with CTCN PAM
gugugaacagcaggcagcag

SEQ ID NO: 16763 - RNA, 20 nt, Artificial Sequence
  targeting sequence with CTCN PAM
gaacugauguuuaauuuggc

SEQ ID NO: 16764 - RNA, 20 nt, Artificial Sequence
  targeting sequence with CTCN PAM
ugcacgcccggggcagagcu

SEQ ID NO: 16765 - RNA, 20 nt, Artificial Sequence
  targeting sequence with CTCN PAM
gccccgggcgugcaggaggc

SEQ ID NO: 16766 - RNA, 20 nt, Artificial Sequence
  targeting sequence with CTCN PAM
ucggcuaguuacuguaauuc

SEQ ID NO: 16767 - RNA, 20 nt, Artificial Sequence
  targeting sequence with CTCN PAM
gacaggcuuccucugugccu

SEQ ID NO: 16768 - RNA, 20 nt, Artificial Sequence
  targeting sequence with CTCN PAM
gugccuccaccccagcuccu

SEQ ID NO: 16769 - RNA, 20 nt, Artificial Sequence
  targeting sequence with CTCN PAM
accccagcuccuggccugaa

SEQ ID NO: 16770 - RNA, 20 nt, Artificial Sequence
  targeting sequence with CTCN PAM
uggccugaagaacugcagac

SEQ ID NO: 16771 - RNA, 20 nt, Artificial Sequence
  targeting sequence with CTCN PAM
guuuccccaucuauaaaaug

SEQ ID NO: 16772 - RNA, 20 nt, Artificial Sequence
  targeting sequence with CTCN PAM
gugccucuguuuccccaucu

SEQ ID NO: 16773 - RNA, 20 nt, Artificial Sequence
  targeting sequence with CTCN PAM
cugugccucuguuuccccau

SEQ ID NO: 16774 - RNA, 20 nt, Artificial Sequence
  targeting sequence with CTCN PAM
ggaaucccugaagcccuguc

SEQ ID NO: 16775 - RNA, 20 nt, Artificial Sequence
  targeting sequence with CTCN PAM
gagcucagugcaaaaaggcu

SEQ ID NO: 16776 - RNA, 20 nt, Artificial Sequence
  targeting sequence with CTCN PAM
gagaaucuucucaggaaucc

SEQ ID NO: 16777 - RNA, 20 nt, Artificial Sequence
  targeting sequence with CTCN PAM
gugcaaaaaggcuggggcug

SEQ ID NO: 16778 - RNA, 20 nt, Artificial Sequence
  targeting sequence with CTCN PAM
gcagccccagccuuuuugca

SEQ ID NO: 16779 - RNA, 20 nt, Artificial Sequence
  targeting sequence with CTCN PAM
gggcgcuggggcugcuuccc

SEQ ID NO: 16780 - RNA, 20 nt, Artificial Sequence
  targeting sequence with CTCN PAM
ucuugcucccaccccauuua

SEQ ID NO: 16781 - RNA, 20 nt, Artificial Sequence
  targeting sequence with CTCN PAM
ugcucccaccccauuuaguu

SEQ ID NO: 16782 - RNA, 20 nt, Artificial Sequence
  targeting sequence with CTCN PAM
caccccauuuaguugauuaa

SEQ ID NO: 16783 - RNA, 20 nt, Artificial Sequence
  targeting sequence with CTCN PAM
gcuguuucauuaccuuuuuu

SEQ ID NO: 16784 - RNA, 20 nt, Artificial Sequence
  targeting sequence with CTCN PAM
gccucugcuguuucauuacc

SEQ ID NO: 16785 - RNA, 20 nt, Artificial Sequence
  targeting sequence with CTCN PAM
ccaaaccccacgguaagcca

SEQ ID NO: 16786 - RNA, 20 nt, Artificial Sequence
  targeting sequence with CTCN PAM
caccgagacugguuggaaac

SEQ ID NO: 16787 - RNA, 20 nt, Artificial Sequence
  targeting sequence with CTCN PAM
gugcgaggccucaccaaacc

SEQ ID NO: 16788 - RNA, 20 nt, Artificial Sequence
  targeting sequence with CTCN PAM
uguguuuccaaccagucucg

SEQ ID NO: 16789 - RNA, 20 nt, Artificial Sequence
  targeting sequence with CTCN PAM
uugucuuccagcuguaccag

SEQ ID NO: 16790 - RNA, 20 nt, Artificial Sequence
  targeting sequence with CTCN PAM
acuccugguuccccaccccu

SEQ ID NO: 16791 - RNA, 20 nt, Artificial Sequence
  targeting sequence with CTCN PAM
ugguuccccaccccucaacu

SEQ ID NO: 16792 - RNA, 20 nt, Artificial Sequence
  targeting sequence with CTCN PAM
acucaucccugucccaggaa

SEQ ID NO: 16793 - RNA, 20 nt, Artificial Sequence
  targeting sequence with CTCN PAM
cuaccuuaaagacccaaucu

SEQ ID NO: 16794 - RNA, 20 nt, Artificial Sequence
  targeting sequence with CTCN PAM
uguuagcaggcagcucacua

SEQ ID NO: 16795 - RNA, 20 nt, Artificial Sequence
  targeting sequence with CTCN PAM
uauuuguauaccucuuguua

SEQ ID NO: 16796 - RNA, 20 nt, Artificial Sequence
  targeting sequence with CTCN PAM
cuccaccaacuggaggcaag

SEQ ID NO: 16797 - RNA, 20 nt, Artificial Sequence
  targeting sequence with CTCN PAM
accaacuggaggcaagccac

SEQ ID NO: 16798 - RNA, 20 nt, Artificial Sequence
  targeting sequence with CTCN PAM
aguugguggagggaggaacg

SEQ ID NO: 16799 - RNA, 20 nt, Artificial Sequence
  targeting sequence with CTCN PAM
cgcuguguggggguacacuu

SEQ ID NO: 16800 - RNA, 20 nt, Artificial Sequence
  targeting sequence with CTCN PAM
cagacaucucaacagucacg

SEQ ID NO: 16801 - RNA, 20 nt, Artificial Sequence
  targeting sequence with CTCN PAM
acagucacguggucuggaau

SEQ ID NO: 16802 - RNA, 20 nt, Artificial Sequence
  targeting sequence with CTCN PAM
cccauccauuccagaccacg

SEQ ID NO: 16803 - RNA, 20 nt, Artificial Sequence
  targeting sequence with CTCN PAM
ccuggcucccccauccauuc

SEQ ID NO: 16804 - RNA, 20 nt, Artificial Sequence
  targeting sequence with CTCN PAM
ggggcugugccaacagcaca

SEQ ID NO: 16805 - RNA, 20 nt, Artificial Sequence
  targeting sequence with CTCN PAM
gcaggagguugcaguaggca

SEQ ID NO: 16806 - RNA, 20 nt, Artificial Sequence
  targeting sequence with CTCN PAM
ugccgagggaccaguuuccg

SEQ ID NO: 16807 - RNA, 20 nt, Artificial Sequence
  targeting sequence with CTCN PAM
ggucccaggcccugccuuug

SEQ ID NO: 16808 - RNA, 20 nt, Artificial Sequence
  targeting sequence with CTCN PAM
augccacugaggcugggcag

SEQ ID NO: 16809 - RNA, 20 nt, Artificial Sequence
  targeting sequence with CTCN PAM
guggcauggagauggccugu

SEQ ID NO: 16810 - RNA, 20 nt, Artificial Sequence
  targeting sequence with CTCN PAM
ggcagccugcccagccucag

SEQ ID NO: 16811 - RNA, 20 nt, Artificial Sequence
  targeting sequence with CTCN PAM
uugcccccagggcaugaucc

SEQ ID NO: 16812 - RNA, 20 nt, Artificial Sequence
  targeting sequence with CTCN PAM
gcucuggggguccaggcuau

SEQ ID NO: 16813 - RNA, 20 nt, Artificial Sequence
  targeting sequence with CTCN PAM
ggggguccaggcuaugcucc

SEQ ID NO: 16814 - RNA, 20 nt, Artificial Sequence
  targeting sequence with CTCN PAM
ggacacaggggagccucccu

SEQ ID NO: 16815 - RNA, 20 nt, Artificial Sequence
  targeting sequence with CTCN PAM
cccaggacucacuggguacu

SEQ ID NO: 16816 - RNA, 20 nt, Artificial Sequence
  targeting sequence with CTCN PAM
cuggguacuccuggcgcaca

SEQ ID NO: 16817 - RNA, 20 nt, Artificial Sequence
  targeting sequence with CTCN PAM
uggcgcacaucgaucucgga

SEQ ID NO: 16818 - RNA, 20 nt, Artificial Sequence
  targeting sequence with CTCN PAM
gaaggcaggacggucauggc

SEQ ID NO: 16819 - RNA, 20 nt, Artificial Sequence
  targeting sequence with CTCN PAM
cuggcacugguccagaaaug

SEQ ID NO: 16820 - RNA, 20 nt, Artificial Sequence
  targeting sequence with CTCN PAM
ucccacccccacagcccucc

SEQ ID NO: 16821 - RNA, 20 nt, Artificial Sequence
  targeting sequence with CTCN PAM
cacccccacagcccuccugg

SEQ ID NO: 16822 - RNA, 20 nt, Artificial Sequence
  targeting sequence with CTCN PAM
ugguccagcuguugcuggug

SEQ ID NO: 16823 - RNA, 20 nt, Artificial Sequence
  targeting sequence with CTCN PAM
ccgcgucuccagggcacacc

SEQ ID NO: 16824 - RNA, 20 nt, Artificial Sequence
  targeting sequence with CTCN PAM
agggcacaccagccgcagua

SEQ ID NO: 16825 - RNA, 20 nt, Artificial Sequence
  targeting sequence with CTCN PAM
accuguggggacugcguggg

SEQ ID NO: 16826 - RNA, 20 nt, Artificial Sequence
  targeting sequence with CTCN PAM
gcccccagauggccagggug

SEQ ID NO: 16827 - RNA, 20 nt, Artificial Sequence
  targeting sequence with CTCN PAM
augggacugccagccucucc

SEQ ID NO: 16828 - RNA, 20 nt, Artificial Sequence
  targeting sequence with CTCN PAM
cccuuggggaggugguacgg

SEQ ID NO: 16829 - RNA, 20 nt, Artificial Sequence
  targeting sequence with CTCN PAM
ggccucaccuggugggacgu

SEQ ID NO: 16830 - RNA, 20 nt, Artificial Sequence
  targeting sequence with CTCN PAM
ccuggugggacgucaucagg

SEQ ID NO: 16831 - RNA, 20 nt, Artificial Sequence
  targeting sequence with CTCN PAM
gguuaccuuuaccugaugac

SEQ ID NO: 16832 - RNA, 20 nt, Artificial Sequence
  targeting sequence with CTCN PAM
ccauaggccacagucaccac

SEQ ID NO: 16833 - RNA, 20 nt, Artificial Sequence
  targeting sequence with CTCN PAM
ccaccugcaugcucucguuc

SEQ ID NO: 16834 - RNA, 20 nt, Artificial Sequence
  targeting sequence with CTCN PAM
cguucagguugaucuguggg

SEQ ID NO: 16835 - RNA, 20 nt, Artificial Sequence
  targeting sequence with CTCN PAM
uucagguugaucuguggggg

SEQ ID NO: 16836 - RNA, 20 nt, Artificial Sequence
  targeting sequence with CTCN PAM
agcacccugaugcccacuac

SEQ ID NO: 16837 - RNA, 20 nt, Artificial Sequence
  targeting sequence with CTCN PAM
ccugcuaugggcuccagcac

SEQ ID NO: 16838 - RNA, 20 nt, Artificial Sequence
  targeting sequence with CTCN PAM
gguuguccccuggguuuggc

SEQ ID NO: 16839 - RNA, 20 nt, Artificial Sequence
  targeting sequence with CTCN PAM
gccuccccauccugucuugg

SEQ ID NO: 16840 - RNA, 20 nt, Artificial Sequence
  targeting sequence with CTCN PAM
ccauccugucuuggacccuu

SEQ ID NO: 16841 - RNA, 20 nt, Artificial Sequence
  targeting sequence with CTCN PAM
ugaaggguccaagacaggau

SEQ ID NO: 16842 - RNA, 20 nt, Artificial Sequence
  targeting sequence with CTCN PAM
ccugcacgcccgugacuucc

SEQ ID NO: 16843 - RNA, 20 nt, Artificial Sequence
  targeting sequence with CTCN PAM
gcugugcccccaccaggagc

SEQ ID NO: 16844 - RNA, 20 nt, Artificial Sequence
  targeting sequence with CTCN PAM
uggugggggcacagcagagg

SEQ ID NO: 16845 - RNA, 20 nt, Artificial Sequence
  targeting sequence with CTCN PAM
uucugggcucgucuccaagg

SEQ ID NO: 16846 - RNA, 20 nt, Artificial Sequence
  targeting sequence with CTCN PAM
ucuccaaggcaucccgcccu

SEQ ID NO: 16847 - RNA, 20 nt, Artificial Sequence
  targeting sequence with CTCN PAM
aaggcaucccgcccugugaa

SEQ ID NO: 16848 - RNA, 20 nt, Artificial Sequence
  targeting sequence with CTCN PAM
gggaggcuguuaggcaccau

SEQ ID NO: 16849 - RNA, 20 nt, Artificial Sequence
  targeting sequence with CTCN PAM
cagagcacguuucguaaacu

SEQ ID NO: 16850 - RNA, 20 nt, Artificial Sequence
  targeting sequence with CTCN PAM
gugucaaagccagaauccaa

SEQ ID NO: 16851 - RNA, 20 nt, Artificial Sequence
  targeting sequence with CTCN PAM
ucagugucaaagccagaauc

SEQ ID NO: 16852 - RNA, 20 nt, Artificial Sequence
  targeting sequence with CTCN PAM
acaauguguaaguuguacaa

SEQ ID NO: 16853 - RNA, 20 nt, Artificial Sequence
  targeting sequence with CTCN PAM
ccucucugagccuguuuccu

SEQ ID NO: 16854 - RNA, 20 nt, Artificial Sequence
  targeting sequence with CTCN PAM
cugagccuguuuccugagcu

SEQ ID NO: 16855 - RNA, 20 nt, Artificial Sequence
  targeting sequence with CTCN PAM
gagccuguuuccugagcuaa

SEQ ID NO: 16856 - RNA, 20 nt, Artificial Sequence
  targeting sequence with CTCN PAM
gagaggggaggcagcuugua

SEQ ID NO: 16857 - RNA, 20 nt, Artificial Sequence
  targeting sequence with CTCN PAM
ggaaacaggcucagagaggg

SEQ ID NO: 16858 - RNA, 20 nt, Artificial Sequence
  targeting sequence with CTCN PAM
uggcccgccugccccauuag

SEQ ID NO: 16859 - RNA, 20 nt, Artificial Sequence
  targeting sequence with CTCN PAM
uuccuccccccgacgcccau

SEQ ID NO: 16860 - RNA, 20 nt, Artificial Sequence
  targeting sequence with CTCN PAM
ccccgacgcccauuucaccg

SEQ ID NO: 16861 - RNA, 20 nt, Artificial Sequence
  targeting sequence with CTCN PAM
ucggugaaaugggcgucggg

SEQ ID NO: 16862 - RNA, 20 nt, Artificial Sequence
  targeting sequence with CTCN PAM
gauuccucuucggugaaaug

SEQ ID NO: 16863 - RNA, 20 nt, Artificial Sequence
  targeting sequence with CTCN PAM
cagccucagauuccucuucg

SEQ ID NO: 16864 - RNA, 20 nt, Artificial Sequence
  targeting sequence with CTCN PAM
gccgcucccagccucagauu

SEQ ID NO: 16865 - RNA, 20 nt, Artificial Sequence
  targeting sequence with CTCN PAM
cucggccgcucccagccuca

SEQ ID NO: 16866 - RNA, 20 nt, Artificial Sequence
  targeting sequence with CTCN PAM
ugccaacucccucggccgcu

SEQ ID NO: 16867 - RNA, 20 nt, Artificial Sequence
  targeting sequence with CTCN PAM
ucacuuugugccucuugcca

SEQ ID NO: 16868 - RNA, 20 nt, Artificial Sequence
  targeting sequence with CTCN PAM
cugcaccuugguuccacacc

SEQ ID NO: 16869 - RNA, 20 nt, Artificial Sequence
  targeting sequence with CTCN PAM
ucccugcaccuugguuccac

SEQ ID NO: 16870 - RNA, 20 nt, Artificial Sequence
  targeting sequence with CTCN PAM
ggcucugagggacccucugc

SEQ ID NO: 16871 - RNA, 20 nt, Artificial Sequence
  targeting sequence with CTCN PAM
gagggacccucugcgugucc

SEQ ID NO: 16872 - RNA, 20 nt, Artificial Sequence
  targeting sequence with CTCN PAM
gagccagagaagcuuccagg

SEQ ID NO: 16873 - RNA, 20 nt, Artificial Sequence
  targeting sequence with CTCN PAM
gcguguccuccugaggauga

SEQ ID NO: 16874 - RNA, 20 nt, Artificial Sequence
  targeting sequence with CTCN PAM
ugaggaugacaauaccgguc

SEQ ID NO: 16875 - RNA, 20 nt, Artificial Sequence
  targeting sequence with CTCN PAM
ggaggacacgcagagggucc

SEQ ID NO: 16876 - RNA, 20 nt, Artificial Sequence
  targeting sequence with CTCN PAM
gaccgguauugucauccuca

SEQ ID NO: 16877 - RNA, 20 nt, Artificial Sequence
  targeting sequence with CTCN PAM
gcucuuuuuugccuggcccu

SEQ ID NO: 16878 - RNA, 20 nt, Artificial Sequence
  targeting sequence with CTCN PAM
uuuuugccuggcccugccug

SEQ ID NO: 16879 - RNA, 20 nt, Artificial Sequence
  targeting sequence with CTCN PAM
aaaugcccagccuggggccu

SEQ ID NO: 16880 - RNA, 20 nt, Artificial Sequence
  targeting sequence with CTCN PAM
caggccaguuucugccccag

SEQ ID NO: 16881 - RNA, 20 nt, Artificial Sequence
  targeting sequence with CTCN PAM
uggggcucccaaacccuuca

SEQ ID NO: 16882 - RNA, 20 nt, Artificial Sequence
  targeting sequence with CTCN PAM
caaacccuucauggcucccu

SEQ ID NO: 16883 - RNA, 20 nt, Artificial Sequence
  targeting sequence with CTCN PAM
cuucugcuuauggaaugaac

SEQ ID NO: 16884 - RNA, 20 nt, Artificial Sequence
  targeting sequence with CTCN PAM
agguccuggugaucuaaccc

SEQ ID NO: 16885 - RNA, 20 nt, Artificial Sequence
  targeting sequence with CTCN PAM
acccccucaacccugcucac

SEQ ID NO: 16886 - RNA, 20 nt, Artificial Sequence
  targeting sequence with CTCN PAM
acccugcucacacauuccag

SEQ ID NO: 16887 - RNA, 20 nt, Artificial Sequence
  targeting sequence with CTCN PAM
cacauuccagccuccaggca

SEQ ID NO: 16888 - RNA, 20 nt, Artificial Sequence
  targeting sequence with CTCN PAM
aggcauuugccuaugcugug

SEQ ID NO: 16889 - RNA, 20 nt, Artificial Sequence
  targeting sequence with CTCN PAM
ccucuggaauauuccuuccu

SEQ ID NO: 16890 - RNA, 20 nt, Artificial Sequence
  targeting sequence with CTCN PAM
ucuggaauauuccuuccugu

SEQ ID NO: 16891 - RNA, 20 nt, Artificial Sequence
  targeting sequence with CTCN PAM
ggaauauuccuuccuguucc

SEQ ID NO: 16892 - RNA, 20 nt, Artificial Sequence
  targeting sequence with CTCN PAM
ugugugcauugguagaaggg

SEQ ID NO: 16893 - RNA, 20 nt, Artificial Sequence
  targeting sequence with CTCN PAM
acacaccaacucaaaauuac

SEQ ID NO: 16894 - RNA, 20 nt, Artificial Sequence
  targeting sequence with CTCN PAM
aaauuaccuucuccccaggc

SEQ ID NO: 16895 - RNA, 20 nt, Artificial Sequence
  targeting sequence with CTCN PAM
ccaggcuuccaugggcuuug

SEQ ID NO: 16896 - RNA, 20 nt, Artificial Sequence
  targeting sequence with CTCN PAM
ggcugggacaaagcccaugg

SEQ ID NO: 16897 - RNA, 20 nt, Artificial Sequence
  targeting sequence with CTCN PAM
ugucccacguggccucuugg

SEQ ID NO: 16898 - RNA, 20 nt, Artificial Sequence
  targeting sequence with CTCN PAM
uggcggagccuugcaggggc

SEQ ID NO: 16899 - RNA, 20 nt, Artificial Sequence
  targeting sequence with CTCN PAM
gccaagaggccacgugggac

SEQ ID NO: 16900 - RNA, 20 nt, Artificial Sequence
  targeting sequence with CTCN PAM
ggccacugcccgcacccacc

SEQ ID NO: 16901 - RNA, 20 nt, Artificial Sequence
  targeting sequence with CTCN PAM
agucauuuccacuccuucaa

SEQ ID NO: 16902 - RNA, 20 nt, Artificial Sequence
  targeting sequence with CTCN PAM
uucaaucauuuauugagcaa

SEQ ID NO: 16903 - RNA, 20 nt, Artificial Sequence
  targeting sequence with CTCN PAM
auaaaugauugaaggagugg

SEQ ID NO: 16904 - RNA, 20 nt, Artificial Sequence
  targeting sequence with CTCN PAM
ggccuuaaaucgccacaccc

SEQ ID NO: 16905 - RNA, 20 nt, Artificial Sequence
  targeting sequence with CTCN PAM
agccaacccugcccugcucg

SEQ ID NO: 16906 - RNA, 20 nt, Artificial Sequence
  targeting sequence with CTCN PAM
gucuccagccaacccugccc

SEQ ID NO: 16907 - RNA, 20 nt, Artificial Sequence
  targeting sequence with CTCN PAM
ccuaccacccugcacagugu

SEQ ID NO: 16908 - RNA, 20 nt, Artificial Sequence
  targeting sequence with CTCN PAM
aggcuguggcgggguguggg

SEQ ID NO: 16909 - RNA, 20 nt, Artificial Sequence
  targeting sequence with CTCN PAM
ugcugugcgacucuggggca

SEQ ID NO: 16910 - RNA, 20 nt, Artificial Sequence
  targeting sequence with CTCN PAM
ggggcaaucauuuccccucu

SEQ ID NO: 16911 - RNA, 20 nt, Artificial Sequence
  targeting sequence with CTCN PAM
cagagccucaacguucucau

SEQ ID NO: 16912 - RNA, 20 nt, Artificial Sequence
  targeting sequence with CTCN PAM
gagccucaacguucucaucu

SEQ ID NO: 16913 - RNA, 20 nt, Artificial Sequence
  targeting sequence with CTCN PAM
gagaggggaaaugauugccc

SEQ ID NO: 16914 - RNA, 20 nt, Artificial Sequence
  targeting sequence with CTCN PAM
acguucucaucuguggcaug

SEQ ID NO: 16915 - RNA, 20 nt, Artificial Sequence
  targeting sequence with CTCN PAM
ucuguggcaugagaaucgug

SEQ ID NO: 16916 - RNA, 20 nt, Artificial Sequence
  targeting sequence with CTCN PAM
ugccacagaugagaacguug

SEQ ID NO: 16917 - RNA, 20 nt, Artificial Sequence
  targeting sequence with CTCN PAM
gccucccuugcaggggugug

SEQ ID NO: 16918 - RNA, 20 nt, Artificial Sequence
  targeting sequence with CTCN PAM
cuugcaggggugugagaauu

SEQ ID NO: 16919 - RNA, 20 nt, Artificial Sequence
  targeting sequence with CTCN PAM
caccccugcaagggaggcag

SEQ ID NO: 16920 - RNA, 20 nt, Artificial Sequence
  targeting sequence with CTCN PAM
cuuaauucucacaccccugc

SEQ ID NO: 16921 - RNA, 20 nt, Artificial Sequence
  targeting sequence with CTCN PAM
cacuuaauucucacaccccu

SEQ ID NO: 16922 - RNA, 20 nt, Artificial Sequence
  targeting sequence with CTCN PAM
ggguagacaguaggcgccua

SEQ ID NO: 16923 - RNA, 20 nt, Artificial Sequence
  targeting sequence with CTCN PAM
gaucugaucacccaaguccc

SEQ ID NO: 16924 - RNA, 20 nt, Artificial Sequence
  targeting sequence with CTCN PAM
auucaugcaccaggcccggc

SEQ ID NO: 16925 - RNA, 20 nt, Artificial Sequence
  targeting sequence with CTCN PAM
caagagggagcaggagagau

SEQ ID NO: 16926 - RNA, 20 nt, Artificial Sequence
  targeting sequence with CTCN PAM
ugggagacuaagcuaagcgc

SEQ ID NO: 16927 - RNA, 20 nt, Artificial Sequence
  targeting sequence with CTCN PAM
cucuugggagacuaagcuaa

SEQ ID NO: 16928 - RNA, 20 nt, Artificial Sequence
  targeting sequence with CTCN PAM
ugcucccucuugggagacua

SEQ ID NO: 16929 - RNA, 20 nt, Artificial Sequence
  targeting sequence with CTCN PAM
ccugcucccucuugggagac

SEQ ID NO: 16930 - RNA, 20 nt, Artificial Sequence
  targeting sequence with CTCN PAM
gccaugucuguccugcccca

SEQ ID NO: 16931 - RNA, 20 nt, Artificial Sequence
  targeting sequence with CTCN PAM
ggggcaggacagacauggcg

SEQ ID NO: 16932 - RNA, 20 nt, Artificial Sequence
  targeting sequence with CTCN PAM
ucccagcuccaggaaucucg

SEQ ID NO: 16933 - RNA, 20 nt, Artificial Sequence
  targeting sequence with CTCN PAM
cagcuccaggaaucucgggg

SEQ ID NO: 16934 - RNA, 20 nt, Artificial Sequence
  targeting sequence with CTCN PAM
aggaaucucggggccacggg

SEQ ID NO: 16935 - RNA, 20 nt, Artificial Sequence
  targeting sequence with CTCN PAM
guuucccugucaagggcugu

SEQ ID NO: 16936 - RNA, 20 nt, Artificial Sequence
  targeting sequence with CTCN PAM
aggccucaguuucccuguca

SEQ ID NO: 16937 - RNA, 20 nt, Artificial Sequence
  targeting sequence with CTCN PAM
ccaggccucaguuucccugu

SEQ ID NO: 16938 - RNA, 20 nt, Artificial Sequence
  targeting sequence with CTCN PAM
cuccaggccucaguuucccu

SEQ ID NO: 16939 - RNA, 20 nt, Artificial Sequence
  targeting sequence with CTCN PAM
cauucgccuagcacuuuaca

SEQ ID NO: 16940 - RNA, 20 nt, Artificial Sequence
  targeting sequence with CTCN PAM
gccaacucccaggggagccu

SEQ ID NO: 16941 - RNA, 20 nt, Artificial Sequence
  targeting sequence with CTCN PAM
caggggagccucccaccccc

SEQ ID NO: 16942 - RNA, 20 nt, Artificial Sequence
  targeting sequence with CTCN PAM
ccugggaguuggcugagggg

SEQ ID NO: 16943 - RNA, 20 nt, Artificial Sequence
  targeting sequence with CTCN PAM
cacccccacccccuccccac

SEQ ID NO: 16944 - RNA, 20 nt, Artificial Sequence
  targeting sequence with CTCN PAM
ccacauccccaaccauaccu

SEQ ID NO: 16945 - RNA, 20 nt, Artificial Sequence
  targeting sequence with CTCN PAM
agguagguaugguuggggau

SEQ ID NO: 16946 - RNA, 20 nt, Artificial Sequence
  targeting sequence with CTCN PAM
cguugaccgugcccaggaag

SEQ ID NO: 16947 - RNA, 20 nt, Artificial Sequence
  targeting sequence with CTCN PAM
guggccguggccagcgucaa

SEQ ID NO: 16948 - RNA, 20 nt, Artificial Sequence
  targeting sequence with CTCN PAM
ccuccguggccguggccagc

SEQ ID NO: 16949 - RNA, 20 nt, Artificial Sequence
  targeting sequence with CTCN PAM
ccugcagcacccgcugucca

SEQ ID NO: 16950 - RNA, 20 nt, Artificial Sequence
  targeting sequence with CTCN PAM
acaguccagcugcucuggcu

SEQ ID NO: 16951 - RNA, 20 nt, Artificial Sequence
  targeting sequence with CTCN PAM
ggcuggagcuggaagaggaa

SEQ ID NO: 16952 - RNA, 20 nt, Artificial Sequence
  targeting sequence with CTCN PAM
agccagagcagcuggacugu

SEQ ID NO: 16953 - RNA, 20 nt, Artificial Sequence
  targeting sequence with CTCN PAM
uccagcuccagccagagcag

SEQ ID NO: 16954 - RNA, 20 nt, Artificial Sequence
  targeting sequence with CTCN PAM
agaaccuucuccggcucccc

SEQ ID NO: 16955 - RNA, 20 nt, Artificial Sequence
  targeting sequence with CTCN PAM
ggcuccccgcccgcacagcu

SEQ ID NO: 16956 - RNA, 20 nt, Artificial Sequence
  targeting sequence with CTCN PAM
ccgcccgcacagcuggcugg

SEQ ID NO: 16957 - RNA, 20 nt, Artificial Sequence
  targeting sequence with CTCN PAM
ggcccuggcaucagagcuuu

SEQ ID NO: 16958 - RNA, 20 nt, Artificial Sequence
  targeting sequence with CTCN PAM
gaugccagggccugagaucc

SEQ ID NO: 16959 - RNA, 20 nt, Artificial Sequence
  targeting sequence with CTCN PAM
gugcucagcugaggcccaaa

SEQ ID NO: 16960 - RNA, 20 nt, Artificial Sequence
  targeting sequence with CTCN PAM
gcugaggcccaaacacaaac

SEQ ID NO: 16961 - RNA, 20 nt, Artificial Sequence
  targeting sequence with CTCN PAM
gcugagcacugaggauauaa

SEQ ID NO: 16962 - RNA, 20 nt, Artificial Sequence
  targeting sequence with CTCN PAM
guguugguuacagagcuguu

SEQ ID NO: 16963 - RNA, 20 nt, Artificial Sequence
  targeting sequence with CTCN PAM
guaaccaacacugaggucag

SEQ ID NO: 16964 - RNA, 20 nt, Artificial Sequence
  targeting sequence with CTCN PAM
uuggaacagcucuguaacca

SEQ ID NO: 16965 - RNA, 20 nt, Artificial Sequence
  targeting sequence with CTCN PAM
ccugcugguucccguguacc

SEQ ID NO: 16966 - RNA, 20 nt, Artificial Sequence
  targeting sequence with CTCN PAM
uuaaaaucaaaccugaccuu

SEQ ID NO: 16967 - RNA, 20 nt, Artificial Sequence
  targeting sequence with CTCN PAM
cuggacucuuuaaaaucaaa

SEQ ID NO: 16968 - RNA, 20 nt, Artificial Sequence
  targeting sequence with CTCN PAM
cccuggccggccucccugga

SEQ ID NO: 16969 - RNA, 20 nt, Artificial Sequence
  targeting sequence with CTCN PAM
cacccuggccggccucccug

SEQ ID NO: 16970 - RNA, 20 nt, Artificial Sequence
  targeting sequence with CTCN PAM
uggcugggcacagcugggaa

SEQ ID NO: 16971 - RNA, 20 nt, Artificial Sequence
  targeting sequence with CTCN PAM
ucccagcugugcccagccag

SEQ ID NO: 16972 - RNA, 20 nt, Artificial Sequence
  targeting sequence with CTCN PAM
gcucuucccagcugugccca

SEQ ID NO: 16973 - RNA, 20 nt, Artificial Sequence
  targeting sequence with CTCN PAM
ucugcucuucccagcugugc

SEQ ID NO: 16974 - RNA, 20 nt, Artificial Sequence
  targeting sequence with CTCN PAM
ggucaucugguguggacucc

SEQ ID NO: 16975 - RNA, 20 nt, Artificial Sequence
  targeting sequence with CTCN PAM
gcuuaacccgcuggcaccca

SEQ ID NO: 16976 - RNA, 20 nt, Artificial Sequence
  targeting sequence with CTCN PAM
ugggugccagcggguuaagc

SEQ ID NO: 16977 - RNA, 20 nt, Artificial Sequence
  targeting sequence with CTCN PAM
ugccucggcuguuuuccuac

SEQ ID NO: 16978 - RNA, 20 nt, Artificial Sequence
  targeting sequence with CTCN PAM
gcuguuuuccuacagccccg

SEQ ID NO: 16979 - RNA, 20 nt, Artificial Sequence
  targeting sequence with CTCN PAM
gcgucuccacagcaaccaug

SEQ ID NO: 16980 - RNA, 20 nt, Artificial Sequence
  targeting sequence with CTCN PAM
acagcaaccaugggcuuucc

SEQ ID NO: 16981 - RNA, 20 nt, Artificial Sequence
  targeting sequence with CTCN PAM
ugccgggugucugcucugac

SEQ ID NO: 16982 - RNA, 20 nt, Artificial Sequence
  targeting sequence with CTCN PAM
gacccuaggaccaccacccc

SEQ ID NO: 16983 - RNA, 20 nt, Artificial Sequence
  targeting sequence with CTCN PAM
agguggaggccucccuaaac

SEQ ID NO: 16984 - RNA, 20 nt, Artificial Sequence
  targeting sequence with CTCN PAM
accuggagucuugcaagcug

SEQ ID NO: 16985 - RNA, 20 nt, Artificial Sequence
  targeting sequence with CTCN PAM
cuaaaccgcagccuuucuuu

SEQ ID NO: 16986 - RNA, 20 nt, Artificial Sequence
  targeting sequence with CTCN PAM
ccaagcaccuauccccucau

SEQ ID NO: 16987 - RNA, 20 nt, Artificial Sequence
  targeting sequence with CTCN PAM
ucugcccacauuacaggggg

SEQ ID NO: 16988 - RNA, 20 nt, Artificial Sequence
  targeting sequence with CTCN PAM
agcagcaaaucagcugcggc

SEQ ID NO: 16989 - RNA, 20 nt, Artificial Sequence
  targeting sequence with CTCN PAM
cagggcagcugugagaggug

SEQ ID NO: 16990 - RNA, 20 nt, Artificial Sequence
  targeting sequence with CTCN PAM
cagcugcccugugagccgca

SEQ ID NO: 16991 - RNA, 20 nt, Artificial Sequence
  targeting sequence with CTCN PAM
cacagcugcccugugagccg

SEQ ID NO: 16992 - RNA, 20 nt, Artificial Sequence
  targeting sequence with CTCN PAM
uaccuucccucccuucuccu

SEQ ID NO: 16993 - RNA, 20 nt, Artificial Sequence
  targeting sequence with CTCN PAM
cuucuccugggucuugguau

SEQ ID NO: 16994 - RNA, 20 nt, Artificial Sequence
  targeting sequence with CTCN PAM
ugggucuugguauguucaaa

SEQ ID NO: 16995 - RNA, 20 nt, Artificial Sequence
  targeting sequence with CTCN PAM
aggaagugacccugagacaa

SEQ ID NO: 16996 - RNA, 20 nt, Artificial Sequence
  targeting sequence with CTCN PAM
gggucacuuccuggaggccu

SEQ ID NO: 16997 - RNA, 20 nt, Artificial Sequence
  targeting sequence with CTCN PAM
gcaaagacgcaggcacaagg

SEQ ID NO: 16998 - RNA, 20 nt, Artificial Sequence
  targeting sequence with CTCN PAM
gcaccacccuugugccugcg

SEQ ID NO: 16999 - RNA, 20 nt, Artificial Sequence
  targeting sequence with CTCN PAM
ucugcaccacccuugugccu

SEQ ID NO: 17000 - RNA, 20 nt, Artificial Sequence
  targeting sequence with CTCN PAM
gucccauccgacacaugugu

SEQ ID NO: 17001 - RNA, 20 nt, Artificial Sequence
  targeting sequence with CTCN PAM
uggaugauaagccaugaugg

SEQ ID NO: 17002 - RNA, 20 nt, Artificial Sequence
  targeting sequence with CTCN PAM
ccuggaugauaagccaugau

SEQ ID NO: 17003 - RNA, 20 nt, Artificial Sequence
  targeting sequence with CTCN PAM
cagaauccuggcagcccuag

SEQ ID NO: 17004 - RNA, 20 nt, Artificial Sequence
  targeting sequence with CTCN PAM
cagauggggaaacugaggcu

SEQ ID NO: 17005 - RNA, 20 nt, Artificial Sequence
  targeting sequence with CTCN PAM
guuuccccaucugugagaua

SEQ ID NO: 17006 - RNA, 20 nt, Artificial Sequence
  targeting sequence with CTCN PAM
gaggggaaaauggcuaacua

SEQ ID NO: 17007 - RNA, 20 nt, Artificial Sequence
  targeting sequence with CTCN PAM
gagccucaguuuccccaucu

SEQ ID NO: 17008 - RNA, 20 nt, Artificial Sequence
  targeting sequence with CTCN PAM
agucugcuaccugggucagc

SEQ ID NO: 17009 - RNA, 20 nt, Artificial Sequence
  targeting sequence with CTCN PAM
gcugcauuuggacaucagag

SEQ ID NO: 17010 - RNA, 20 nt, Artificial Sequence
  targeting sequence with CTCN PAM
gauguccaaaugcagcugag

SEQ ID NO: 17011 - RNA, 20 nt, Artificial Sequence
  targeting sequence with CTCN PAM
gagcaggacucagggagguc

SEQ ID NO: 17012 - RNA, 20 nt, Artificial Sequence
  targeting sequence with CTCN PAM
gagccucugauguccaaaug

SEQ ID NO: 17013 - RNA, 20 nt, Artificial Sequence
  targeting sequence with CTCN PAM
gggaggucaccggaaggcag

SEQ ID NO: 17014 - RNA, 20 nt, Artificial Sequence
  targeting sequence with CTCN PAM
cugaguccugcucugagccu

SEQ ID NO: 17015 - RNA, 20 nt, Artificial Sequence
  targeting sequence with CTCN PAM
gagccucauuuuacucaacu

SEQ ID NO: 17016 - RNA, 20 nt, Artificial Sequence
  targeting sequence with CTCN PAM
gaggcgaagugccuugccug

SEQ ID NO: 17017 - RNA, 20 nt, Artificial Sequence
  targeting sequence with CTCN PAM
uuuuacucaacuauaaaaug

SEQ ID NO: 17018 - RNA, 20 nt, Artificial Sequence
  targeting sequence with CTCN PAM
acuauaaaauggguauaucc

SEQ ID NO: 17019 - RNA, 20 nt, Artificial Sequence
  targeting sequence with CTCN PAM
augcggaaaacacuauggau

SEQ ID NO: 17020 - RNA, 20 nt, Artificial Sequence
  targeting sequence with CTCN PAM
caaguagcugggaacuacag

SEQ ID NO: 17021 - RNA, 20 nt, Artificial Sequence
  targeting sequence with CTCN PAM
gccucccaaguagcugggaa

SEQ ID NO: 17022 - RNA, 20 nt, Artificial Sequence
  targeting sequence with CTCN PAM
agccucagccucccaaguag

SEQ ID NO: 17023 - RNA, 20 nt, Artificial Sequence
  targeting sequence with CTCN PAM
agugauccuccagccucagc

SEQ ID NO: 17024 - RNA, 20 nt, Artificial Sequence
  targeting sequence with CTCN PAM
uggacucaagugauccucca

SEQ ID NO: 17025 - RNA, 20 nt, Artificial Sequence
  targeting sequence with CTCN PAM
cgggagcgggggaccaccag

SEQ ID NO: 17026 - RNA, 20 nt, Artificial Sequence
  targeting sequence with CTCN PAM
cgggaggucaccauauugau

SEQ ID NO: 17027 - RNA, 20 nt, Artificial Sequence
  targeting sequence with CTCN PAM
uuaggcaaccuggugguccc

SEQ ID NO: 17028 - RNA, 20 nt, Artificial Sequence
  targeting sequence with CTCN PAM
guuuccgaccugggccaguu

SEQ ID NO: 17029 - RNA, 20 nt, Artificial Sequence
  targeting sequence with CTCN PAM
aaagcuuuaagguaggcaug

SEQ ID NO: 17030 - RNA, 20 nt, Artificial Sequence
  targeting sequence with CTCN PAM
caccuggacagcccucccag

SEQ ID NO: 17031 - RNA, 20 nt, Artificial Sequence
  targeting sequence with CTCN PAM
ccuggacagcccucccagcc

SEQ ID NO: 17032 - RNA, 20 nt, Artificial Sequence
  targeting sequence with CTCN PAM
cagcccucuucauuuuccaa

SEQ ID NO: 17033 - RNA, 20 nt, Artificial Sequence
  targeting sequence with CTCN PAM
ucauuuuccaagaccacucu

SEQ ID NO: 17034 - RNA, 20 nt, Artificial Sequence
  targeting sequence with CTCN PAM
ugcccccuacacugacauuu

SEQ ID NO: 17035 - RNA, 20 nt, Artificial Sequence
  targeting sequence with CTCN PAM
uuuggcagcuguguuagcag

SEQ ID NO: 17036 - RNA, 20 nt, Artificial Sequence
  targeting sequence with CTCN PAM
cccgauucaagcccucccau

SEQ ID NO: 17037 - RNA, 20 nt, Artificial Sequence
  targeting sequence with CTCN PAM
caugguuuccaggacacuca

SEQ ID NO: 17038 - RNA, 20 nt, Artificial Sequence
  targeting sequence with CTCN PAM
gaauaaauccugaauccuaa

SEQ ID NO: 17039 - RNA, 20 nt, Artificial Sequence
  targeting sequence with CTCN PAM
cguggguccccucaucuucu

SEQ ID NO: 17040 - RNA, 20 nt, Artificial Sequence
  targeting sequence with CTCN PAM
ucuucuaacuccauuucaca

SEQ ID NO: 17041 - RNA, 20 nt, Artificial Sequence
  targeting sequence with CTCN PAM
auuucacaccucccuugccc

SEQ ID NO: 17042 - RNA, 20 nt, Artificial Sequence
  targeting sequence with CTCN PAM
cuugcccuugcuccuucacc

SEQ ID NO: 17043 - RNA, 20 nt, Artificial Sequence
  targeting sequence with CTCN PAM
uucaccccagccacacuggc

SEQ ID NO: 17044 - RNA, 20 nt, Artificial Sequence
  targeting sequence with CTCN PAM
uuucugugccucaaauauca

SEQ ID NO: 17045 - RNA, 20 nt, Artificial Sequence
  targeting sequence with CTCN PAM
aauaucacaagcucguuccu

SEQ ID NO: 17046 - RNA, 20 nt, Artificial Sequence
  targeting sequence with CTCN PAM
uuccugccucaggaccucug

SEQ ID NO: 17047 - RNA, 20 nt, Artificial Sequence
  targeting sequence with CTCN PAM
ggaccucuggccuggccgcu

SEQ ID NO: 17048 - RNA, 20 nt, Artificial Sequence
  targeting sequence with CTCN PAM
ggccuggccgcucccucugc

SEQ ID NO: 17049 - RNA, 20 nt, Artificial Sequence
  targeting sequence with CTCN PAM
cucugcccaggaagccauuc

SEQ ID NO: 17050 - RNA, 20 nt, Artificial Sequence
  targeting sequence with CTCN PAM
gcccaggaagccauuccccc

SEQ ID NO: 17051 - RNA, 20 nt, Artificial Sequence
  targeting sequence with CTCN PAM
ggugggggggaauggcuucc

SEQ ID NO: 17052 - RNA, 20 nt, Artificial Sequence
  targeting sequence with CTCN PAM
cgggugggggggaauggcuu

SEQ ID NO: 17053 - RNA, 20 nt, Artificial Sequence
  targeting sequence with CTCN PAM
ucucagugccagcccugacc

SEQ ID NO: 17054 - RNA, 20 nt, Artificial Sequence
  targeting sequence with CTCN PAM
cagugccagcccugaccuac

SEQ ID NO: 17055 - RNA, 20 nt, Artificial Sequence
  targeting sequence with CTCN PAM
gugccagcccugaccuaccc

SEQ ID NO: 17056 - RNA, 20 nt, Artificial Sequence
  targeting sequence with CTCN PAM
auccuguguguguuacaguu

SEQ ID NO: 17057 - RNA, 20 nt, Artificial Sequence
  targeting sequence with CTCN PAM
gcacccaccuuccagggcug

SEQ ID NO: 17058 - RNA, 20 nt, Artificial Sequence
  targeting sequence with CTCN PAM
ccagcugccccaaccaggcg

SEQ ID NO: 17059 - RNA, 20 nt, Artificial Sequence
  targeting sequence with CTCN PAM
gcaauccugcagcugcaggg

SEQ ID NO: 17060 - RNA, 20 nt, Artificial Sequence
  targeting sequence with CTCN PAM
ucccugcagcugcaggauug

SEQ ID NO: 17061 - RNA, 20 nt, Artificial Sequence
  targeting sequence with CTCN PAM
ccucuucccugcagcugcag

SEQ ID NO: 17062 - RNA, 20 nt, Artificial Sequence
  targeting sequence with CTCN PAM
ccacugcgagggaugauuuu

SEQ ID NO: 17063 - RNA, 20 nt, Artificial Sequence
  targeting sequence with CTCN PAM
caguggugaggaucccaccu

SEQ ID NO: 17064 - RNA, 20 nt, Artificial Sequence
  targeting sequence with CTCN PAM
caccaagggaacauaaguuc

SEQ ID NO: 17065 - RNA, 20 nt, Artificial Sequence
  targeting sequence with CTCN PAM
cagguguccccuuccagaac

SEQ ID NO: 17066 - RNA, 20 nt, Artificial Sequence
  targeting sequence with CTCN PAM
gggugaucugugggcuaggg

SEQ ID NO: 17067 - RNA, 20 nt, Artificial Sequence
  targeting sequence with CTCN PAM
cugcugcccuagcccacaga

SEQ ID NO: 17068 - RNA, 20 nt, Artificial Sequence
  targeting sequence with CTCN PAM
ucccugcugcccuagcccac

SEQ ID NO: 17069 - RNA, 20 nt, Artificial Sequence
  targeting sequence with CTCN PAM
ccuccucccugcugcccuag

SEQ ID NO: 17070 - RNA, 20 nt, Artificial Sequence
  targeting sequence with CTCN PAM
ugcuccccuccucccugcug

SEQ ID NO: 17071 - RNA, 20 nt, Artificial Sequence
  targeting sequence with CTCN PAM
cuccugcuccccuccucccu

SEQ ID NO: 17072 - RNA, 20 nt, Artificial Sequence
  targeting sequence with CTCN PAM
ccucccuccugcuccccucc

SEQ ID NO: 17073 - RNA, 20 nt, Artificial Sequence
  targeting sequence with CTCN PAM
cugggagcccgcuccccccu

SEQ ID NO: 17074 - RNA, 20 nt, Artificial Sequence
  targeting sequence with CTCN PAM
cagcgagcuccccucccucc

SEQ ID NO: 17075 - RNA, 20 nt, Artificial Sequence
  targeting sequence with CTCN PAM
ccccucccccaccccgcgcu

SEQ ID NO: 17076 - RNA, 20 nt, Artificial Sequence
  targeting sequence with CTCN PAM
cccaccccgcgcugacuuuc

SEQ ID NO: 17077 - RNA, 20 nt, Artificial Sequence
  targeting sequence with CTCN PAM
gaaugaucuguguuccgagg

SEQ ID NO: 17078 - RNA, 20 nt, Artificial Sequence
  targeting sequence with CTCN PAM
gaacacagaucauucggagc

SEQ ID NO: 17079 - RNA, 20 nt, Artificial Sequence
  targeting sequence with CTCN PAM
aacacggaagcccagcgugg

SEQ ID NO: 17080 - RNA, 20 nt, Artificial Sequence
  targeting sequence with CTCN PAM
cccagcaggggcggcacuuc

SEQ ID NO: 17081 - RNA, 20 nt, Artificial Sequence
  targeting sequence with CTCN PAM
cccagccugcaucccccucc

SEQ ID NO: 17082 - RNA, 20 nt, Artificial Sequence
  targeting sequence with CTCN PAM
gggacuagacguccugagca

SEQ ID NO: 17083 - RNA, 20 nt, Artificial Sequence
  targeting sequence with CTCN PAM
ggacgucuaguccccgaguc

SEQ ID NO: 17084 - RNA, 20 nt, Artificial Sequence
  targeting sequence with CTCN PAM
gcugaacuuggucuccaggg

SEQ ID NO: 17085 - RNA, 20 nt, Artificial Sequence
  targeting sequence with CTCN PAM
agggacaguuagccucacag

SEQ ID NO: 17086 - RNA, 20 nt, Artificial Sequence
  targeting sequence with CTCN PAM
caggcccaaaauacccccug

SEQ ID NO: 17087 - RNA, 20 nt, Artificial Sequence
  targeting sequence with CTCN PAM
uuaaaggcuaaugagcauga

SEQ ID NO: 17088 - RNA, 20 nt, Artificial Sequence
  targeting sequence with CTCN PAM
uuagccuuuaaggaggacgg

SEQ ID NO: 17089 - RNA, 20 nt, Artificial Sequence
  targeting sequence with CTCN PAM
ugcucauuagccuuuaagga

SEQ ID NO: 17090 - RNA, 20 nt, Artificial Sequence
  targeting sequence with CTCN PAM
aguucuccugagagcaggga

SEQ ID NO: 17091 - RNA, 20 nt, Artificial Sequence
  targeting sequence with CTCN PAM
ugagagcagggaaggcucgg

SEQ ID NO: 17092 - RNA, 20 nt, Artificial Sequence
  targeting sequence with CTCN PAM
ggagaacuugaguuuugaaa

SEQ ID NO: 17093 - RNA, 20 nt, Artificial Sequence
  targeting sequence with CTCN PAM
caggagaacuugaguuuuga

SEQ ID NO: 17094 - RNA, 20 nt, Artificial Sequence
  targeting sequence with CTCN PAM
gcuauccccgcagcgcccuc

SEQ ID NO: 17095 - RNA, 20 nt, Artificial Sequence
  targeting sequence with CTCN PAM
aagucacagggccaucuuuc

SEQ ID NO: 17096 - RNA, 20 nt, Artificial Sequence
  targeting sequence with CTCN PAM
cacacaaagcuggucagacc

SEQ ID NO: 17097 - RNA, 20 nt, Artificial Sequence
  targeting sequence with CTCN PAM
cacaaagcuggucagacccu

SEQ ID NO: 17098 - RNA, 20 nt, Artificial Sequence
  targeting sequence with CTCN PAM
cuaccuacaacccagcuccu

SEQ ID NO: 17099 - RNA, 20 nt, Artificial Sequence
  targeting sequence with CTCN PAM
uggcuguccucgggaucaag

SEQ ID NO: 17100 - RNA, 20 nt, Artificial Sequence
  targeting sequence with CTCN PAM
ggaucaagccccagcagucc

SEQ ID NO: 17101 - RNA, 20 nt, Artificial Sequence
  targeting sequence with CTCN PAM
cauucaaggccuucgugccc

SEQ ID NO: 17102 - RNA, 20 nt, Artificial Sequence
  targeting sequence with CTCN PAM
ugccagcucccaggccucca

SEQ ID NO: 17103 - RNA, 20 nt, Artificial Sequence
  targeting sequence with CTCN PAM
caggccuccagucucccucc

SEQ ID NO: 17104 - RNA, 20 nt, Artificial Sequence
  targeting sequence with CTCN PAM
agucucccuccucccucugc

SEQ ID NO: 17105 - RNA, 20 nt, Artificial Sequence
  targeting sequence with CTCN PAM
cuccucccucugccccaccc

SEQ ID NO: 17106 - RNA, 20 nt, Artificial Sequence
  targeting sequence with CTCN PAM
ucccucugccccacccgcug

SEQ ID NO: 17107 - RNA, 20 nt, Artificial Sequence
  targeting sequence with CTCN PAM
cucugccccacccgcugcgc

SEQ ID NO: 17108 - RNA, 20 nt, Artificial Sequence
  targeting sequence with CTCN PAM
gccccacccgcugcgcccac

SEQ ID NO: 17109 - RNA, 20 nt, Artificial Sequence
  targeting sequence with CTCN PAM
acagguccuggaaugugccc

SEQ ID NO: 17110 - RNA, 20 nt, Artificial Sequence
  targeting sequence with CTCN PAM
uacccggggcucuuguacca

SEQ ID NO: 17111 - RNA, 20 nt, Artificial Sequence
  targeting sequence with CTCN PAM
uguaccauuguaaauguccc

SEQ ID NO: 17112 - RNA, 20 nt, Artificial Sequence
  targeting sequence with CTCN PAM
gaggcauucguacuccccuu

SEQ ID NO: 17113 - RNA, 20 nt, Artificial Sequence
  targeting sequence with CTCN PAM
gaggcaugggaugggcauug

SEQ ID NO: 17114 - RNA, 20 nt, Artificial Sequence
  targeting sequence with CTCN PAM
ccuuggcacuucagcgcccc

SEQ ID NO: 17115 - RNA, 20 nt, Artificial Sequence
  targeting sequence with CTCN PAM
ccaggcaugcccagacggca

SEQ ID NO: 17116 - RNA, 20 nt, Artificial Sequence
  targeting sequence with CTCN PAM
aggcaugcccagacggcaag

SEQ ID NO: 17117 - RNA, 20 nt, Artificial Sequence
  targeting sequence with CTCN PAM
gccccccaacuccugugaug

SEQ ID NO: 17118 - RNA, 20 nt, Artificial Sequence
  targeting sequence with CTCN PAM
ugugauggcacugugcuggu

SEQ ID NO: 17119 - RNA, 20 nt, Artificial Sequence
  targeting sequence with CTCN PAM
agcauggagccugugcucug

SEQ ID NO: 17120 - RNA, 20 nt, Artificial Sequence
  targeting sequence with CTCN PAM
augcuggagaacgucaugca

SEQ ID NO: 17121 - RNA, 20 nt, Artificial Sequence
  targeting sequence with CTCN PAM
ggagggaauguuuacaaaag

SEQ ID NO: 17122 - RNA, 20 nt, Artificial Sequence
  targeting sequence with CTCN PAM
agagcacaggcuccaugcug

SEQ ID NO: 17123 - RNA, 20 nt, Artificial Sequence
  targeting sequence with CTCN PAM
cuaagucgagugacugagag

SEQ ID NO: 17124 - RNA, 20 nt, Artificial Sequence
  targeting sequence with CTCN PAM
aagucgagugacugagagca

SEQ ID NO: 17125 - RNA, 20 nt, Artificial Sequence
  targeting sequence with CTCN PAM
acuuagagagaaagcagcug

SEQ ID NO: 17126 - RNA, 20 nt, Artificial Sequence
  targeting sequence with CTCN PAM
gucacucgacuuagagagaa

SEQ ID NO: 17127 - RNA, 20 nt, Artificial Sequence
  targeting sequence with CTCN PAM
cagucacucgacuuagagag

SEQ ID NO: 17128 - RNA, 20 nt, Artificial Sequence
  targeting sequence with CTCN PAM
agcacccagcauggccgugu

SEQ ID NO: 17129 - RNA, 20 nt, Artificial Sequence
  targeting sequence with CTCN PAM
guucuccagcacccagcaug

SEQ ID NO: 17130 - RNA, 20 nt, Artificial Sequence
  targeting sequence with CTCN PAM
gcguguggcaacaaagggag

SEQ ID NO: 17131 - RNA, 20 nt, Artificial Sequence
  targeting sequence with CTCN PAM
cuuuguugccacacgcagag

SEQ ID NO: 17132 - RNA, 20 nt, Artificial Sequence
  targeting sequence with CTCN PAM
cuuuaucccucucucacaug

SEQ ID NO: 17133 - RNA, 20 nt, Artificial Sequence
  targeting sequence with CTCN PAM
cucacaugggaugagcaacc

SEQ ID NO: 17134 - RNA, 20 nt, Artificial Sequence
  targeting sequence with CTCN PAM
cacaugggaugagcaaccgc

SEQ ID NO: 17135 - RNA, 20 nt, Artificial Sequence
  targeting sequence with CTCN PAM
caugggaugagcaaccgccg

SEQ ID NO: 17136 - RNA, 20 nt, Artificial Sequence
  targeting sequence with CTCN PAM
ucccaugugagagagggaua

SEQ ID NO: 17137 - RNA, 20 nt, Artificial Sequence
  targeting sequence with CTCN PAM
aaacggggccgaaaccagcg

SEQ ID NO: 17138 - RNA, 20 nt, Artificial Sequence
  targeting sequence with CTCN PAM
caaaacggggccgaaaccag

SEQ ID NO: 17139 - RNA, 20 nt, Artificial Sequence
  targeting sequence with CTCN PAM
cccuccagcuggcucccucc

SEQ ID NO: 17140 - RNA, 20 nt, Artificial Sequence
  targeting sequence with CTCN PAM
agcuggcucccuccuggggc

SEQ ID NO: 17141 - RNA, 20 nt, Artificial Sequence
  targeting sequence with CTCN PAM
cuccuggggccaaagcucag

SEQ ID NO: 17142 - RNA, 20 nt, Artificial Sequence
  targeting sequence with CTCN PAM
uggggccaaagcucagcucu

SEQ ID NO: 17143 - RNA, 20 nt, Artificial Sequence
  targeting sequence with CTCN PAM
gcucugcccacucucccauu

SEQ ID NO: 17144 - RNA, 20 nt, Artificial Sequence
  targeting sequence with CTCN PAM
gcccacucucccauuaaaac

SEQ ID NO: 17145 - RNA, 20 nt, Artificial Sequence
  targeting sequence with CTCN PAM
cccauuaaaacucugacaua

SEQ ID NO: 17146 - RNA, 20 nt, Artificial Sequence
  targeting sequence with CTCN PAM
cauuaaaacucugacauauu

SEQ ID NO: 17147 - RNA, 20 nt, Artificial Sequence
  targeting sequence with CTCN PAM
gacauauugauuuuacuacc

SEQ ID NO: 17148 - RNA, 20 nt, Artificial Sequence
  targeting sequence with CTCN PAM
ccccaggaagccaguuggaa

SEQ ID NO: 17149 - RNA, 20 nt, Artificial Sequence
  targeting sequence with CTCN PAM
ccaggaagccaguuggaagg

SEQ ID NO: 17150 - RNA, 20 nt, Artificial Sequence
  targeting sequence with CTCN PAM
uuccaacuggcuuccugggg

SEQ ID NO: 17151 - RNA, 20 nt, Artificial Sequence
  targeting sequence with CTCN PAM
ugaagcgcuccuuccaacug

SEQ ID NO: 17152 - RNA, 20 nt, Artificial Sequence
  targeting sequence with CTCN PAM
ggccucacauccugccgcag

SEQ ID NO: 17153 - RNA, 20 nt, Artificial Sequence
  targeting sequence with CTCN PAM
cauccugccgcagacccacc

SEQ ID NO: 17154 - RNA, 20 nt, Artificial Sequence
  targeting sequence with CTCN PAM
gcagccggugugguagccau

SEQ ID NO: 17155 - RNA, 20 nt, Artificial Sequence
  targeting sequence with CTCN PAM
agugcaaagccuccgcagcc

SEQ ID NO: 17156 - RNA, 20 nt, Artificial Sequence
  targeting sequence with CTCN PAM
cuucucaagugcaaagccuc

SEQ ID NO: 17157 - RNA, 20 nt, Artificial Sequence
  targeting sequence with CTCN PAM
guggcaaggaaaccugacuu

SEQ ID NO: 17158 - RNA, 20 nt, Artificial Sequence
  targeting sequence with CTCN PAM
guggcaaauuucagcucugu

SEQ ID NO: 17159 - RNA, 20 nt, Artificial Sequence
  targeting sequence with CTCN PAM
cgccuguaaucccagcgcuu

SEQ ID NO: 17160 - RNA, 20 nt, Artificial Sequence
  targeting sequence with CTCN PAM
caaagcgcugggauuacagg

SEQ ID NO: 17161 - RNA, 20 nt, Artificial Sequence
  targeting sequence with CTCN PAM
aggcuucaggcgauccuucc

SEQ ID NO: 17162 - RNA, 20 nt, Artificial Sequence
  targeting sequence with CTCN PAM
cugcagccuugaccuccagg

SEQ ID NO: 17163 - RNA, 20 nt, Artificial Sequence
  targeting sequence with CTCN PAM
agucugggugacagagaccc

SEQ ID NO: 17164 - RNA, 20 nt, Artificial Sequence
  targeting sequence with CTCN PAM
gucacccagacuggagugcg

SEQ ID NO: 17165 - RNA, 20 nt, Artificial Sequence
  targeting sequence with CTCN PAM
aaaaaauaaaaauaaaaaaa

SEQ ID NO: 17166 - RNA, 20 nt, Artificial Sequence
  targeting sequence with CTCN PAM
cuacauccuggccggggacu

SEQ ID NO: 17167 - RNA, 20 nt, Artificial Sequence
  targeting sequence with CTCN PAM
ucccaaagcugggcuccuuc

SEQ ID NO: 17168 - RNA, 20 nt, Artificial Sequence
  targeting sequence with CTCN PAM
caaagcugggcuccuuccca

SEQ ID NO: 17169 - RNA, 20 nt, Artificial Sequence
  targeting sequence with CTCN PAM
uucccauucauccuucacgg

SEQ ID NO: 17170 - RNA, 20 nt, Artificial Sequence
  targeting sequence with CTCN PAM
cgugaaggaugaaugggaag

SEQ ID NO: 17171 - RNA, 20 nt, Artificial Sequence
  targeting sequence with CTCN PAM
uuggcucccgugaaggauga

SEQ ID NO: 17172 - RNA, 20 nt, Artificial Sequence
  targeting sequence with CTCN PAM
cuuuggcucccgugaaggau

SEQ ID NO: 17173 - RNA, 20 nt, Artificial Sequence
  targeting sequence with CTCN PAM
uggaaaagaaagcagacguu

SEQ ID NO: 17174 - RNA, 20 nt, Artificial Sequence
  targeting sequence with CTCN PAM
acaaacgucugcuuucuuuu

SEQ ID NO: 17175 - RNA, 20 nt, Artificial Sequence
  targeting sequence with CTCN PAM
agacugcacuccacaaacgu

SEQ ID NO: 17176 - RNA, 20 nt, Artificial Sequence
  targeting sequence with CTCN PAM
caacuaaacuccagacugca

SEQ ID NO: 17177 - RNA, 20 nt, Artificial Sequence
  targeting sequence with CTCN PAM
cauugcuaacaucuuaccgu

SEQ ID NO: 17178 - RNA, 20 nt, Artificial Sequence
  targeting sequence with CTCN PAM
ugugcagcucaacagcuucc

SEQ ID NO: 17179 - RNA, 20 nt, Artificial Sequence
  targeting sequence with CTCN PAM
acagcuucccaugguucccu

SEQ ID NO: 17180 - RNA, 20 nt, Artificial Sequence
  targeting sequence with CTCN PAM
ugggcccuugaagccccacu

SEQ ID NO: 17181 - RNA, 20 nt, Artificial Sequence
  targeting sequence with CTCN PAM
aucuggcccugaccucugug

SEQ ID NO: 17182 - RNA, 20 nt, Artificial Sequence
  targeting sequence with CTCN PAM
guggccucucucagcccccg

SEQ ID NO: 17183 - RNA, 20 nt, Artificial Sequence
  targeting sequence with CTCN PAM
cucagcccccguccccgcca

SEQ ID NO: 17184 - RNA, 20 nt, Artificial Sequence
  targeting sequence with CTCN PAM
cagcccccguccccgccaac

SEQ ID NO: 17185 - RNA, 20 nt, Artificial Sequence
  targeting sequence with CTCN PAM
gcccccguccccgccaacuc

SEQ ID NO: 17186 - RNA, 20 nt, Artificial Sequence
  targeting sequence with CTCN PAM
ucccucagcuuggacagccc

SEQ ID NO: 17187 - RNA, 20 nt, Artificial Sequence
  targeting sequence with CTCN PAM
cucagcuuggacagcccagg

SEQ ID NO: 17188 - RNA, 20 nt, Artificial Sequence
  targeting sequence with CTCN PAM
gcuuggacagcccagguagg

SEQ ID NO: 17189 - RNA, 20 nt, Artificial Sequence
  targeting sequence with CTCN PAM
ugggcuccccugaguggagc

SEQ ID NO: 17190 - RNA, 20 nt, Artificial Sequence
  targeting sequence with CTCN PAM
ccugaguggagcccaugugg

SEQ ID NO: 17191 - RNA, 20 nt, Artificial Sequence
  targeting sequence with CTCN PAM
ggggagcccaggaggacugg

SEQ ID NO: 17192 - RNA, 20 nt, Artificial Sequence
  targeting sequence with CTCN PAM
acucaggggagcccaggagg

SEQ ID NO: 17193 - RNA, 20 nt, Artificial Sequence
  targeting sequence with CTCN PAM
gugguggccuguggacugug

SEQ ID NO: 17194 - RNA, 20 nt, Artificial Sequence
  targeting sequence with CTCN PAM
guccagcagcccagccgcac

SEQ ID NO: 17195 - RNA, 20 nt, Artificial Sequence
  targeting sequence with CTCN PAM
cagaccccagcuccuuccac

SEQ ID NO: 17196 - RNA, 20 nt, Artificial Sequence
  targeting sequence with CTCN PAM
uuccacuucagcaugcacug

SEQ ID NO: 17197 - RNA, 20 nt, Artificial Sequence
  targeting sequence with CTCN PAM
cagaacacugugcaagcuga

SEQ ID NO: 17198 - RNA, 20 nt, Artificial Sequence
  targeting sequence with CTCN PAM
gaacacugugcaagcugaca

SEQ ID NO: 17199 - RNA, 20 nt, Artificial Sequence
  targeting sequence with CTCN PAM
gcugagaguaaacugaggca

SEQ ID NO: 17200 - RNA, 20 nt, Artificial Sequence
  targeting sequence with CTCN PAM
gcagaggugucagcuugcac

SEQ ID NO: 17201 - RNA, 20 nt, Artificial Sequence
  targeting sequence with CTCN PAM
cagcagaggugucagcuugc

SEQ ID NO: 17202 - RNA, 20 nt, Artificial Sequence
  targeting sequence with CTCN PAM
guuuacucucagcagaggug

SEQ ID NO: 17203 - RNA, 20 nt, Artificial Sequence
  targeting sequence with CTCN PAM
uuccuugccucaguuuacuc

SEQ ID NO: 17204 - RNA, 20 nt, Artificial Sequence
  targeting sequence with CTCN PAM
cagggcuggcacacagugug

SEQ ID NO: 17205 - RNA, 20 nt, Artificial Sequence
  targeting sequence with CTCN PAM
guccuggguggccucuggca

SEQ ID NO: 17206 - RNA, 20 nt, Artificial Sequence
  targeting sequence with CTCN PAM
ggcagcagcccccaugccag

SEQ ID NO: 17207 - RNA, 20 nt, Artificial Sequence
  targeting sequence with CTCN PAM
cuggcaugggggcugcugcc

SEQ ID NO: 17208 - RNA, 20 nt, Artificial Sequence
  targeting sequence with CTCN PAM
ucccuggcaugggggcugcu

SEQ ID NO: 17209 - RNA, 20 nt, Artificial Sequence
  targeting sequence with CTCN PAM
gcagcagguggucuccuccc

SEQ ID NO: 17210 - RNA, 20 nt, Artificial Sequence
  targeting sequence with CTCN PAM
uggucaccccugaaggcgcu

SEQ ID NO: 17211 - RNA, 20 nt, Artificial Sequence
  targeting sequence with CTCN PAM
aggaagccucuuggucaccc

SEQ ID NO: 17212 - RNA, 20 nt, Artificial Sequence
  targeting sequence with CTCN PAM
cuacagccccuccaggaagc

SEQ ID NO: 17213 - RNA, 20 nt, Artificial Sequence
  targeting sequence with CTCN PAM
guggcuaaggccaggcuucc

SEQ ID NO: 17214 - RNA, 20 nt, Artificial Sequence
  targeting sequence with CTCN PAM
aggcugcuuuuccucugugg

SEQ ID NO: 17215 - RNA, 20 nt, Artificial Sequence
  targeting sequence with CTCN PAM
uccaggcugcuuuuccucug

SEQ ID NO: 17216 - RNA, 20 nt, Artificial Sequence
  targeting sequence with CTCN PAM
aacgugcuccuccaggcugc

SEQ ID NO: 17217 - RNA, 20 nt, Artificial Sequence
  targeting sequence with CTCN PAM
gugccuugguuucuccaacg

SEQ ID NO: 17218 - RNA, 20 nt, Artificial Sequence
  targeting sequence with CTCN PAM
ucucugugccuugguuucuc

SEQ ID NO: 17219 - RNA, 20 nt, Artificial Sequence
  targeting sequence with CTCN PAM
gcucuucucugugccuuggu

SEQ ID NO: 17220 - RNA, 20 nt, Artificial Sequence
  targeting sequence with CTCN PAM
ggcagacccuucggggaggc

SEQ ID NO: 17221 - RNA, 20 nt, Artificial Sequence
  targeting sequence with CTCN PAM
ccgaagggucugccagagcu

SEQ ID NO: 17222 - RNA, 20 nt, Artificial Sequence
  targeting sequence with CTCN PAM
ggaagaggcgggucacccag

SEQ ID NO: 17223 - RNA, 20 nt, Artificial Sequence
  targeting sequence with CTCN PAM
uccagaggggucagggaaac

SEQ ID NO: 17224 - RNA, 20 nt, Artificial Sequence
  targeting sequence with CTCN PAM
agggcuuugagguuauccag

SEQ ID NO: 17225 - RNA, 20 nt, Artificial Sequence
  targeting sequence with CTCN PAM
aagcccuggagcugggugac

SEQ ID NO: 17226 - RNA, 20 nt, Artificial Sequence
  targeting sequence with CTCN PAM
gggcggccuggcuggcuggc

SEQ ID NO: 17227 - RNA, 20 nt, Artificial Sequence
  targeting sequence with CTCN PAM
ugcugcguacccauuuuaca

SEQ ID NO: 17228 - RNA, 20 nt, Artificial Sequence
  targeting sequence with CTCN PAM
ucuguaaaauggguacgcag

SEQ ID NO: 17229 - RNA, 20 nt, Artificial Sequence
  targeting sequence with CTCN PAM
gcuuucucaucuguaaaaug

SEQ ID NO: 17230 - RNA, 20 nt, Artificial Sequence
  targeting sequence with CTCN PAM
ugacuccuaagucucacagc

SEQ ID NO: 17231 - RNA, 20 nt, Artificial Sequence
  targeting sequence with CTCN PAM
uaagucucacagcucuuacc

SEQ ID NO: 17232 - RNA, 20 nt, Artificial Sequence
  targeting sequence with CTCN PAM
cagcucuuaccucacuaugg

SEQ ID NO: 17233 - RNA, 20 nt, Artificial Sequence
  targeting sequence with CTCN PAM
uaccucacuaugggaggcac

SEQ ID NO: 17234 - RNA, 20 nt, Artificial Sequence
  targeting sequence with CTCN PAM
cuaugggaggcaccaucccc

SEQ ID NO: 17235 - RNA, 20 nt, Artificial Sequence
  targeting sequence with CTCN PAM
cauagugagguaagagcugu

SEQ ID NO: 17236 - RNA, 20 nt, Artificial Sequence
  targeting sequence with CTCN PAM
gaaccucggacuccacaucu

SEQ ID NO: 17237 - RNA, 20 nt, Artificial Sequence
  targeting sequence with CTCN PAM
gacuccacaucuguaaaaua

SEQ ID NO: 17238 - RNA, 20 nt, Artificial Sequence
  targeting sequence with CTCN PAM
acaucuguaaaauaagacag

SEQ ID NO: 17239 - RNA, 20 nt, Artificial Sequence
  targeting sequence with CTCN PAM
guccuuccauaagcccuagg

SEQ ID NO: 17240 - RNA, 20 nt, Artificial Sequence
  targeting sequence with CTCN PAM
uaggagccuucagugcuaag

SEQ ID NO: 17241 - RNA, 20 nt, Artificial Sequence
  targeting sequence with CTCN PAM
uaugagcucaguccuuccau

SEQ ID NO: 17242 - RNA, 20 nt, Artificial Sequence
  targeting sequence with CTCN PAM
auaaauguucccaauuagcu

SEQ ID NO: 17243 - RNA, 20 nt, Artificial Sequence
  targeting sequence with CTCN PAM
guggucugcauagcuaauug

SEQ ID NO: 17244 - RNA, 20 nt, Artificial Sequence
  targeting sequence with CTCN PAM
gcuccguggucugcauagcu

SEQ ID NO: 17245 - RNA, 20 nt, Artificial Sequence
  targeting sequence with CTCN PAM
ggagcucccgaggacaggga

SEQ ID NO: 17246 - RNA, 20 nt, Artificial Sequence
  targeting sequence with CTCN PAM
cgagccucugcuccgugguc

SEQ ID NO: 17247 - RNA, 20 nt, Artificial Sequence
  targeting sequence with CTCN PAM
cgaggacagggacaagccac

SEQ ID NO: 17248 - RNA, 20 nt, Artificial Sequence
  targeting sequence with CTCN PAM
ggagcucccgagccucugcu

SEQ ID NO: 17249 - RNA, 20 nt, Artificial Sequence
  targeting sequence with CTCN PAM
accgcuuccugaagucaaag

SEQ ID NO: 17250 - RNA, 20 nt, Artificial Sequence
  targeting sequence with CTCN PAM
gaugcuuugacuucaggaag

SEQ ID NO: 17251 - RNA, 20 nt, Artificial Sequence
  targeting sequence with CTCN PAM
ccaaggacacaguaguggga

SEQ ID NO: 17252 - RNA, 20 nt, Artificial Sequence
  targeting sequence with CTCN PAM
cacuacuguguccuugguga

SEQ ID NO: 17253 - RNA, 20 nt, Artificial Sequence
  targeting sequence with CTCN PAM
ggccucggccugcucugccc

SEQ ID NO: 17254 - RNA, 20 nt, Artificial Sequence
  targeting sequence with CTCN PAM
gccugcucugcccuggcgcc

SEQ ID NO: 17255 - RNA, 20 nt, Artificial Sequence
  targeting sequence with CTCN PAM
gcccuggcgccugggaacca

SEQ ID NO: 17256 - RNA, 20 nt, Artificial Sequence
  targeting sequence with CTCN PAM
agcagccauuguuuaguuag

SEQ ID NO: 17257 - RNA, 20 nt, Artificial Sequence
  targeting sequence with CTCN PAM
cccuucaugaagcuguuucu

SEQ ID NO: 17258 - RNA, 20 nt, Artificial Sequence
  targeting sequence with CTCN PAM
uuccggcccggccuggcccc

SEQ ID NO: 17259 - RNA, 20 nt, Artificial Sequence
  targeting sequence with CTCN PAM
ccucccccugggucccagag

SEQ ID NO: 17260 - RNA, 20 nt, Artificial Sequence
  targeting sequence with CTCN PAM
cccugggucccagaggagca

SEQ ID NO: 17261 - RNA, 20 nt, Artificial Sequence
  targeting sequence with CTCN PAM
gggacccagggggaggggag

SEQ ID NO: 17262 - RNA, 20 nt, Artificial Sequence
  targeting sequence with CTCN PAM
ucugggacccagggggaggg

SEQ ID NO: 17263 - RNA, 20 nt, Artificial Sequence
  targeting sequence with CTCN PAM
ucccuggcccagggaaaagg

SEQ ID NO: 17264 - RNA, 20 nt, Artificial Sequence
  targeting sequence with CTCN PAM
ccccagcaggaggggcagag

SEQ ID NO: 17265 - RNA, 20 nt, Artificial Sequence
  targeting sequence with CTCN PAM
ugcuggggggagggaagccu

SEQ ID NO: 17266 - RNA, 20 nt, Artificial Sequence
  targeting sequence with CTCN PAM
gccccuccugcuggggggag

SEQ ID NO: 17267 - RNA, 20 nt, Artificial Sequence
  targeting sequence with CTCN PAM
cagcuuccuccccugaaggg

SEQ ID NO: 17268 - RNA, 20 nt, Artificial Sequence
  targeting sequence with CTCN PAM
ccugaagggacuccaggcca

SEQ ID NO: 17269 - RNA, 20 nt, Artificial Sequence
  targeting sequence with CTCN PAM
aggccaggagccgagaaaua

SEQ ID NO: 17270 - RNA, 20 nt, Artificial Sequence
  targeting sequence with CTCN PAM
uggccuggagucccuucagg

SEQ ID NO: 17271 - RNA, 20 nt, Artificial Sequence
  targeting sequence with CTCN PAM
gcuccuggccuggagucccu

SEQ ID NO: 17272 - RNA, 20 nt, Artificial Sequence
  targeting sequence with CTCN PAM
ccagggaacacuggcaguuc

SEQ ID NO: 17273 - RNA, 20 nt, Artificial Sequence
  targeting sequence with CTCN PAM
agggaacacuggcaguuccc

SEQ ID NO: 17274 - RNA, 20 nt, Artificial Sequence
  targeting sequence with CTCN PAM
uggggcuggggggacuugga

SEQ ID NO: 17275 - RNA, 20 nt, Artificial Sequence
  targeting sequence with CTCN PAM
aaguccccccagccccagga

SEQ ID NO: 17276 - RNA, 20 nt, Artificial Sequence
  targeting sequence with CTCN PAM
cacccuccuccccagccccu

SEQ ID NO: 17277 - RNA, 20 nt, Artificial Sequence
  targeting sequence with CTCN PAM
uccccagccccuggucuccu

SEQ ID NO: 17278 - RNA, 20 nt, Artificial Sequence
  targeting sequence with CTCN PAM
ccagccccuggucuccucgg

SEQ ID NO: 17279 - RNA, 20 nt, Artificial Sequence
  targeting sequence with CTCN PAM
ucgggguccagcccauaugc

SEQ ID NO: 17280 - RNA, 20 nt, Artificial Sequence
  targeting sequence with CTCN PAM
ggguccagcccauaugccug

SEQ ID NO: 17281 - RNA, 20 nt, Artificial Sequence
  targeting sequence with CTCN PAM
gcagcaggacucuaccgcug

SEQ ID NO: 17282 - RNA, 20 nt, Artificial Sequence
  targeting sequence with CTCN PAM
accgcuggucccagagucau

SEQ ID NO: 17283 - RNA, 20 nt, Artificial Sequence
  targeting sequence with CTCN PAM
gggaccagcgguagaguccu

SEQ ID NO: 17284 - RNA, 20 nt, Artificial Sequence
  targeting sequence with CTCN PAM
aagcagcccugucuucuugg

SEQ ID NO: 17285 - RNA, 20 nt, Artificial Sequence
  targeting sequence with CTCN PAM
gggcuggauuccaugagcug

SEQ ID NO: 17286 - RNA, 20 nt, Artificial Sequence
  targeting sequence with CTCN PAM
uggaauccagcccggagaug

SEQ ID NO: 17287 - RNA, 20 nt, Artificial Sequence
  targeting sequence with CTCN PAM
guguccccagcucauggaau

SEQ ID NO: 17288 - RNA, 20 nt, Artificial Sequence
  targeting sequence with CTCN PAM
cuccagcugcccacauccga

SEQ ID NO: 17289 - RNA, 20 nt, Artificial Sequence
  targeting sequence with CTCN PAM
ccagcugcccacauccgagc

SEQ ID NO: 17290 - RNA, 20 nt, Artificial Sequence
  targeting sequence with CTCN PAM
agcugcccacauccgagcuc

SEQ ID NO: 17291 - RNA, 20 nt, Artificial Sequence
  targeting sequence with CTCN PAM
gaugugggcagcuggagaga

SEQ ID NO: 17292 - RNA, 20 nt, Artificial Sequence
  targeting sequence with CTCN PAM
gaggcccagccccaggaugg

SEQ ID NO: 17293 - RNA, 20 nt, Artificial Sequence
  targeting sequence with CTCN PAM
gagcucggaugugggcagcu

SEQ ID NO: 17294 - RNA, 20 nt, Artificial Sequence
  targeting sequence with CTCN PAM
ccauccuggggcugggccuc

SEQ ID NO: 17295 - RNA, 20 nt, Artificial Sequence
  targeting sequence with CTCN PAM
uaguaacaguucgguagagu

SEQ ID NO: 17296 - RNA, 20 nt, Artificial Sequence
  targeting sequence with CTCN PAM
accgaacuguuacuaugaga

SEQ ID NO: 17297 - RNA, 20 nt, Artificial Sequence
  targeting sequence with CTCN PAM
gcacaaagcagacugcacac

SEQ ID NO: 17298 - RNA, 20 nt, Artificial Sequence
  targeting sequence with CTCN PAM
uucuguauuaucucauucaa

SEQ ID NO: 17299 - RNA, 20 nt, Artificial Sequence
  targeting sequence with CTCN PAM
uucaacccucaccacacccu

SEQ ID NO: 17300 - RNA, 20 nt, Artificial Sequence
  targeting sequence with CTCN PAM
ccacacccugaaagaguuga

SEQ ID NO: 17301 - RNA, 20 nt, Artificial Sequence
  targeting sequence with CTCN PAM
uucaggguguggugaggguu

SEQ ID NO: 17302 - RNA, 20 nt, Artificial Sequence
  targeting sequence with CTCN PAM
guuuccuuuacuguaaagca

SEQ ID NO: 17303 - RNA, 20 nt, Artificial Sequence
  targeting sequence with CTCN PAM
gugccucaguuuccuuuacu

SEQ ID NO: 17304 - RNA, 20 nt, Artificial Sequence
  targeting sequence with CTCN PAM
cugugccucaguuuccuuua

SEQ ID NO: 17305 - RNA, 20 nt, Artificial Sequence
  targeting sequence with CTCN PAM
agcgcaggccugcgggcucc

SEQ ID NO: 17306 - RNA, 20 nt, Artificial Sequence
  targeting sequence with CTCN PAM
agauccccgcccuuaaccac

SEQ ID NO: 17307 - RNA, 20 nt, Artificial Sequence
  targeting sequence with CTCN PAM
ccacccgccgcucugcuggg

SEQ ID NO: 17308 - RNA, 20 nt, Artificial Sequence
  targeting sequence with CTCN PAM
gcugggagccaccaaugguu

SEQ ID NO: 17309 - RNA, 20 nt, Artificial Sequence
  targeting sequence with CTCN PAM
cagcagagcggcgggugggg

SEQ ID NO: 17310 - RNA, 20 nt, Artificial Sequence
  targeting sequence with CTCN PAM
aagcggcugauuuccuggca

SEQ ID NO: 17311 - RNA, 20 nt, Artificial Sequence
  targeting sequence with CTCN PAM
aaacccaggguuuuuccagc

SEQ ID NO: 17312 - RNA, 20 nt, Artificial Sequence
  targeting sequence with CTCN PAM
guuuccccagcucaaaaccc

SEQ ID NO: 17313 - RNA, 20 nt, Artificial Sequence
  targeting sequence with CTCN PAM
agaagcagccaucaccuuga

SEQ ID NO: 17314 - RNA, 20 nt, Artificial Sequence
  targeting sequence with CTCN PAM
cuagaagcagccaucaccuu

SEQ ID NO: 17315 - RNA, 20 nt, Artificial Sequence
  targeting sequence with CTCN PAM
gucaccucaaacaaagauag

SEQ ID NO: 17316 - RNA, 20 nt, Artificial Sequence
  targeting sequence with CTCN PAM
aacaaagauagcgggcagag

SEQ ID NO: 17317 - RNA, 20 nt, Artificial Sequence
  targeting sequence with CTCN PAM
gcccgcuaucuuuguuugag

SEQ ID NO: 17318 - RNA, 20 nt, Artificial Sequence
  targeting sequence with CTCN PAM
agccucugcccgcuaucuuu

SEQ ID NO: 17319 - RNA, 20 nt, Artificial Sequence
  targeting sequence with CTCN PAM
acuccaaggccucugccugc

SEQ ID NO: 17320 - RNA, 20 nt, Artificial Sequence
  targeting sequence with CTCN PAM
aaggccucugccugcgggcc

SEQ ID NO: 17321 - RNA, 20 nt, Artificial Sequence
  targeting sequence with CTCN PAM
gccugcgggcccccccccau

SEQ ID NO: 17322 - RNA, 20 nt, Artificial Sequence
  targeting sequence with CTCN PAM
gaucgguaaauaaugggggg

SEQ ID NO: 17323 - RNA, 20 nt, Artificial Sequence
  targeting sequence with CTCN PAM
uaauggagcugcgagcuucc

SEQ ID NO: 17324 - RNA, 20 nt, Artificial Sequence
  targeting sequence with CTCN PAM
auuacgagucccggcaaggc

SEQ ID NO: 17325 - RNA, 20 nt, Artificial Sequence
  targeting sequence with CTCN PAM
cagcuccauuacgagucccg

SEQ ID NO: 17326 - RNA, 20 nt, Artificial Sequence
  targeting sequence with CTCN PAM
cccuccagcgcaugauuuau

SEQ ID NO: 17327 - RNA, 20 nt, Artificial Sequence
  targeting sequence with CTCN PAM
agcgcaugauuuaucaaguu

SEQ ID NO: 17328 - RNA, 20 nt, Artificial Sequence
  targeting sequence with CTCN PAM
ccgccuaguccaccguccuu

SEQ ID NO: 17329 - RNA, 20 nt, Artificial Sequence
  targeting sequence with CTCN PAM
augcagucaagaucuggggg

SEQ ID NO: 17330 - RNA, 20 nt, Artificial Sequence
  targeting sequence with CTCN PAM
gcugauacucgaugcaguca

SEQ ID NO: 17331 - RNA, 20 nt, Artificial Sequence
  targeting sequence with CTCN PAM
acccugcucggcugauacuc

SEQ ID NO: 17332 - RNA, 20 nt, Artificial Sequence
  targeting sequence with CTCN PAM
gacauggccuuuggaaagaa

SEQ ID NO: 17333 - RNA, 20 nt, Artificial Sequence
  targeting sequence with CTCN PAM
cugccccccaaguacagccg

SEQ ID NO: 17334 - RNA, 20 nt, Artificial Sequence
  targeting sequence with CTCN PAM
gagacuuucugggcuugucc

SEQ ID NO: 17335 - RNA, 20 nt, Artificial Sequence
  targeting sequence with CTCN PAM
gagugccagccacguggacu

SEQ ID NO: 17336 - RNA, 20 nt, Artificial Sequence
  targeting sequence with CTCN PAM
ggaaccggcugguuuccaug

SEQ ID NO: 17337 - RNA, 20 nt, Artificial Sequence
  targeting sequence with CTCN PAM
gacagccauguggggauugc

SEQ ID NO: 17338 - RNA, 20 nt, Artificial Sequence
  targeting sequence with CTCN PAM
agcucugacagccauguggg

SEQ ID NO: 17339 - RNA, 20 nt, Artificial Sequence
  targeting sequence with CTCN PAM
ccagcucugacagccaugug

SEQ ID NO: 17340 - RNA, 20 nt, Artificial Sequence
  targeting sequence with CTCN PAM
ggaguuaccugguccagcca

SEQ ID NO: 17341 - RNA, 20 nt, Artificial Sequence
  targeting sequence with CTCN PAM
cgagggccucuccagcucug

SEQ ID NO: 17342 - RNA, 20 nt, Artificial Sequence
  targeting sequence with CTCN PAM
gggugagcgccuccgccccu

SEQ ID NO: 17343 - RNA, 20 nt, Artificial Sequence
  targeting sequence with CTCN PAM
cccggagcccccacuguggc

SEQ ID NO: 17344 - RNA, 20 nt, Artificial Sequence
  targeting sequence with CTCN PAM
gccccuggauccugccagca

SEQ ID NO: 17345 - RNA, 20 nt, Artificial Sequence
  targeting sequence with CTCN PAM
ccuuuccccaaagcccugcu

SEQ ID NO: 17346 - RNA, 20 nt, Artificial Sequence
  targeting sequence with CTCN PAM
uuuccccaaagcccugcugg

SEQ ID NO: 17347 - RNA, 20 nt, Artificial Sequence
  targeting sequence with CTCN PAM
ccgcagcccacaugacagca

SEQ ID NO: 17348 - RNA, 20 nt, Artificial Sequence
  targeting sequence with CTCN PAM
cagcuuccccucggccugcu

SEQ ID NO: 17349 - RNA, 20 nt, Artificial Sequence
  targeting sequence with CTCN PAM
gcuuccccucggccugcuac

SEQ ID NO: 17350 - RNA, 20 nt, Artificial Sequence
  targeting sequence with CTCN PAM
gccugcuacccaagccacau

SEQ ID NO: 17351 - RNA, 20 nt, Artificial Sequence
  targeting sequence with CTCN PAM
gagccuuugccccuaucgug

SEQ ID NO: 17352 - RNA, 20 nt, Artificial Sequence
  targeting sequence with CTCN PAM
gagauguuggaauguggcuu

SEQ ID NO: 17353 - RNA, 20 nt, Artificial Sequence
  targeting sequence with CTCN PAM
gccuggaaugccuuccccag

SEQ ID NO: 17354 - RNA, 20 nt, Artificial Sequence
  targeting sequence with CTCN PAM
aaccuccccuccuccaggaa

SEQ ID NO: 17355 - RNA, 20 nt, Artificial Sequence
  targeting sequence with CTCN PAM
ccuccuccaggaagcccucc

SEQ ID NO: 17356 - RNA, 20 nt, Artificial Sequence
  targeting sequence with CTCN PAM
uccaggaagcccucccgcac

SEQ ID NO: 17357 - RNA, 20 nt, Artificial Sequence
  targeting sequence with CTCN PAM
aggaagcccucccgcacucc

SEQ ID NO: 17358 - RNA, 20 nt, Artificial Sequence
  targeting sequence with CTCN PAM
cgcacuccucugaugagcug

SEQ ID NO: 17359 - RNA, 20 nt, Artificial Sequence
  targeting sequence with CTCN PAM
ucugaugagcugguuagugu

SEQ ID NO: 17360 - RNA, 20 nt, Artificial Sequence
  targeting sequence with CTCN PAM
gaugagcugguuagugugug

SEQ ID NO: 17361 - RNA, 20 nt, Artificial Sequence
  targeting sequence with CTCN PAM
ucagaggagugcgggagggc

SEQ ID NO: 17362 - RNA, 20 nt, Artificial Sequence
  targeting sequence with CTCN PAM
ucccucaccauucugggggc

SEQ ID NO: 17363 - RNA, 20 nt, Artificial Sequence
  targeting sequence with CTCN PAM
cucaccauucugggggcucc

SEQ ID NO: 17364 - RNA, 20 nt, Artificial Sequence
  targeting sequence with CTCN PAM
ccauucugggggcuccugga

SEQ ID NO: 17365 - RNA, 20 nt, Artificial Sequence
  targeting sequence with CTCN PAM
uggagaggguccaauuuguc

SEQ ID NO: 17366 - RNA, 20 nt, Artificial Sequence
  targeting sequence with CTCN PAM
aggagcccccagaaugguga

SEQ ID NO: 17367 - RNA, 20 nt, Artificial Sequence
  targeting sequence with CTCN PAM
ccaggagcccccagaauggu

SEQ ID NO: 17368 - RNA, 20 nt, Artificial Sequence
  targeting sequence with CTCN PAM
cuugggggcuguccuguagc

SEQ ID NO: 17369 - RNA, 20 nt, Artificial Sequence
  targeting sequence with CTCN PAM
ugggggcuguccuguagcaa

SEQ ID NO: 17370 - RNA, 20 nt, Artificial Sequence
  targeting sequence with CTCN PAM
gcuugcuacaggacagcccc

SEQ ID NO: 17371 - RNA, 20 nt, Artificial Sequence
  targeting sequence with CTCN PAM
ucccauacucacauacucua

SEQ ID NO: 17372 - RNA, 20 nt, Artificial Sequence
  targeting sequence with CTCN PAM
cauacucacauacucuagag

SEQ ID NO: 17373 - RNA, 20 nt, Artificial Sequence
  targeting sequence with CTCN PAM
cauacucuagagagcucccc

SEQ ID NO: 17374 - RNA, 20 nt, Artificial Sequence
  targeting sequence with CTCN PAM
agagagcuccccacccagag

SEQ ID NO: 17375 - RNA, 20 nt, Artificial Sequence
  targeting sequence with CTCN PAM
agaguaugugaguaugggag

SEQ ID NO: 17376 - RNA, 20 nt, Artificial Sequence
  targeting sequence with CTCN PAM
cuagaguaugugaguauggg

SEQ ID NO: 17377 - RNA, 20 nt, Artificial Sequence
  targeting sequence with CTCN PAM
ccacccagagcuuggacggg

SEQ ID NO: 17378 - RNA, 20 nt, Artificial Sequence
  targeting sequence with CTCN PAM
ggguggggagcucucuagag

SEQ ID NO: 17379 - RNA, 20 nt, Artificial Sequence
  targeting sequence with CTCN PAM
uugguaacaucgcaugcccg

SEQ ID NO: 17380 - RNA, 20 nt, Artificial Sequence
  targeting sequence with CTCN PAM
gguauguguggguggagaca

SEQ ID NO: 17381 - RNA, 20 nt, Artificial Sequence
  targeting sequence with CTCN PAM
acccacacauaccagaggcc

SEQ ID NO: 17382 - RNA, 20 nt, Artificial Sequence
  targeting sequence with CTCN PAM
ugcuaccgggccuguagcug

SEQ ID NO: 17383 - RNA, 20 nt, Artificial Sequence
  targeting sequence with CTCN PAM
gcaggccacccugaaaggcc

SEQ ID NO: 17384 - RNA, 20 nt, Artificial Sequence
  targeting sequence with CTCN PAM
cugcuucucacaggggccuc

SEQ ID NO: 17385 - RNA, 20 nt, Artificial Sequence
  targeting sequence with CTCN PAM
caggggccucggcggacgca

SEQ ID NO: 17386 - RNA, 20 nt, Artificial Sequence
  targeting sequence with CTCN PAM
gcggacgcagaaguucccug

SEQ ID NO: 17387 - RNA, 20 nt, Artificial Sequence
  targeting sequence with CTCN PAM
guuuccucaccuuuaaaaug

SEQ ID NO: 17388 - RNA, 20 nt, Artificial Sequence
  targeting sequence with CTCN PAM
ccuuuaaaaugggcccauuc

SEQ ID NO: 17389 - RNA, 20 nt, Artificial Sequence
  targeting sequence with CTCN PAM
ggcucacaccccuucgguca

SEQ ID NO: 17390 - RNA, 20 nt, Artificial Sequence
  targeting sequence with CTCN PAM
caccccuucggucaaagauu

SEQ ID NO: 17391 - RNA, 20 nt, Artificial Sequence
  targeting sequence with CTCN PAM
aaaaucuuugaccgaagggg

SEQ ID NO: 17392 - RNA, 20 nt, Artificial Sequence
  targeting sequence with CTCN PAM
uuccuccaaaaucuuugacc

SEQ ID NO: 17393 - RNA, 20 nt, Artificial Sequence
  targeting sequence with CTCN PAM
accuggagcaccacagucac

SEQ ID NO: 17394 - RNA, 20 nt, Artificial Sequence
  targeting sequence with CTCN PAM
agguggagcaggcuucuggc

SEQ ID NO: 17395 - RNA, 20 nt, Artificial Sequence
  targeting sequence with CTCN PAM
ggcaagaugcuuaacccuuc

SEQ ID NO: 17396 - RNA, 20 nt, Artificial Sequence
  targeting sequence with CTCN PAM
guuuccccuuccauagacug

SEQ ID NO: 17397 - RNA, 20 nt, Artificial Sequence
  targeting sequence with CTCN PAM
ccagaaccugaaugacauga

SEQ ID NO: 17398 - RNA, 20 nt, Artificial Sequence
  targeting sequence with CTCN PAM
gcaaagggcuaacacagaga

SEQ ID NO: 17399 - RNA, 20 nt, Artificial Sequence
  targeting sequence with CTCN PAM
guguuagcccuuugcagagc

SEQ ID NO: 17400 - RNA, 20 nt, Artificial Sequence
  targeting sequence with CTCN PAM
agcaacaaccacaguaauua

SEQ ID NO: 17401 - RNA, 20 nt, Artificial Sequence
  targeting sequence with CTCN PAM
gacaccagaacugccccauc

SEQ ID NO: 17402 - RNA, 20 nt, Artificial Sequence
  targeting sequence with CTCN PAM
augggccaacuccagggucg

SEQ ID NO: 17403 - RNA, 20 nt, Artificial Sequence
  targeting sequence with CTCN PAM
agggucggagaacggaggcc

SEQ ID NO: 17404 - RNA, 20 nt, Artificial Sequence
  targeting sequence with CTCN PAM
gacccuggaguuggcccaug

SEQ ID NO: 17405 - RNA, 20 nt, Artificial Sequence
  targeting sequence with CTCN PAM
guucuccgacccuggaguug

SEQ ID NO: 17406 - RNA, 20 nt, Artificial Sequence
  targeting sequence with CTCN PAM
cucccggggcuccugcccuc

SEQ ID NO: 17407 - RNA, 20 nt, Artificial Sequence
  targeting sequence with CTCN PAM
cccggggcuccugcccuccc

SEQ ID NO: 17408 - RNA, 20 nt, Artificial Sequence
  targeting sequence with CTCN PAM
cggggcuccugcccucccgc

SEQ ID NO: 17409 - RNA, 20 nt, Artificial Sequence
  targeting sequence with CTCN PAM
ugcccucccgcuccuguccc

SEQ ID NO: 17410 - RNA, 20 nt, Artificial Sequence
  targeting sequence with CTCN PAM
cgcuccugucccaguacacg

SEQ ID NO: 17411 - RNA, 20 nt, Artificial Sequence
  targeting sequence with CTCN PAM
ugucccaguacacgccacgc

SEQ ID NO: 17412 - RNA, 20 nt, Artificial Sequence
  targeting sequence with CTCN PAM
auggagaccgggagucacag

SEQ ID NO: 17413 - RNA, 20 nt, Artificial Sequence
  targeting sequence with CTCN PAM
auggagauuaaggaaaccag

SEQ ID NO: 17414 - RNA, 20 nt, Artificial Sequence
  targeting sequence with CTCN PAM
cggucuccauggagauuaag

SEQ ID NO: 17415 - RNA, 20 nt, Artificial Sequence
  targeting sequence with CTCN PAM
gcaaaguccgauucacccgc

SEQ ID NO: 17416 - RNA, 20 nt, Artificial Sequence
  targeting sequence with CTCN PAM
agucuucccugcgcucagcc

SEQ ID NO: 17417 - RNA, 20 nt, Artificial Sequence
  targeting sequence with CTCN PAM
gcccacuuuauagaugggaa

SEQ ID NO: 17418 - RNA, 20 nt, Artificial Sequence
  targeting sequence with CTCN PAM
auuuucccaucuauaaagug

SEQ ID NO: 17419 - RNA, 20 nt, Artificial Sequence
  targeting sequence with CTCN PAM
aagaacggaugggacuuucc

SEQ ID NO: 17420 - RNA, 20 nt, Artificial Sequence
  targeting sequence with CTCN PAM
gccccuuccuagcuguggaa

SEQ ID NO: 17421 - RNA, 20 nt, Artificial Sequence
  targeting sequence with CTCN PAM
ccuagcgaugugcgccugcc

SEQ ID NO: 17422 - RNA, 20 nt, Artificial Sequence
  targeting sequence with CTCN PAM
cugugggcguauccagggcg

SEQ ID NO: 17423 - RNA, 20 nt, Artificial Sequence
  targeting sequence with CTCN PAM
cccuccuggguggaccauca

SEQ ID NO: 17424 - RNA, 20 nt, Artificial Sequence
  targeting sequence with CTCN PAM
uggguggaccaucauucaca

SEQ ID NO: 17425 - RNA, 20 nt, Artificial Sequence
  targeting sequence with CTCN PAM
cauuugcacacccaaagggc

SEQ ID NO: 17426 - RNA, 20 nt, Artificial Sequence
  targeting sequence with CTCN PAM
uuugcacacccaaagggcca

SEQ ID NO: 17427 - RNA, 20 nt, Artificial Sequence
  targeting sequence with CTCN PAM
cuccuuccagaggcugauga

SEQ ID NO: 17428 - RNA, 20 nt, Artificial Sequence
  targeting sequence with CTCN PAM
uuccagaggcugaugaucgc

SEQ ID NO: 17429 - RNA, 20 nt, Artificial Sequence
  targeting sequence with CTCN PAM
ggaaggagugagcccauggc

SEQ ID NO: 17430 - RNA, 20 nt, Artificial Sequence
  targeting sequence with CTCN PAM
ccugacuuccucaggaagcu

SEQ ID NO: 17431 - RNA, 20 nt, Artificial Sequence
  targeting sequence with CTCN PAM
ggaagcugggucagccccca

SEQ ID NO: 17432 - RNA, 20 nt, Artificial Sequence
  targeting sequence with CTCN PAM
gcagaugccccagcccgccu

SEQ ID NO: 17433 - RNA, 20 nt, Artificial Sequence
  targeting sequence with CTCN PAM
ggcgggcuggggcaucugca

SEQ ID NO: 17434 - RNA, 20 nt, Artificial Sequence
  targeting sequence with CTCN PAM
auggcccagccagaggggga

SEQ ID NO: 17435 - RNA, 20 nt, Artificial Sequence
  targeting sequence with CTCN PAM
ggcugggccauagagauuca

SEQ ID NO: 17436 - RNA, 20 nt, Artificial Sequence
  targeting sequence with CTCN PAM
gugguggggaauucugcagu

SEQ ID NO: 17437 - RNA, 20 nt, Artificial Sequence
  targeting sequence with CTCN PAM
ccgugguggggaauucugca

SEQ ID NO: 17438 - RNA, 20 nt, Artificial Sequence
  targeting sequence with CTCN PAM
cagcucaccagccaccagga

SEQ ID NO: 17439 - RNA, 20 nt, Artificial Sequence
  targeting sequence with CTCN PAM
ccagccaccaggaagaggac

SEQ ID NO: 17440 - RNA, 20 nt, Artificial Sequence
  targeting sequence with CTCN PAM
uccugguggcuggugagcug

SEQ ID NO: 17441 - RNA, 20 nt, Artificial Sequence
  targeting sequence with CTCN PAM
ugcuucuaucugcggaucca

SEQ ID NO: 17442 - RNA, 20 nt, Artificial Sequence
  targeting sequence with CTCN PAM
cuccccagcugugugagcca

SEQ ID NO: 17443 - RNA, 20 nt, Artificial Sequence
  targeting sequence with CTCN PAM
ccagcugugugagccagggc

SEQ ID NO: 17444 - RNA, 20 nt, Artificial Sequence
  targeting sequence with CTCN PAM
cacagcuggggagugagggu

SEQ ID NO: 17445 - RNA, 20 nt, Artificial Sequence
  targeting sequence with CTCN PAM
cuuggccucaguuuccccuu

SEQ ID NO: 17446 - RNA, 20 nt, Artificial Sequence
  targeting sequence with CTCN PAM
uggccucaguuuccccuucu

SEQ ID NO: 17447 - RNA, 20 nt, Artificial Sequence
  targeting sequence with CTCN PAM
guuuccccuucuguaagcug

SEQ ID NO: 17448 - RNA, 20 nt, Artificial Sequence
  targeting sequence with CTCN PAM
ccuggucaggcagacagugc

SEQ ID NO: 17449 - RNA, 20 nt, Artificial Sequence
  targeting sequence with CTCN PAM
uggcugccccuccccugguc

SEQ ID NO: 17450 - RNA, 20 nt, Artificial Sequence
  targeting sequence with CTCN PAM
gcaggccuuuuauaagcacc

SEQ ID NO: 17451 - RNA, 20 nt, Artificial Sequence
  targeting sequence with CTCN PAM
cgcucugcaggccuuuuaua

SEQ ID NO: 17452 - RNA, 20 nt, Artificial Sequence
  targeting sequence with CTCN PAM
gcgacgguuuuuauucacuc

SEQ ID NO: 17453 - RNA, 20 nt, Artificial Sequence
  targeting sequence with CTCN PAM
aaggagcccacaggccucuu

SEQ ID NO: 17454 - RNA, 20 nt, Artificial Sequence
  targeting sequence with CTCN PAM
uuggagugaauaaaaaccgu

SEQ ID NO: 17455 - RNA, 20 nt, Artificial Sequence
  targeting sequence with CTCN PAM
ugccuucaagacagugcugc

SEQ ID NO: 17456 - RNA, 20 nt, Artificial Sequence
  targeting sequence with CTCN PAM
ucagcccgggcacuagagac

SEQ ID NO: 17457 - RNA, 20 nt, Artificial Sequence
  targeting sequence with CTCN PAM
gcccgggcacuagagaccau

SEQ ID NO: 17458 - RNA, 20 nt, Artificial Sequence
  targeting sequence with CTCN PAM
agugcccgggcugaggaguc

SEQ ID NO: 17459 - RNA, 20 nt, Artificial Sequence
  targeting sequence with CTCN PAM
ccaucucagucucugugcug

SEQ ID NO: 17460 - RNA, 20 nt, Artificial Sequence
  targeting sequence with CTCN PAM
aucucagucucugugcuggg

SEQ ID NO: 17461 - RNA, 20 nt, Artificial Sequence
  targeting sequence with CTCN PAM
gucucugugcuggggcuggg

SEQ ID NO: 17462 - RNA, 20 nt, Artificial Sequence
  targeting sequence with CTCN PAM
gugcuggggcugggacagca

SEQ ID NO: 17463 - RNA, 20 nt, Artificial Sequence
  targeting sequence with CTCN PAM
cccaccccugccugccuuca

SEQ ID NO: 17464 - RNA, 20 nt, Artificial Sequence
  targeting sequence with CTCN PAM
ucuccuccaaggcccugacc

SEQ ID NO: 17465 - RNA, 20 nt, Artificial Sequence
  targeting sequence with CTCN PAM
uccaaggcccugacccuccc

SEQ ID NO: 17466 - RNA, 20 nt, Artificial Sequence
  targeting sequence with CTCN PAM
aaggcccugacccucccucc

SEQ ID NO: 17467 - RNA, 20 nt, Artificial Sequence
  targeting sequence with CTCN PAM
cuccucugagcauccccugu

SEQ ID NO: 17468 - RNA, 20 nt, Artificial Sequence
  targeting sequence with CTCN PAM
ucugagcauccccuguccac

SEQ ID NO: 17469 - RNA, 20 nt, Artificial Sequence
  targeting sequence with CTCN PAM
gagcauccccuguccacuga

SEQ ID NO: 17470 - RNA, 20 nt, Artificial Sequence
  targeting sequence with CTCN PAM
gaggagggagggucagggcc

SEQ ID NO: 17471 - RNA, 20 nt, Artificial Sequence
  targeting sequence with CTCN PAM
guggacaggggaugcucaga

SEQ ID NO: 17472 - RNA, 20 nt, Artificial Sequence
  targeting sequence with CTCN PAM
cucuugauacuaauaccugu

SEQ ID NO: 17473 - RNA, 20 nt, Artificial Sequence
  targeting sequence with CTCN PAM
ugauacuaauaccugugccu

SEQ ID NO: 17474 - RNA, 20 nt, Artificial Sequence
  targeting sequence with CTCN PAM
caugcagugcccaggaaaug

SEQ ID NO: 17475 - RNA, 20 nt, Artificial Sequence
  targeting sequence with CTCN PAM
ggcuuagggggcugcccaua

SEQ ID NO: 17476 - RNA, 20 nt, Artificial Sequence
  targeting sequence with CTCN PAM
gccuacucuggcuuaggggg

SEQ ID NO: 17477 - RNA, 20 nt, Artificial Sequence
  targeting sequence with CTCN PAM
cagccuacucuggcuuaggg

SEQ ID NO: 17478 - RNA, 20 nt, Artificial Sequence
  targeting sequence with CTCN PAM
cucagccuacucuggcuuag

SEQ ID NO: 17479 - RNA, 20 nt, Artificial Sequence
  targeting sequence with CTCN PAM
ggggugucucucucagccua

SEQ ID NO: 17480 - RNA, 20 nt, Artificial Sequence
  targeting sequence with CTCN PAM
uaggauguggguagauuaaa

SEQ ID NO: 17481 - RNA, 20 nt, Artificial Sequence
  targeting sequence with CTCN PAM
cuccuaggauguggguagau

SEQ ID NO: 17482 - RNA, 20 nt, Artificial Sequence
  targeting sequence with CTCN PAM
uuauaaaacaggucuuaugc

SEQ ID NO: 17483 - RNA, 20 nt, Artificial Sequence
  targeting sequence with CTCN PAM
uucuuucucauuauaaaaca

SEQ ID NO: 17484 - RNA, 20 nt, Artificial Sequence
  targeting sequence with CTCN PAM
gggccucauucuuucucauu

SEQ ID NO: 17485 - RNA, 20 nt, Artificial Sequence
  targeting sequence with CTCN PAM
cugggccucauucuuucuca

SEQ ID NO: 17486 - RNA, 20 nt, Artificial Sequence
  targeting sequence with CTCN PAM
acccccagguacaugggcau

SEQ ID NO: 17487 - RNA, 20 nt, Artificial Sequence
  targeting sequence with CTCN PAM
gggcugggagggaugucucc

SEQ ID NO: 17488 - RNA, 20 nt, Artificial Sequence
  targeting sequence with CTCN PAM
cagcccugagaaugucucga

SEQ ID NO: 17489 - RNA, 20 nt, Artificial Sequence
  targeting sequence with CTCN PAM
ugguccaagcccuaucuguu

SEQ ID NO: 17490 - RNA, 20 nt, Artificial Sequence
  targeting sequence with CTCN PAM
aggccagagggucaucucag

SEQ ID NO: 17491 - RNA, 20 nt, Artificial Sequence
  targeting sequence with CTCN PAM
ggccuggagaaacagauagg

SEQ ID NO: 17492 - RNA, 20 nt, Artificial Sequence
  targeting sequence with CTCN PAM
gccaauccuccuagaacccc

SEQ ID NO: 17493 - RNA, 20 nt, Artificial Sequence
  targeting sequence with CTCN PAM
uagaacccccucuccuaaau

SEQ ID NO: 17494 - RNA, 20 nt, Artificial Sequence
  targeting sequence with CTCN PAM
ccuaaauccugccaaguguc

SEQ ID NO: 17495 - RNA, 20 nt, Artificial Sequence
  targeting sequence with CTCN PAM
uaaauccugccaagugucuc

SEQ ID NO: 17496 - RNA, 20 nt, Artificial Sequence
  targeting sequence with CTCN PAM
gcuugcacccuucgucacug

SEQ ID NO: 17497 - RNA, 20 nt, Artificial Sequence
  targeting sequence with CTCN PAM
cagugacgaagggugcaagc

SEQ ID NO: 17498 - RNA, 20 nt, Artificial Sequence
  targeting sequence with CTCN PAM
cagcccccagcccaaaccca

SEQ ID NO: 17499 - RNA, 20 nt, Artificial Sequence
  targeting sequence with CTCN PAM
cucucccuccgcccccaccu

SEQ ID NO: 17500 - RNA, 20 nt, Artificial Sequence
  targeting sequence with CTCN PAM
cucccuccgcccccaccugg

SEQ ID NO: 17501 - RNA, 20 nt, Artificial Sequence
  targeting sequence with CTCN PAM
cccuccgcccccaccuggca

SEQ ID NO: 17502 - RNA, 20 nt, Artificial Sequence
  targeting sequence with CTCN PAM
cuccgcccccaccuggcauc

SEQ ID NO: 17503 - RNA, 20 nt, Artificial Sequence
  targeting sequence with CTCN PAM
gcccccaccuggcaucucag

SEQ ID NO: 17504 - RNA, 20 nt, Artificial Sequence
  targeting sequence with CTCN PAM
gccccuaaauuggugcaaaa

SEQ ID NO: 17505 - RNA, 20 nt, Artificial Sequence
  targeting sequence with CTCN PAM
ccaaccuaugaaugaccaua

SEQ ID NO: 17506 - RNA, 20 nt, Artificial Sequence
  targeting sequence with CTCN PAM
gucugccccaccuuguuggg

SEQ ID NO: 17507 - RNA, 20 nt, Artificial Sequence
  targeting sequence with CTCN PAM
guuucccccaucaguggcac

SEQ ID NO: 17508 - RNA, 20 nt, Artificial Sequence
  targeting sequence with CTCN PAM
acaacuucccaacuggcuug

SEQ ID NO: 17509 - RNA, 20 nt, Artificial Sequence
  targeting sequence with CTCN PAM
aaacagguugugauuugagg

SEQ ID NO: 17510 - RNA, 20 nt, Artificial Sequence
  targeting sequence with CTCN PAM
aaucacaaccuguuuggagu

SEQ ID NO: 17511 - RNA, 20 nt, Artificial Sequence
  targeting sequence with CTCN PAM
auugcauguagcuuggaucc

SEQ ID NO: 17512 - RNA, 20 nt, Artificial Sequence
  targeting sequence with CTCN PAM
guuucucucaaaauaucuua

SEQ ID NO: 17513 - RNA, 20 nt, Artificial Sequence
  targeting sequence with CTCN PAM
caaaauaucuuaacugcccc

SEQ ID NO: 17514 - RNA, 20 nt, Artificial Sequence
  targeting sequence with CTCN PAM
aaauaucuuaacugccccaa

SEQ ID NO: 17515 - RNA, 20 nt, Artificial Sequence
  targeting sequence with CTCN PAM
gaaguccccaaauuuguccc

SEQ ID NO: 17516 - RNA, 20 nt, Artificial Sequence
  targeting sequence with CTCN PAM
guccccgcagcccucagaag

SEQ ID NO: 17517 - RNA, 20 nt, Artificial Sequence
  targeting sequence with CTCN PAM
gccucuggccucacacuuca

SEQ ID NO: 17518 - RNA, 20 nt, Artificial Sequence
  targeting sequence with CTCN PAM
ggccucacacuucagcagcu

SEQ ID NO: 17519 - RNA, 20 nt, Artificial Sequence
  targeting sequence with CTCN PAM
cacuucagcagcuucucccu

SEQ ID NO: 17520 - RNA, 20 nt, Artificial Sequence
  targeting sequence with CTCN PAM
cuuuggguucucgggaagaa

SEQ ID NO: 17521 - RNA, 20 nt, Artificial Sequence
  targeting sequence with CTCN PAM
ggaagaagguggagggcaga

SEQ ID NO: 17522 - RNA, 20 nt, Artificial Sequence
  targeting sequence with CTCN PAM
accuucuucccgagaaccca

SEQ ID NO: 17523 - RNA, 20 nt, Artificial Sequence
  targeting sequence with CTCN PAM
gcccuccaccuucuucccga

SEQ ID NO: 17524 - RNA, 20 nt, Artificial Sequence
  targeting sequence with CTCN PAM
cgacauuccggguucccagc

SEQ ID NO: 17525 - RNA, 20 nt, Artificial Sequence
  targeting sequence with CTCN PAM
ggaguugugggcggcucaag

SEQ ID NO: 17526 - RNA, 20 nt, Artificial Sequence
  targeting sequence with CTCN PAM
agagccugggucaggauggc

SEQ ID NO: 17527 - RNA, 20 nt, Artificial Sequence
  targeting sequence with CTCN PAM
agggauuccugccagggccc

SEQ ID NO: 17528 - RNA, 20 nt, Artificial Sequence
  targeting sequence with CTCN PAM
cgaagaacccugggcccugg

SEQ ID NO: 17529 - RNA, 20 nt, Artificial Sequence
  targeting sequence with CTCN PAM
agcaggagcgagaggcuggg

SEQ ID NO: 17530 - RNA, 20 nt, Artificial Sequence
  targeting sequence with CTCN PAM
ugcuugagggucucacgaag

SEQ ID NO: 17531 - RNA, 20 nt, Artificial Sequence
  targeting sequence with CTCN PAM
cuccugcuugagggucucac

SEQ ID NO: 17532 - RNA, 20 nt, Artificial Sequence
  targeting sequence with CTCN PAM
cgcuccugcuugagggucuc

SEQ ID NO: 17533 - RNA, 20 nt, Artificial Sequence
  targeting sequence with CTCN PAM
gccaggccuuuggaaaccca

SEQ ID NO: 17534 - RNA, 20 nt, Artificial Sequence
  targeting sequence with CTCN PAM
gucacuggcacuggguggcc

SEQ ID NO: 17535 - RNA, 20 nt, Artificial Sequence
  targeting sequence with CTCN PAM
uggucccaucuggcuggauu

SEQ ID NO: 17536 - RNA, 20 nt, Artificial Sequence
  targeting sequence with CTCN PAM
ugguucuccccagaccaaac

SEQ ID NO: 17537 - RNA, 20 nt, Artificial Sequence
  targeting sequence with CTCN PAM
ccagaccaaacucauccucu

SEQ ID NO: 17538 - RNA, 20 nt, Artificial Sequence
  targeting sequence with CTCN PAM
uccucuuccccagagguacc

SEQ ID NO: 17539 - RNA, 20 nt, Artificial Sequence
  targeting sequence with CTCN PAM
uccccagagguaccccauca

SEQ ID NO: 17540 - RNA, 20 nt, Artificial Sequence
  targeting sequence with CTCN PAM
ggggaagaggaugaguuugg

SEQ ID NO: 17541 - RNA, 20 nt, Artificial Sequence
  targeting sequence with CTCN PAM
gcaacaggauagauguuggu

SEQ ID NO: 17542 - RNA, 20 nt, Artificial Sequence
  targeting sequence with CTCN PAM
gggcagcuuucugcuccucc

SEQ ID NO: 17543 - RNA, 20 nt, Artificial Sequence
  targeting sequence with CTCN PAM
uccaucccaucacuccccac

SEQ ID NO: 17544 - RNA, 20 nt, Artificial Sequence
  targeting sequence with CTCN PAM
aucccaucacuccccaccac

SEQ ID NO: 17545 - RNA, 20 nt, Artificial Sequence
  targeting sequence with CTCN PAM
ccaccacuggggcugcaucc

SEQ ID NO: 17546 - RNA, 20 nt, Artificial Sequence
  targeting sequence with CTCN PAM
ggacagauuugggggcuggg

SEQ ID NO: 17547 - RNA, 20 nt, Artificial Sequence
  targeting sequence with CTCN PAM
aagcccucagcacugcugca

SEQ ID NO: 17548 - RNA, 20 nt, Artificial Sequence
  targeting sequence with CTCN PAM
gcacugcugcagaccaggcc

SEQ ID NO: 17549 - RNA, 20 nt, Artificial Sequence
  targeting sequence with CTCN PAM
agagaacaaggccggcccca

SEQ ID NO: 17550 - RNA, 20 nt, Artificial Sequence
  targeting sequence with CTCN PAM
ggagacauggcuggccuggu

SEQ ID NO: 17551 - RNA, 20 nt, Artificial Sequence
  targeting sequence with CTCN PAM
ccacugccaucuggcaccca

SEQ ID NO: 17552 - RNA, 20 nt, Artificial Sequence
  targeting sequence with CTCN PAM
guggugggugccagauggca

SEQ ID NO: 17553 - RNA, 20 nt, Artificial Sequence
  targeting sequence with CTCN PAM
agauauauuugcgacugagu

SEQ ID NO: 17554 - RNA, 20 nt, Artificial Sequence
  targeting sequence with CTCN PAM
gucgcaaauauaucuugagc

SEQ ID NO: 17555 - RNA, 20 nt, Artificial Sequence
  targeting sequence with CTCN PAM
cgggaauagauuccuucacu

SEQ ID NO: 17556 - RNA, 20 nt, Artificial Sequence
  targeting sequence with CTCN PAM
gccucucagccacucucccu

SEQ ID NO: 17557 - RNA, 20 nt, Artificial Sequence
  targeting sequence with CTCN PAM
cagccacucucccuccucca

SEQ ID NO: 17558 - RNA, 20 nt, Artificial Sequence
  targeting sequence with CTCN PAM
gccacucucccuccuccauu

SEQ ID NO: 17559 - RNA, 20 nt, Artificial Sequence
  targeting sequence with CTCN PAM
cccuccuccauugcuccuuc

SEQ ID NO: 17560 - RNA, 20 nt, Artificial Sequence
  targeting sequence with CTCN PAM
cuccuccauugcuccuucuc

SEQ ID NO: 17561 - RNA, 20 nt, Artificial Sequence
  targeting sequence with CTCN PAM
uccauugcuccuucucacca

SEQ ID NO: 17562 - RNA, 20 nt, Artificial Sequence
  targeting sequence with CTCN PAM
auugcuccuucucaccagcu

SEQ ID NO: 17563 - RNA, 20 nt, Artificial Sequence
  targeting sequence with CTCN PAM
uucucaccagcuaccuaggg

SEQ ID NO: 17564 - RNA, 20 nt, Artificial Sequence
  targeting sequence with CTCN PAM
ccagcuaccuaggggcuuuc

SEQ ID NO: 17565 - RNA, 20 nt, Artificial Sequence
  targeting sequence with CTCN PAM
uuuaauacccccaacagccc

SEQ ID NO: 17566 - RNA, 20 nt, Artificial Sequence
  targeting sequence with CTCN PAM
uagggcuguuggggguauua

SEQ ID NO: 17567 - RNA, 20 nt, Artificial Sequence
  targeting sequence with CTCN PAM
ugaauaccugccucuuaggg

SEQ ID NO: 17568 - RNA, 20 nt, Artificial Sequence
  targeting sequence with CTCN PAM
ccgcugcagaaggggaaugc

SEQ ID NO: 17569 - RNA, 20 nt, Artificial Sequence
  targeting sequence with CTCN PAM
ggugccugcugagaccacuc

SEQ ID NO: 17570 - RNA, 20 nt, Artificial Sequence
  targeting sequence with CTCN PAM
gcaggcaccugagucucccc

SEQ ID NO: 17571 - RNA, 20 nt, Artificial Sequence
  targeting sequence with CTCN PAM
acuucucuggcuaaaacccu

SEQ ID NO: 17572 - RNA, 20 nt, Artificial Sequence
  targeting sequence with CTCN PAM
ggcuaaaacccuucauggcu

SEQ ID NO: 17573 - RNA, 20 nt, Artificial Sequence
  targeting sequence with CTCN PAM
caggaccccaggauaaaguc

SEQ ID NO: 17574 - RNA, 20 nt, Artificial Sequence
  targeting sequence with CTCN PAM
caaggacggucuccccaggc

SEQ ID NO: 17575 - RNA, 20 nt, Artificial Sequence
  targeting sequence with CTCN PAM
ccaggccucccuggcccuug

SEQ ID NO: 17576 - RNA, 20 nt, Artificial Sequence
  targeting sequence with CTCN PAM
cuggcccuugugucaugugc

SEQ ID NO: 17577 - RNA, 20 nt, Artificial Sequence
  targeting sequence with CTCN PAM
acucgccuggccacgcagac

SEQ ID NO: 17578 - RNA, 20 nt, Artificial Sequence
  targeting sequence with CTCN PAM
ccuggccacgcagacccccu

SEQ ID NO: 17579 - RNA, 20 nt, Artificial Sequence
  targeting sequence with CTCN PAM
agccugcucacagccuucgc

SEQ ID NO: 17580 - RNA, 20 nt, Artificial Sequence
  targeting sequence with CTCN PAM
agggggucugcguggccagg

SEQ ID NO: 17581 - RNA, 20 nt, Artificial Sequence
  targeting sequence with CTCN PAM
cagccuucgcacaggcugcu

SEQ ID NO: 17582 - RNA, 20 nt, Artificial Sequence
  targeting sequence with CTCN PAM
cuuugccuggaugccuuucc

SEQ ID NO: 17583 - RNA, 20 nt, Artificial Sequence
  targeting sequence with CTCN PAM
ucuccggccucaccuggcuu

SEQ ID NO: 17584 - RNA, 20 nt, Artificial Sequence
  targeting sequence with CTCN PAM
ggccucaccuggcuuccucc

SEQ ID NO: 17585 - RNA, 20 nt, Artificial Sequence
  targeting sequence with CTCN PAM
ccuggcuuccuccugcuccu

SEQ ID NO: 17586 - RNA, 20 nt, Artificial Sequence
  targeting sequence with CTCN PAM
ugcuccuccgcccccuccgc

SEQ ID NO: 17587 - RNA, 20 nt, Artificial Sequence
  targeting sequence with CTCN PAM
uccgcccccuccgcugggcu

SEQ ID NO: 17588 - RNA, 20 nt, Artificial Sequence
  targeting sequence with CTCN PAM
gcccccuccgcugggcuccc

SEQ ID NO: 17589 - RNA, 20 nt, Artificial Sequence
  targeting sequence with CTCN PAM
gcugggcucccuccacccuc

SEQ ID NO: 17590 - RNA, 20 nt, Artificial Sequence
  targeting sequence with CTCN PAM
cuccacccucauucucccuu

SEQ ID NO: 17591 - RNA, 20 nt, Artificial Sequence
  targeting sequence with CTCN PAM
acccucauucucccuuugcg

SEQ ID NO: 17592 - RNA, 20 nt, Artificial Sequence
  targeting sequence with CTCN PAM
uucucccuuugcggcacgca

SEQ ID NO: 17593 - RNA, 20 nt, Artificial Sequence
  targeting sequence with CTCN PAM
cuuugcggcacgcauugccc

SEQ ID NO: 17594 - RNA, 20 nt, Artificial Sequence
  targeting sequence with CTCN PAM
gcucaccugcccagcccaca

SEQ ID NO: 17595 - RNA, 20 nt, Artificial Sequence
  targeting sequence with CTCN PAM
ccugcccagcccacaagagu

SEQ ID NO: 17596 - RNA, 20 nt, Artificial Sequence
  targeting sequence with CTCN PAM
ugugggcugggcaggugagc

SEQ ID NO: 17597 - RNA, 20 nt, Artificial Sequence
  targeting sequence with CTCN PAM
cuuuguuucuacucuugugg

SEQ ID NO: 17598 - RNA, 20 nt, Artificial Sequence
  targeting sequence with CTCN PAM
ccagggcacagcaugggacu

SEQ ID NO: 17599 - RNA, 20 nt, Artificial Sequence
  targeting sequence with CTCN PAM
caauagggacuuaguaaaug

SEQ ID NO: 17600 - RNA, 20 nt, Artificial Sequence
  targeting sequence with CTCN PAM
auagacauuuacuaaguccc

SEQ ID NO: 17601 - RNA, 20 nt, Artificial Sequence
  targeting sequence with CTCN PAM
uacuucuagccccagaugac

SEQ ID NO: 17602 - RNA, 20 nt, Artificial Sequence
  targeting sequence with CTCN PAM
ccaggaccaagcagagaccu

SEQ ID NO: 17603 - RNA, 20 nt, Artificial Sequence
  targeting sequence with CTCN PAM
aggaccaagcagagaccugu

SEQ ID NO: 17604 - RNA, 20 nt, Artificial Sequence
  targeting sequence with CTCN PAM
gcuugguccuggagagcagu

SEQ ID NO: 17605 - RNA, 20 nt, Artificial Sequence
  targeting sequence with CTCN PAM
aagggacauuauuagcacag

SEQ ID NO: 17606 - RNA, 20 nt, Artificial Sequence
  targeting sequence with CTCN PAM
guguacccaguacacaguaa

SEQ ID NO: 17607 - RNA, 20 nt, Artificial Sequence
  targeting sequence with CTCN PAM
guuucuucaucugugaagug

SEQ ID NO: 17608 - RNA, 20 nt, Artificial Sequence
  targeting sequence with CTCN PAM
gggccucaguuucuucaucu

SEQ ID NO: 17609 - RNA, 20 nt, Artificial Sequence
  targeting sequence with CTCN PAM
cugggccucaguuucuucau

SEQ ID NO: 17610 - RNA, 20 nt, Artificial Sequence
  targeting sequence with CTCN PAM
aggcuguugccagcuaugca

SEQ ID NO: 17611 - RNA, 20 nt, Artificial Sequence
  targeting sequence with CTCN PAM
cccaccccugcccaugcuag

SEQ ID NO: 17612 - RNA, 20 nt, Artificial Sequence
  targeting sequence with CTCN PAM
agcaugggcagggguggggg

SEQ ID NO: 17613 - RNA, 20 nt, Artificial Sequence
  targeting sequence with CTCN PAM
agguccccggucugggccuc

SEQ ID NO: 17614 - RNA, 20 nt, Artificial Sequence
  targeting sequence with CTCN PAM
gggagauacugccaaguggc

SEQ ID NO: 17615 - RNA, 20 nt, Artificial Sequence
  targeting sequence with CTCN PAM
cagaggugcucaaggucccc

SEQ ID NO: 17616 - RNA, 20 nt, Artificial Sequence
  targeting sequence with CTCN PAM
ucgccgugcccgcugugggc

SEQ ID NO: 17617 - RNA, 20 nt, Artificial Sequence
  targeting sequence with CTCN PAM
ucuucgccgugcccgcugug

SEQ ID NO: 17618 - RNA, 20 nt, Artificial Sequence
  targeting sequence with CTCN PAM
cuguguuuuccacacccuuc

SEQ ID NO: 17619 - RNA, 20 nt, Artificial Sequence
  targeting sequence with CTCN PAM
uccccaccccaaggccacag

SEQ ID NO: 17620 - RNA, 20 nt, Artificial Sequence
  targeting sequence with CTCN PAM
guccuggggcugugucccug

SEQ ID NO: 17621 - RNA, 20 nt, Artificial Sequence
  targeting sequence with CTCN PAM
agggacacagccccaggaca

SEQ ID NO: 17622 - RNA, 20 nt, Artificial Sequence
  targeting sequence with CTCN PAM
ccagggacacagccccagga

SEQ ID NO: 17623 - RNA, 20 nt, Artificial Sequence
  targeting sequence with CTCN PAM
accuaaggggacagggccuc

SEQ ID NO: 17624 - RNA, 20 nt, Artificial Sequence
  targeting sequence with CTCN PAM
agccccccucagcuggguga

SEQ ID NO: 17625 - RNA, 20 nt, Artificial Sequence
  targeting sequence with CTCN PAM
gcugggugagucacugcacc

SEQ ID NO: 17626 - RNA, 20 nt, Artificial Sequence
  targeting sequence with CTCN PAM
cccagcugaggggggcugga

SEQ ID NO: 17627 - RNA, 20 nt, Artificial Sequence
  targeting sequence with CTCN PAM
gugcagugacucacccagcu

SEQ ID NO: 17628 - RNA, 20 nt, Artificial Sequence
  targeting sequence with CTCN PAM
cucggugcagugacucaccc

SEQ ID NO: 17629 - RNA, 20 nt, Artificial Sequence
  targeting sequence with CTCN PAM
ggcaagaaccauucugguuc

SEQ ID NO: 17630 - RNA, 20 nt, Artificial Sequence
  targeting sequence with CTCN PAM
cccucuggcaagaaccauuc

SEQ ID NO: 17631 - RNA, 20 nt, Artificial Sequence
  targeting sequence with CTCN PAM
gcccuuugguguaagcugau

SEQ ID NO: 17632 - RNA, 20 nt, Artificial Sequence
  targeting sequence with CTCN PAM
aguaguuucaggcccugugu

SEQ ID NO: 17633 - RNA, 20 nt, Artificial Sequence
  targeting sequence with CTCN PAM
guccacaggacacuucucuc

SEQ ID NO: 17634 - RNA, 20 nt, Artificial Sequence
  targeting sequence with CTCN PAM
ccauucagcgacuccccacu

SEQ ID NO: 17635 - RNA, 20 nt, Artificial Sequence
  targeting sequence with CTCN PAM
auucagcgacuccccacuga

SEQ ID NO: 17636 - RNA, 20 nt, Artificial Sequence
  targeting sequence with CTCN PAM
ccacugagacccccagugcc

SEQ ID NO: 17637 - RNA, 20 nt, Artificial Sequence
  targeting sequence with CTCN PAM
guggggagucgcugaaugga

SEQ ID NO: 17638 - RNA, 20 nt, Artificial Sequence
  targeting sequence with CTCN PAM
caggcaacuguguuuggcac

SEQ ID NO: 17639 - RNA, 20 nt, Artificial Sequence
  targeting sequence with CTCN PAM
gggguggagaugguggauga

SEQ ID NO: 17640 - RNA, 20 nt, Artificial Sequence
  targeting sequence with CTCN PAM
accccagagcuucaucucgc

SEQ ID NO: 17641 - RNA, 20 nt, Artificial Sequence
  targeting sequence with CTCN PAM
cccaccgugaccuuuacuuu

SEQ ID NO: 17642 - RNA, 20 nt, Artificial Sequence
  targeting sequence with CTCN PAM
cacgacugcccaccaucugg

SEQ ID NO: 17643 - RNA, 20 nt, Artificial Sequence
  targeting sequence with CTCN PAM
accuugggagaaggaaucug

SEQ ID NO: 17644 - RNA, 20 nt, Artificial Sequence
  targeting sequence with CTCN PAM
caaggucgaggucggucucc

SEQ ID NO: 17645 - RNA, 20 nt, Artificial Sequence
  targeting sequence with CTCN PAM
aagccccaguguugggcccg

SEQ ID NO: 17646 - RNA, 20 nt, Artificial Sequence
  targeting sequence with CTCN PAM
gugggcgggcccaacacugg

SEQ ID NO: 17647 - RNA, 20 nt, Artificial Sequence
  targeting sequence with CTCN PAM
ugaaauucuugucacagcca

SEQ ID NO: 17648 - RNA, 20 nt, Artificial Sequence
  targeting sequence with CTCN PAM
auggcugugacaagaauuuc

SEQ ID NO: 17649 - RNA, 20 nt, Artificial Sequence
  targeting sequence with CTCN PAM
gccuucuuguggugacccaa

SEQ ID NO: 17650 - RNA, 20 nt, Artificial Sequence
  targeting sequence with CTCN PAM
aucagcaaaaugcagaacuc

SEQ ID NO: 17651 - RNA, 20 nt, Artificial Sequence
  targeting sequence with CTCN PAM
acugccugccauucccuuag

SEQ ID NO: 17652 - RNA, 20 nt, Artificial Sequence
  targeting sequence with CTCN PAM
ccagacucagauggguggag

SEQ ID NO: 17653 - RNA, 20 nt, Artificial Sequence
  targeting sequence with CTCN PAM
gauggguggaggguguggga

SEQ ID NO: 17654 - RNA, 20 nt, Artificial Sequence
  targeting sequence with CTCN PAM
acccaucugagucuggcgag

SEQ ID NO: 17655 - RNA, 20 nt, Artificial Sequence
  targeting sequence with CTCN PAM
uuccucagggugaacuaugg

SEQ ID NO: 17656 - RNA, 20 nt, Artificial Sequence
  targeting sequence with CTCN PAM
gggugaacuauggggaucaa

SEQ ID NO: 17657 - RNA, 20 nt, Artificial Sequence
  targeting sequence with CTCN PAM
caaagccagugugaggagca

SEQ ID NO: 17658 - RNA, 20 nt, Artificial Sequence
  targeting sequence with CTCN PAM
cacuggcuuugggagcuggg

SEQ ID NO: 17659 - RNA, 20 nt, Artificial Sequence
  targeting sequence with CTCN PAM
ucacacuggcuuugggagcu

SEQ ID NO: 17660 - RNA, 20 nt, Artificial Sequence
  targeting sequence with CTCN PAM
cgcacccuugucaugucaac

SEQ ID NO: 17661 - RNA, 20 nt, Artificial Sequence
  targeting sequence with CTCN PAM
gacaccugggccccaugccu

SEQ ID NO: 17662 - RNA, 20 nt, Artificial Sequence
  targeting sequence with CTCN PAM
uccucauuccccacugagcc

SEQ ID NO: 17663 - RNA, 20 nt, Artificial Sequence
  targeting sequence with CTCN PAM
ucauuccccacugagcccca

SEQ ID NO: 17664 - RNA, 20 nt, Artificial Sequence
  targeting sequence with CTCN PAM
uuccccacugagccccacgg

SEQ ID NO: 17665 - RNA, 20 nt, Artificial Sequence
  targeting sequence with CTCN PAM
guggggaaugaggaggagua

SEQ ID NO: 17666 - RNA, 20 nt, Artificial Sequence
  targeting sequence with CTCN PAM
ccugcccccaaaacaccccu

SEQ ID NO: 17667 - RNA, 20 nt, Artificial Sequence
  targeting sequence with CTCN PAM
ugcccccaaaacaccccugu

SEQ ID NO: 17668 - RNA, 20 nt, Artificial Sequence
  targeting sequence with CTCN PAM
auucuccuggcccuggcauc

SEQ ID NO: 17669 - RNA, 20 nt, Artificial Sequence
  targeting sequence with CTCN PAM
uggcccuggcaucugcccac

SEQ ID NO: 17670 - RNA, 20 nt, Artificial Sequence
  targeting sequence with CTCN PAM
gagauccaaguccagaaggc

SEQ ID NO: 17671 - RNA, 20 nt, Artificial Sequence
  targeting sequence with CTCN PAM
gagugcguguguuuuggggg

SEQ ID NO: 17672 - RNA, 20 nt, Artificial Sequence
  targeting sequence with CTCN PAM
gcaucuguguuuuuaaugcc

SEQ ID NO: 17673 - RNA, 20 nt, Artificial Sequence
  targeting sequence with CTCN PAM
gcuagugcccaacuguguga

SEQ ID NO: 17674 - RNA, 20 nt, Artificial Sequence
  targeting sequence with CTCN PAM
gcaaguugcuuaaccucucu

SEQ ID NO: 17675 - RNA, 20 nt, Artificial Sequence
  targeting sequence with CTCN PAM
cugugccuguuucuucaucu

SEQ ID NO: 17676 - RNA, 20 nt, Artificial Sequence
  targeting sequence with CTCN PAM
gugccuguuucuucaucugu

SEQ ID NO: 17677 - RNA, 20 nt, Artificial Sequence
  targeting sequence with CTCN PAM
ucacauuuuacagaugaaga

SEQ ID NO: 17678 - RNA, 20 nt, Artificial Sequence
  targeting sequence with CTCN PAM
auucucaucacauuuuacag

SEQ ID NO: 17679 - RNA, 20 nt, Artificial Sequence
  targeting sequence with CTCN PAM
gguagccucuauucucauca

SEQ ID NO: 17680 - RNA, 20 nt, Artificial Sequence
  targeting sequence with CTCN PAM
cagguagccucuauucucau

SEQ ID NO: 17681 - RNA, 20 nt, Artificial Sequence
  targeting sequence with CTCN PAM
gaacaacccucucagguagc

SEQ ID NO: 17682 - RNA, 20 nt, Artificial Sequence
  targeting sequence with CTCN PAM
acaagugcuauuguuuaccc

SEQ ID NO: 17683 - RNA, 20 nt, Artificial Sequence
  targeting sequence with CTCN PAM
cacaccugguacauacuagg

SEQ ID NO: 17684 - RNA, 20 nt, Artificial Sequence
  targeting sequence with CTCN PAM
ggaaauauuugcagaauagg

SEQ ID NO: 17685 - RNA, 20 nt, Artificial Sequence
  targeting sequence with CTCN PAM
ggcacacaccuguuugccaa

SEQ ID NO: 17686 - RNA, 20 nt, Artificial Sequence
  targeting sequence with CTCN PAM
ucagaguaccgacucaugcc

SEQ ID NO: 17687 - RNA, 20 nt, Artificial Sequence
  targeting sequence with CTCN PAM
gaguaccgacucaugcccaa

SEQ ID NO: 17688 - RNA, 20 nt, Artificial Sequence
  targeting sequence with CTCN PAM
gaggaggcugcaugguuggc

SEQ ID NO: 17689 - RNA, 20 nt, Artificial Sequence
  targeting sequence with CTCN PAM
ugcccaaauaccugcguccc

SEQ ID NO: 17690 - RNA, 20 nt, Artificial Sequence
  targeting sequence with CTCN PAM
uugcacaccugccacaccca

SEQ ID NO: 17691 - RNA, 20 nt, Artificial Sequence
  targeting sequence with CTCN PAM
gacaggcucacgcaguggcc

SEQ ID NO: 17692 - RNA, 20 nt, Artificial Sequence
  targeting sequence with CTCN PAM
cgcaguggccccagaacaca

SEQ ID NO: 17693 - RNA, 20 nt, Artificial Sequence
  targeting sequence with CTCN PAM
gcaugcaccugugacccuca

SEQ ID NO: 17694 - RNA, 20 nt, Artificial Sequence
  targeting sequence with CTCN PAM
cgugcauaccugggcuuuau

SEQ ID NO: 17695 - RNA, 20 nt, Artificial Sequence
  targeting sequence with CTCN PAM
caguacgccuagguaugcgc

SEQ ID NO: 17696 - RNA, 20 nt, Artificial Sequence
  targeting sequence with CTCN PAM
ugggcgcgcauaccuaggcg

SEQ ID NO: 17697 - RNA, 20 nt, Artificial Sequence
  targeting sequence with CTCN PAM
cuugagucccugcacaugcc

SEQ ID NO: 17698 - RNA, 20 nt, Artificial Sequence
  targeting sequence with CTCN PAM
agugagugccggcucauggg

SEQ ID NO: 17699 - RNA, 20 nt, Artificial Sequence
  targeting sequence with CTCN PAM
ggggacaccuguauucucgc

SEQ ID NO: 17700 - RNA, 20 nt, Artificial Sequence
  targeting sequence with CTCN PAM
cgugcacaccuggguuccac

SEQ ID NO: 17701 - RNA, 20 nt, Artificial Sequence
  targeting sequence with CTCN PAM
gcgcgcucccaccugugacc

SEQ ID NO: 17702 - RNA, 20 nt, Artificial Sequence
  targeting sequence with CTCN PAM
caccugugacccacucagcu

SEQ ID NO: 17703 - RNA, 20 nt, Artificial Sequence
  targeting sequence with CTCN PAM
gcucacgacccgcucgguuc

SEQ ID NO: 17704 - RNA, 20 nt, Artificial Sequence
  targeting sequence with CTCN PAM
cgacccgcucgguucccgcc

SEQ ID NO: 17705 - RNA, 20 nt, Artificial Sequence
  targeting sequence with CTCN PAM
guucccgcccgcccccgccc

SEQ ID NO: 17706 - RNA, 20 nt, Artificial Sequence
  targeting sequence with CTCN PAM
acauccagguacacccgggc

SEQ ID NO: 17707 - RNA, 20 nt, Artificial Sequence
  targeting sequence with CTCN PAM
caggccggucccgugcccug

SEQ ID NO: 17708 - RNA, 20 nt, Artificial Sequence
  targeting sequence with CTCN PAM
acagcguggugcagggcacg

SEQ ID NO: 17709 - RNA, 20 nt, Artificial Sequence
  targeting sequence with CTCN PAM
gauggcggcucgcacgucgg

SEQ ID NO: 17710 - RNA, 20 nt, Artificial Sequence
  targeting sequence with CTCN PAM
cacgucggcgaagcggaagg

SEQ ID NO: 17711 - RNA, 20 nt, Artificial Sequence
  targeting sequence with CTCN PAM
gcgccuuccgcuucgccgac

SEQ ID NO: 17712 - RNA, 20 nt, Artificial Sequence
  targeting sequence with CTCN PAM
ggccgcacucugcgccuucc

SEQ ID NO: 17713 - RNA, 20 nt, Artificial Sequence
  targeting sequence with CTCN PAM
aagacagcaaagagccgcuc

SEQ ID NO: 17714 - RNA, 20 nt, Artificial Sequence
  targeting sequence with CTCN PAM
uugcugucuucgagcggccc

SEQ ID NO: 17715 - RNA, 20 nt, Artificial Sequence
  targeting sequence with CTCN PAM
cgggcugggaagaccgacac

SEQ ID NO: 17716 - RNA, 20 nt, Artificial Sequence
  targeting sequence with CTCN PAM
acagccgccuggugucgguc

SEQ ID NO: 17717 - RNA, 20 nt, Artificial Sequence
  targeting sequence with CTCN PAM
gugagcuucuuggcgucgcc

SEQ ID NO: 17718 - RNA, 20 nt, Artificial Sequence
  targeting sequence with CTCN PAM
ccgaguccuacauccaguug

SEQ ID NO: 17719 - RNA, 20 nt, Artificial Sequence
  targeting sequence with CTCN PAM
gcgccuggcucuccuugucg

SEQ ID NO: 17720 - RNA, 20 nt, Artificial Sequence
  targeting sequence with CTCN PAM
ccuugucgcccgcgcgcgcc

SEQ ID NO: 17721 - RNA, 20 nt, Artificial Sequence
  targeting sequence with CTCN PAM
uugucgcccgcgcgcgccuc

SEQ ID NO: 17722 - RNA, 20 nt, Artificial Sequence
  targeting sequence with CTCN PAM
cuguugagcgccagguacgc

SEQ ID NO: 17723 - RNA, 20 nt, Artificial Sequence
  targeting sequence with CTCN PAM
acagcgaggcgcgcgcgggc

SEQ ID NO: 17724 - RNA, 20 nt, Artificial Sequence
  targeting sequence with CTCN PAM
cgaagcccagcuugugcugc

SEQ ID NO: 17725 - RNA, 20 nt, Artificial Sequence
  targeting sequence with CTCN PAM
uuggcgcccugcuugaucuu

SEQ ID NO: 17726 - RNA, 20 nt, Artificial Sequence
  targeting sequence with CTCN PAM
agaucaagcagggcgccaag

SEQ ID NO: 17727 - RNA, 20 nt, Artificial Sequence
  targeting sequence with CTCN PAM
gacgacaacauccucaagau

SEQ ID NO: 17728 - RNA, 20 nt, Artificial Sequence
  targeting sequence with CTCN PAM
accccuccgacgacaacauc

SEQ ID NO: 17729 - RNA, 20 nt, Artificial Sequence
  targeting sequence with CTCN PAM
ucaccuucgaccucaacccc

SEQ ID NO: 17730 - RNA, 20 nt, Artificial Sequence
  targeting sequence with CTCN PAM
cuggacacgcgcggcgaccu

SEQ ID NO: 17731 - RNA, 20 nt, Artificial Sequence
  targeting sequence with CTCN PAM
ggcguguucucgaagcggug

SEQ ID NO: 17732 - RNA, 20 nt, Artificial Sequence
  targeting sequence with CTCN PAM
aagcggugguccuccaggcu

SEQ ID NO: 17733 - RNA, 20 nt, Artificial Sequence
  targeting sequence with CTCN PAM
aggcugcgguugcgcgggaa

SEQ ID NO: 17734 - RNA, 20 nt, Artificial Sequence
  targeting sequence with CTCN PAM
uucuucccgcgcaaccgcag

SEQ ID NO: 17735 - RNA, 20 nt, Artificial Sequence
  targeting sequence with CTCN PAM
ugggcgccacguacaccggu

SEQ ID NO: 17736 - RNA, 20 nt, Artificial Sequence
  targeting sequence with CTCN PAM
cgccgcgggcgcggggggca

SEQ ID NO: 17737 - RNA, 20 nt, Artificial Sequence
  targeting sequence with CTCN PAM
gcgggcggcgcggcgggcgg

SEQ ID NO: 17738 - RNA, 20 nt, Artificial Sequence
  targeting sequence with CTCN PAM
gccguggccgugcgcuuccc

SEQ ID NO: 17739 - RNA, 20 nt, Artificial Sequence
  targeting sequence with CTCN PAM
cggacaacuacaacaagauc

SEQ ID NO: 17740 - RNA, 20 nt, Artificial Sequence
  targeting sequence with CTCN PAM
cacgaggccugcggcagcug

SEQ ID NO: 17741 - RNA, 20 nt, Artificial Sequence
  targeting sequence with CTCN PAM
ugcgagcacccgcggcgccu

SEQ ID NO: 17742 - RNA, 20 nt, Artificial Sequence
  targeting sequence with CTCN PAM
gcagcugccgcaggccucgu

SEQ ID NO: 17743 - RNA, 20 nt, Artificial Sequence
  targeting sequence with CTCN PAM
gccuccaggcucagguuggc

SEQ ID NO: 17744 - RNA, 20 nt, Artificial Sequence
  targeting sequence with CTCN PAM
aggcucagguuggcgcccga

SEQ ID NO: 17745 - RNA, 20 nt, Artificial Sequence
  targeting sequence with CTCN PAM
gguuggcgcccgacagcuga

SEQ ID NO: 17746 - RNA, 20 nt, Artificial Sequence
  targeting sequence with CTCN PAM
aucagcugucgggcgccaac

SEQ ID NO: 17747 - RNA, 20 nt, Artificial Sequence
  targeting sequence with CTCN PAM
cccacgcccaccaacaacuu

SEQ ID NO: 17748 - RNA, 20 nt, Artificial Sequence
  targeting sequence with CTCN PAM
agggcgccggcccgcgccgc

SEQ ID NO: 17749 - RNA, 20 nt, Artificial Sequence
  targeting sequence with CTCN PAM
ugggggcggcgcgggccggc

SEQ ID NO: 17750 - RNA, 20 nt, Artificial Sequence
  targeting sequence with CTCN PAM
cgccgcgggcggcgcacccc

SEQ ID NO: 17751 - RNA, 20 nt, Artificial Sequence
  targeting sequence with CTCN PAM
ucgcgccgcgggcggcgcac

SEQ ID NO: 17752 - RNA, 20 nt, Artificial Sequence
  targeting sequence with CTCN PAM
ccgcgccgcgcagcccgcgc

SEQ ID NO: 17753 - RNA, 20 nt, Artificial Sequence
  targeting sequence with CTCN PAM
ccccaugcacucgccgcgcc

SEQ ID NO: 17754 - RNA, 20 nt, Artificial Sequence
  targeting sequence with CTCN PAM
cggccgcgccucgccccaug

SEQ ID NO: 17755 - RNA, 20 nt, Artificial Sequence
  targeting sequence with CTCN PAM
cggcucccggccgcgccucg

SEQ ID NO: 17756 - RNA, 20 nt, Artificial Sequence
  targeting sequence with CTCN PAM
gggcucccggcucccggccg

SEQ ID NO: 17757 - RNA, 20 nt, Artificial Sequence
  targeting sequence with CTCN PAM
cgccgccuccgggcucccgg

SEQ ID NO: 17758 - RNA, 20 nt, Artificial Sequence
  targeting sequence with CTCN PAM
ccgcgcagcccgggggcggg

SEQ ID NO: 17759 - RNA, 20 nt, Artificial Sequence
  targeting sequence with CTCN PAM
gcugcggacacgcccucacu

SEQ ID NO: 17760 - RNA, 20 nt, Artificial Sequence
  targeting sequence with CTCN PAM
cuccccgccccggccccgcc

SEQ ID NO: 17761 - RNA, 20 nt, Artificial Sequence
  targeting sequence with CTCN PAM
ccgccccggccccgcccgcc

SEQ ID NO: 17762 - RNA, 20 nt, Artificial Sequence
  targeting sequence with CTCN PAM
aggacccgcccgcggcccca

SEQ ID NO: 17763 - RNA, 20 nt, Artificial Sequence
  targeting sequence with CTCN PAM
ccguagccgccgccgccguc

SEQ ID NO: 17764 - RNA, 20 nt, Artificial Sequence
  targeting sequence with CTCN PAM
cucuccucgcucuuuccucc

SEQ ID NO: 17765 - RNA, 20 nt, Artificial Sequence
  targeting sequence with CTCN PAM
ccucgcucuuuccucccacu

SEQ ID NO: 17766 - RNA, 20 nt, Artificial Sequence
  targeting sequence with CTCN PAM
ucgcucuuuccucccacuug

SEQ ID NO: 17767 - RNA, 20 nt, Artificial Sequence
  targeting sequence with CTCN PAM
cucuuuccucccacuuggcc

SEQ ID NO: 17768 - RNA, 20 nt, Artificial Sequence
  targeting sequence with CTCN PAM
uuccucccacuuggccgcuu

SEQ ID NO: 17769 - RNA, 20 nt, Artificial Sequence
  targeting sequence with CTCN PAM
cacuuggccgcuuggccugc

SEQ ID NO: 17770 - RNA, 20 nt, Artificial Sequence
  targeting sequence with CTCN PAM
cucgcgccuguuuucucuuu

SEQ ID NO: 17771 - RNA, 20 nt, Artificial Sequence
  targeting sequence with CTCN PAM
cgccuguuuucucuuuuccg

SEQ ID NO: 17772 - RNA, 20 nt, Artificial Sequence
  targeting sequence with CTCN PAM
uuuccgcccucucccccacc

SEQ ID NO: 17773 - RNA, 20 nt, Artificial Sequence
  targeting sequence with CTCN PAM
cccccaccccgucucucccu

SEQ ID NO: 17774 - RNA, 20 nt, Artificial Sequence
  targeting sequence with CTCN PAM
cccaccccgucucucccucu

SEQ ID NO: 17775 - RNA, 20 nt, Artificial Sequence
  targeting sequence with CTCN PAM
cccucucucugcgucucucg

SEQ ID NO: 17776 - RNA, 20 nt, Artificial Sequence
  targeting sequence with CTCN PAM
cucucucugcgucucucggu

SEQ ID NO: 17777 - RNA, 20 nt, Artificial Sequence
  targeting sequence with CTCN PAM
cucugcgucucucggucucu

SEQ ID NO: 17778 - RNA, 20 nt, Artificial Sequence
  targeting sequence with CTCN PAM
cugcgucucucggucucugc

SEQ ID NO: 17779 - RNA, 20 nt, Artificial Sequence
  targeting sequence with CTCN PAM
gcgucucucggucucugcgu

SEQ ID NO: 17780 - RNA, 20 nt, Artificial Sequence
  targeting sequence with CTCN PAM
cggucucugcgucucuccgu

SEQ ID NO: 17781 - RNA, 20 nt, Artificial Sequence
  targeting sequence with CTCN PAM
gucucugcgucucuccgucu

SEQ ID NO: 17782 - RNA, 20 nt, Artificial Sequence
  targeting sequence with CTCN PAM
gcgucucuccgucucugucc

SEQ ID NO: 17783 - RNA, 20 nt, Artificial Sequence
  targeting sequence with CTCN PAM
ccgucucuguccccacccca

SEQ ID NO: 17784 - RNA, 20 nt, Artificial Sequence
  targeting sequence with CTCN PAM
gucucuguccccaccccaaa

SEQ ID NO: 17785 - RNA, 20 nt, Artificial Sequence
  targeting sequence with CTCN PAM
guccccaccccaaacuccgc

SEQ ID NO: 17786 - RNA, 20 nt, Artificial Sequence
  targeting sequence with CTCN PAM
gcgcguguggcgcuucuccg

SEQ ID NO: 17787 - RNA, 20 nt, Artificial Sequence
  targeting sequence with CTCN PAM
ggguucugccucugcuucuc

SEQ ID NO: 17788 - RNA, 20 nt, Artificial Sequence
  targeting sequence with CTCN PAM
gcuucuccuucucccuccga

SEQ ID NO: 17789 - RNA, 20 nt, Artificial Sequence
  targeting sequence with CTCN PAM
uucucccuccgacuccgcuu

SEQ ID NO: 17790 - RNA, 20 nt, Artificial Sequence
  targeting sequence with CTCN PAM
cuccgacuccgcuucgcucu

SEQ ID NO: 17791 - RNA, 20 nt, Artificial Sequence
  targeting sequence with CTCN PAM
gacuccgcuucgcucuccag

SEQ ID NO: 17792 - RNA, 20 nt, Artificial Sequence
  targeting sequence with CTCN PAM
gcuucgcucuccagucccug

SEQ ID NO: 17793 - RNA, 20 nt, Artificial Sequence
  targeting sequence with CTCN PAM
ccagucccuggcagccccgc

SEQ ID NO: 17794 - RNA, 20 nt, Artificial Sequence
  targeting sequence with CTCN PAM
agucccuggcagccccgccc

SEQ ID NO: 17795 - RNA, 20 nt, Artificial Sequence
  targeting sequence with CTCN PAM
uucucucuccugcuccguuu

SEQ ID NO: 17796 - RNA, 20 nt, Artificial Sequence
  targeting sequence with CTCN PAM
cuccugcuccguuuuuccgu

SEQ ID NO: 17797 - RNA, 20 nt, Artificial Sequence
  targeting sequence with CTCN PAM
ccugcuccguuuuuccgucc

SEQ ID NO: 17798 - RNA, 20 nt, Artificial Sequence
  targeting sequence with CTCN PAM
ugcuccguuuuuccgucccu

SEQ ID NO: 17799 - RNA, 20 nt, Artificial Sequence
  targeting sequence with CTCN PAM
guuuuuccgucccugacgcu

SEQ ID NO: 17800 - RNA, 20 nt, Artificial Sequence
  targeting sequence with CTCN PAM
cucccucucuccguggcucc

SEQ ID NO: 17801 - RNA, 20 nt, Artificial Sequence
  targeting sequence with CTCN PAM
cucucuccguggcucccucu

SEQ ID NO: 17802 - RNA, 20 nt, Artificial Sequence
  targeting sequence with CTCN PAM
cuccguggcucccucugccu

SEQ ID NO: 17803 - RNA, 20 nt, Artificial Sequence
  targeting sequence with CTCN PAM
ccguggcucccucugccucc

SEQ ID NO: 17804 - RNA, 20 nt, Artificial Sequence
  targeting sequence with CTCN PAM
guggcucccucugccucccc

SEQ ID NO: 17805 - RNA, 20 nt, Artificial Sequence
  targeting sequence with CTCN PAM
cucugccucccccucggacc

SEQ ID NO: 17806 - RNA, 20 nt, Artificial Sequence
  targeting sequence with CTCN PAM
gccucccccucggacccucc

SEQ ID NO: 17807 - RNA, 20 nt, Artificial Sequence
  targeting sequence with CTCN PAM
cccucggacccuccgucccu

SEQ ID NO: 17808 - RNA, 20 nt, Artificial Sequence
  targeting sequence with CTCN PAM
gacccuccgucccucucucg

SEQ ID NO: 17809 - RNA, 20 nt, Artificial Sequence
  targeting sequence with CTCN PAM
gucccucucucggucccucu

SEQ ID NO: 17810 - RNA, 20 nt, Artificial Sequence
  targeting sequence with CTCN PAM
cucggucccucugagcuccc

SEQ ID NO: 17811 - RNA, 20 nt, Artificial Sequence
  targeting sequence with CTCN PAM
cggucccucugagcuccccu

SEQ ID NO: 17812 - RNA, 20 nt, Artificial Sequence
  targeting sequence with CTCN PAM
gucccucugagcuccccuuu

SEQ ID NO: 17813 - RNA, 20 nt, Artificial Sequence
  targeting sequence with CTCN PAM
gagcuccccuuuccuucucc

SEQ ID NO: 17814 - RNA, 20 nt, Artificial Sequence
  targeting sequence with CTCN PAM
gagggaccgagagagggacg

SEQ ID NO: 17815 - RNA, 20 nt, Artificial Sequence
  targeting sequence with CTCN PAM
ccuuuccuucucccucugcc

SEQ ID NO: 17816 - RNA, 20 nt, Artificial Sequence
  targeting sequence with CTCN PAM
cucugccuucccgaacccug

SEQ ID NO: 17817 - RNA, 20 nt, Artificial Sequence
  targeting sequence with CTCN PAM
gccuucccgaacccuguguc

SEQ ID NO: 17818 - RNA, 20 nt, Artificial Sequence
  targeting sequence with CTCN PAM
ccuccacacucagccucccu

SEQ ID NO: 17819 - RNA, 20 nt, Artificial Sequence
  targeting sequence with CTCN PAM
acacucagccucccuccacc

SEQ ID NO: 17820 - RNA, 20 nt, Artificial Sequence
  targeting sequence with CTCN PAM
gccucccuccaccaccuuuc

SEQ ID NO: 17821 - RNA, 20 nt, Artificial Sequence
  targeting sequence with CTCN PAM
cuccaccaccuuucucaggc

SEQ ID NO: 17822 - RNA, 20 nt, Artificial Sequence
  targeting sequence with CTCN PAM
accaccuuucucaggcacug

SEQ ID NO: 17823 - RNA, 20 nt, Artificial Sequence
  targeting sequence with CTCN PAM
ggcacuguccaggccuucgc

SEQ ID NO: 17824 - RNA, 20 nt, Artificial Sequence
  targeting sequence with CTCN PAM
cccggugccggccagucggg

SEQ ID NO: 17825 - RNA, 20 nt, Artificial Sequence
  targeting sequence with CTCN PAM
ggcccugccacuuguaaauc

SEQ ID NO: 17826 - RNA, 20 nt, Artificial Sequence
  targeting sequence with CTCN PAM
gggucagauauauaaaugag

SEQ ID NO: 17827 - RNA, 20 nt, Artificial Sequence
  targeting sequence with CTCN PAM
uuuauauaucugacccugag

SEQ ID NO: 17828 - RNA, 20 nt, Artificial Sequence
  targeting sequence with CTCN PAM
auguuuuccucauuuauaua

SEQ ID NO: 17829 - RNA, 20 nt, Artificial Sequence
  targeting sequence with CTCN PAM
ccauguuuuccucauuuaua

SEQ ID NO: 17830 - RNA, 20 nt, Artificial Sequence
  targeting sequence with CTCN PAM
cuccauguuuuccucauuua

SEQ ID NO: 17831 - RNA, 20 nt, Artificial Sequence
  targeting sequence with CTCN PAM
ggcuaucgguugugggccac

SEQ ID NO: 17832 - RNA, 20 nt, Artificial Sequence
  targeting sequence with CTCN PAM
aggaccaaggccuugcucug

SEQ ID NO: 17833 - RNA, 20 nt, Artificial Sequence
  targeting sequence with CTCN PAM
uguggagacccagccgcacc

SEQ ID NO: 17834 - RNA, 20 nt, Artificial Sequence
  targeting sequence with CTCN PAM
acaggaggcaacugugggcu

SEQ ID NO: 17835 - RNA, 20 nt, Artificial Sequence
  targeting sequence with CTCN PAM
caggcuuaguggaagauuag

SEQ ID NO: 17836 - RNA, 20 nt, Artificial Sequence
  targeting sequence with CTCN PAM
aaagcagcguuaggggcagg

SEQ ID NO: 17837 - RNA, 20 nt, Artificial Sequence
  targeting sequence with CTCN PAM
cagggcugugaccuuggaac

SEQ ID NO: 17838 - RNA, 20 nt, Artificial Sequence
  targeting sequence with CTCN PAM
cacagggcuagcccgugcca

SEQ ID NO: 17839 - RNA, 20 nt, Artificial Sequence
  targeting sequence with CTCN PAM
cuuuuuccucacagauuccc

SEQ ID NO: 17840 - RNA, 20 nt, Artificial Sequence
  targeting sequence with CTCN PAM
uuuuccucacagauuccccc

SEQ ID NO: 17841 - RNA, 20 nt, Artificial Sequence
  targeting sequence with CTCN PAM
cagauucccccgaggcgagc

SEQ ID NO: 17842 - RNA, 20 nt, Artificial Sequence
  targeting sequence with CTCN PAM
ggggaaucugugaggaaaaa

SEQ ID NO: 17843 - RNA, 20 nt, Artificial Sequence
  targeting sequence with CTCN PAM
ccucgggggaaucugugagg

SEQ ID NO: 17844 - RNA, 20 nt, Artificial Sequence
  targeting sequence with CTCN PAM
gccuugguuuccauaucugg

SEQ ID NO: 17845 - RNA, 20 nt, Artificial Sequence
  targeting sequence with CTCN PAM
ugaggagcagagcuacagug

SEQ ID NO: 17846 - RNA, 20 nt, Artificial Sequence
  targeting sequence with CTCN PAM
ugagcugugcaucuugggcc

SEQ ID NO: 17847 - RNA, 20 nt, Artificial Sequence
  targeting sequence with CTCN PAM
ucaugagcugugcaucuugg

SEQ ID NO: 17848 - RNA, 20 nt, Artificial Sequence
  targeting sequence with CTCN PAM
gcuccucaugagcugugcau

SEQ ID NO: 17849 - RNA, 20 nt, Artificial Sequence
  targeting sequence with CTCN PAM
gaccucucagaacggggccu

SEQ ID NO: 17850 - RNA, 20 nt, Artificial Sequence
  targeting sequence with CTCN PAM
cagaacggggccucccauca

SEQ ID NO: 17851 - RNA, 20 nt, Artificial Sequence
  targeting sequence with CTCN PAM
gaacggggccucccaucaga

SEQ ID NO: 17852 - RNA, 20 nt, Artificial Sequence
  targeting sequence with CTCN PAM
caucagacccccagcuucca

SEQ ID NO: 17853 - RNA, 20 nt, Artificial Sequence
  targeting sequence with CTCN PAM
cucugagaguagcgggaccu

SEQ ID NO: 17854 - RNA, 20 nt, Artificial Sequence
  targeting sequence with CTCN PAM
gagaguagcgggaccucauu

SEQ ID NO: 17855 - RNA, 20 nt, Artificial Sequence
  targeting sequence with CTCN PAM
gagugaggcccaccgggcac

SEQ ID NO: 17856 - RNA, 20 nt, Artificial Sequence
  targeting sequence with CTCN PAM
cagagugaggcccaccgggc

SEQ ID NO: 17857 - RNA, 20 nt, Artificial Sequence
  targeting sequence with CTCN PAM
uuuuccucuuucccacccaa

SEQ ID NO: 17858 - RNA, 20 nt, Artificial Sequence
  targeting sequence with CTCN PAM
uucccacccaaccaggaagg

SEQ ID NO: 17859 - RNA, 20 nt, Artificial Sequence
  targeting sequence with CTCN PAM
acacccucgccuuccugcca

SEQ ID NO: 17860 - RNA, 20 nt, Artificial Sequence
  targeting sequence with CTCN PAM
ccuuccugccauccugcccg

SEQ ID NO: 17861 - RNA, 20 nt, Artificial Sequence
  targeting sequence with CTCN PAM
gcccuggucuggccacugcu

SEQ ID NO: 17862 - RNA, 20 nt, Artificial Sequence
  targeting sequence with CTCN PAM
cggccaucaaagcaguggcc

SEQ ID NO: 17863 - RNA, 20 nt, Artificial Sequence
  targeting sequence with CTCN PAM
acacucccggccaucaaagc

SEQ ID NO: 17864 - RNA, 20 nt, Artificial Sequence
  targeting sequence with CTCN PAM
aauuuccugcagcucaacac

SEQ ID NO: 17865 - RNA, 20 nt, Artificial Sequence
  targeting sequence with CTCN PAM
caggcccauccacccaccaa

SEQ ID NO: 17866 - RNA, 20 nt, Artificial Sequence
  targeting sequence with CTCN PAM
ugguggguggaugggccugg

SEQ ID NO: 17867 - RNA, 20 nt, Artificial Sequence
  targeting sequence with CTCN PAM
ggggacugcccgugggacug

SEQ ID NO: 17868 - RNA, 20 nt, Artificial Sequence
  targeting sequence with CTCN PAM
cuggauggagaaggcgcaca

SEQ ID NO: 17869 - RNA, 20 nt, Artificial Sequence
  targeting sequence with CTCN PAM
ggauggagaaggcgcacauc

SEQ ID NO: 17870 - RNA, 20 nt, Artificial Sequence
  targeting sequence with CTCN PAM
auccagagaggaagacaggg

SEQ ID NO: 17871 - RNA, 20 nt, Artificial Sequence
  targeting sequence with CTCN PAM
gcaguuggcccccacgggug

SEQ ID NO: 17872 - RNA, 20 nt, Artificial Sequence
  targeting sequence with CTCN PAM
augccccuccuccucacuca

SEQ ID NO: 17873 - RNA, 20 nt, Artificial Sequence
  targeting sequence with CTCN PAM
uccucacucacauccucagu

SEQ ID NO: 17874 - RNA, 20 nt, Artificial Sequence
  targeting sequence with CTCN PAM
ucacucacauccucagugcc

SEQ ID NO: 17875 - RNA, 20 nt, Artificial Sequence
  targeting sequence with CTCN PAM
cucacauccucagugccccc

SEQ ID NO: 17876 - RNA, 20 nt, Artificial Sequence
  targeting sequence with CTCN PAM
cauccucagugcccccaccc

SEQ ID NO: 17877 - RNA, 20 nt, Artificial Sequence
  targeting sequence with CTCN PAM
gugcccccaccccaguccau

SEQ ID NO: 17878 - RNA, 20 nt, Artificial Sequence
  targeting sequence with CTCN PAM
cugucuuaucucucucucuc

SEQ ID NO: 17879 - RNA, 20 nt, Artificial Sequence
  targeting sequence with CTCN PAM
gucuuaucucucucucuccu

SEQ ID NO: 17880 - RNA, 20 nt, Artificial Sequence
  targeting sequence with CTCN PAM
cucucuccugcccccaccca

SEQ ID NO: 17881 - RNA, 20 nt, Artificial Sequence
  targeting sequence with CTCN PAM
cucuccugcccccacccauc

SEQ ID NO: 17882 - RNA, 20 nt, Artificial Sequence
  targeting sequence with CTCN PAM
cuccugcccccacccaucuc

SEQ ID NO: 17883 - RNA, 20 nt, Artificial Sequence
  targeting sequence with CTCN PAM
ccugcccccacccaucucug

SEQ ID NO: 17884 - RNA, 20 nt, Artificial Sequence
  targeting sequence with CTCN PAM
ugcccccacccaucucuguu

SEQ ID NO: 17885 - RNA, 20 nt, Artificial Sequence
  targeting sequence with CTCN PAM
guuccuaucugucuugcucc

SEQ ID NO: 17886 - RNA, 20 nt, Artificial Sequence
  targeting sequence with CTCN PAM
ucccguucacucucuuuguc

SEQ ID NO: 17887 - RNA, 20 nt, Artificial Sequence
  targeting sequence with CTCN PAM
cguucacucucuuugucucu

SEQ ID NO: 17888 - RNA, 20 nt, Artificial Sequence
  targeting sequence with CTCN PAM
cuuugucucuccuucucuca

SEQ ID NO: 17889 - RNA, 20 nt, Artificial Sequence
  targeting sequence with CTCN PAM
uugucucuccuucucucagu

SEQ ID NO: 17890 - RNA, 20 nt, Artificial Sequence
  targeting sequence with CTCN PAM
ccuucucucagugucuugcc

SEQ ID NO: 17891 - RNA, 20 nt, Artificial Sequence
  targeting sequence with CTCN PAM
uucucucagugucuugcccc

SEQ ID NO: 17892 - RNA, 20 nt, Artificial Sequence
  targeting sequence with CTCN PAM
cagugucuugcccccuuccc

SEQ ID NO: 17893 - RNA, 20 nt, Artificial Sequence
  targeting sequence with CTCN PAM
gugucuugcccccuucccuu

SEQ ID NO: 17894 - RNA, 20 nt, Artificial Sequence
  targeting sequence with CTCN PAM
ucaucugucucucugugucu

SEQ ID NO: 17895 - RNA, 20 nt, Artificial Sequence
  targeting sequence with CTCN PAM
cugugucucuaucucugucu

SEQ ID NO: 17896 - RNA, 20 nt, Artificial Sequence
  targeting sequence with CTCN PAM
gugucucuaucucugucucu

SEQ ID NO: 17897 - RNA, 20 nt, Artificial Sequence
  targeting sequence with CTCN PAM
aucucugucucucucucugu

SEQ ID NO: 17898 - RNA, 20 nt, Artificial Sequence
  targeting sequence with CTCN PAM
gucucucucucugucucccu

SEQ ID NO: 17899 - RNA, 20 nt, Artificial Sequence
  targeting sequence with CTCN PAM
cucucugucucccucccuau

SEQ ID NO: 17900 - RNA, 20 nt, Artificial Sequence
  targeting sequence with CTCN PAM
cucugucucccucccuaucc

SEQ ID NO: 17901 - RNA, 20 nt, Artificial Sequence
  targeting sequence with CTCN PAM
cugucucccucccuaucccu

SEQ ID NO: 17902 - RNA, 20 nt, Artificial Sequence
  targeting sequence with CTCN PAM
gucucccucccuaucccuca

SEQ ID NO: 17903 - RNA, 20 nt, Artificial Sequence
  targeting sequence with CTCN PAM
cucccuaucccucaccccca

SEQ ID NO: 17904 - RNA, 20 nt, Artificial Sequence
  targeting sequence with CTCN PAM
cuaucccucacccccacucc

SEQ ID NO: 17905 - RNA, 20 nt, Artificial Sequence
  targeting sequence with CTCN PAM
cccccacucccucuccagcc

SEQ ID NO: 17906 - RNA, 20 nt, Artificial Sequence
  targeting sequence with CTCN PAM
cucuccagccccuccucucu

SEQ ID NO: 17907 - RNA, 20 nt, Artificial Sequence
  targeting sequence with CTCN PAM
ccagccccuccucucuuccu

SEQ ID NO: 17908 - RNA, 20 nt, Artificial Sequence
  targeting sequence with CTCN PAM
agccccuccucucuuccuuc

SEQ ID NO: 17909 - RNA, 20 nt, Artificial Sequence
  targeting sequence with CTCN PAM
ucucuuccuuccugucuccc

SEQ ID NO: 17910 - RNA, 20 nt, Artificial Sequence
  targeting sequence with CTCN PAM
cuuccuuccugucucccgcu

SEQ ID NO: 17911 - RNA, 20 nt, Artificial Sequence
  targeting sequence with CTCN PAM
uccuuccugucucccgcuca

SEQ ID NO: 17912 - RNA, 20 nt, Artificial Sequence
  targeting sequence with CTCN PAM
cgcucaucugguucaucuug

SEQ ID NO: 17913 - RNA, 20 nt, Artificial Sequence
  targeting sequence with CTCN PAM
ucugguucaucuugcugcau

SEQ ID NO: 17914 - RNA, 20 nt, Artificial Sequence
  targeting sequence with CTCN PAM
ccccacugagccgugaggau

SEQ ID NO: 17915 - RNA, 20 nt, Artificial Sequence
  targeting sequence with CTCN PAM
guggggggagcugcaggaug

SEQ ID NO: 17916 - RNA, 20 nt, Artificial Sequence
  targeting sequence with CTCN PAM
cggcucaguggggggagcug

SEQ ID NO: 17917 - RNA, 20 nt, Artificial Sequence
  targeting sequence with CTCN PAM
guguugucuuagaccagccu

SEQ ID NO: 17918 - RNA, 20 nt, Artificial Sequence
  targeting sequence with CTCN PAM
cugccaagcugagcaguggg

SEQ ID NO: 17919 - RNA, 20 nt, Artificial Sequence
  targeting sequence with CTCN PAM
gcuuggcagggagcuugugu

SEQ ID NO: 17920 - RNA, 20 nt, Artificial Sequence
  targeting sequence with CTCN PAM
uaaaccccacugcucagcuu

SEQ ID NO: 17921 - RNA, 20 nt, Artificial Sequence
  targeting sequence with CTCN PAM
cuaggugaaggguauucggg

SEQ ID NO: 17922 - RNA, 20 nt, Artificial Sequence
  targeting sequence with CTCN PAM
aggugaaggguauucggguc

SEQ ID NO: 17923 - RNA, 20 nt, Artificial Sequence
  targeting sequence with CTCN PAM
gacccgaauacccuucaccu

SEQ ID NO: 17924 - RNA, 20 nt, Artificial Sequence
  targeting sequence with CTCN PAM
caucaacuggaggugagaag

SEQ ID NO: 17925 - RNA, 20 nt, Artificial Sequence
  targeting sequence with CTCN PAM
aguugaugugaggauacuca

SEQ ID NO: 17926 - RNA, 20 nt, Artificial Sequence
  targeting sequence with CTCN PAM
ccuccaguugaugugaggau

SEQ ID NO: 17927 - RNA, 20 nt, Artificial Sequence
  targeting sequence with CTCN PAM
cccucucugagccucaguuu

SEQ ID NO: 17928 - RNA, 20 nt, Artificial Sequence
  targeting sequence with CTCN PAM
cugagccucaguuuccucaa

SEQ ID NO: 17929 - RNA, 20 nt, Artificial Sequence
  targeting sequence with CTCN PAM
gagccucaguuuccucaacu

SEQ ID NO: 17930 - RNA, 20 nt, Artificial Sequence
  targeting sequence with CTCN PAM
gagagggugagugccuugca

SEQ ID NO: 17931 - RNA, 20 nt, Artificial Sequence
  targeting sequence with CTCN PAM
guuuccucaacuguaaaaug

SEQ ID NO: 17932 - RNA, 20 nt, Artificial Sequence
  targeting sequence with CTCN PAM
acuguaaaaugaggacaauc

SEQ ID NO: 17933 - RNA, 20 nt, Artificial Sequence
  targeting sequence with CTCN PAM
uuuuacaguugaggaaacug

SEQ ID NO: 17934 - RNA, 20 nt, Artificial Sequence
  targeting sequence with CTCN PAM
caggggcagguguucugcua

SEQ ID NO: 17935 - RNA, 20 nt, Artificial Sequence
  targeting sequence with CTCN PAM
cacccucccaggggcaggug

SEQ ID NO: 17936 - RNA, 20 nt, Artificial Sequence
  targeting sequence with CTCN PAM
aucucacacccucccagggg

SEQ ID NO: 17937 - RNA, 20 nt, Artificial Sequence
  targeting sequence with CTCN PAM
uagcaaacaccaguuucucc

SEQ ID NO: 17938 - RNA, 20 nt, Artificial Sequence
  targeting sequence with CTCN PAM
ccgccuuguggcagugaacc

SEQ ID NO: 17939 - RNA, 20 nt, Artificial Sequence
  targeting sequence with CTCN PAM
aacaugggcuucagggguca

SEQ ID NO: 17940 - RNA, 20 nt, Artificial Sequence
  targeting sequence with CTCN PAM
uggcucuaacaugggcuuca

SEQ ID NO: 17941 - RNA, 20 nt, Artificial Sequence
  targeting sequence with CTCN PAM
accuccuguccugagcccca

SEQ ID NO: 17942 - RNA, 20 nt, Artificial Sequence
  targeting sequence with CTCN PAM
uguccugagccccaaugugg

SEQ ID NO: 17943 - RNA, 20 nt, Artificial Sequence
  targeting sequence with CTCN PAM
ggacaggagguggagcccug

SEQ ID NO: 17944 - RNA, 20 nt, Artificial Sequence
  targeting sequence with CTCN PAM
gcuagccacauuggggcuca

SEQ ID NO: 17945 - RNA, 20 nt, Artificial Sequence
  targeting sequence with CTCN PAM
ccgucugguggcucugcuag

SEQ ID NO: 17946 - RNA, 20 nt, Artificial Sequence
  targeting sequence with CTCN PAM
caccgucugguggcucugcu

SEQ ID NO: 17947 - RNA, 20 nt, Artificial Sequence
  targeting sequence with CTCN PAM
guuuccccaucugugaaaug

SEQ ID NO: 17948 - RNA, 20 nt, Artificial Sequence
  targeting sequence with CTCN PAM
acaucuuaugauuucucccu

SEQ ID NO: 17949 - RNA, 20 nt, Artificial Sequence
  targeting sequence with CTCN PAM
cuucuacccauuagcuggga

SEQ ID NO: 17950 - RNA, 20 nt, Artificial Sequence
  targeting sequence with CTCN PAM
cagcuaauggguagaaggga

SEQ ID NO: 17951 - RNA, 20 nt, Artificial Sequence
  targeting sequence with CTCN PAM
ugguggcagccccuauaccc

SEQ ID NO: 17952 - RNA, 20 nt, Artificial Sequence
  targeting sequence with CTCN PAM
gcccagccagggguauaggg

SEQ ID NO: 17953 - RNA, 20 nt, Artificial Sequence
  targeting sequence with CTCN PAM
ucugcccagccagggguaua

SEQ ID NO: 17954 - RNA, 20 nt, Artificial Sequence
  targeting sequence with CTCN PAM
uugcaucuuaguaaggccag

SEQ ID NO: 17955 - RNA, 20 nt, Artificial Sequence
  targeting sequence with CTCN PAM
ggaagaacaccucauugcau

SEQ ID NO: 17956 - RNA, 20 nt, Artificial Sequence
  targeting sequence with CTCN PAM
aaaauucccucuggaagaac

SEQ ID NO: 17957 - RNA, 20 nt, Artificial Sequence
  targeting sequence with CTCN PAM
ccuugguucccuccaaaauu

SEQ ID NO: 17958 - RNA, 20 nt, Artificial Sequence
  targeting sequence with CTCN PAM
ggaguggggauuagguggga

SEQ ID NO: 17959 - RNA, 20 nt, Artificial Sequence
  targeting sequence with CTCN PAM
ugaguaccuuucaucucccc

SEQ ID NO: 17960 - RNA, 20 nt, Artificial Sequence
  targeting sequence with CTCN PAM
aaccaagaccuuuuccuuga

SEQ ID NO: 17961 - RNA, 20 nt, Artificial Sequence
  targeting sequence with CTCN PAM
uuuuaauagagagaaggucu

SEQ ID NO: 17962 - RNA, 20 nt, Artificial Sequence
  targeting sequence with CTCN PAM
auuaaaaagagacagugaca

SEQ ID NO: 17963 - RNA, 20 nt, Artificial Sequence
  targeting sequence with CTCN PAM
cuauuaaaaagagacaguga

SEQ ID NO: 17964 - RNA, 20 nt, Artificial Sequence
  targeting sequence with CTCN PAM
aacucagggcuguugacauc

SEQ ID NO: 17965 - RNA, 20 nt, Artificial Sequence
  targeting sequence with CTCN PAM
gggcuguugacaucagcgug

SEQ ID NO: 17966 - RNA, 20 nt, Artificial Sequence
  targeting sequence with CTCN PAM
cuuuuaaaggacuucaauca

SEQ ID NO: 17967 - RNA, 20 nt, Artificial Sequence
  targeting sequence with CTCN PAM
ucuucaaaggcacugcugga

SEQ ID NO: 17968 - RNA, 20 nt, Artificial Sequence
  targeting sequence with CTCN PAM
gccaccagguccucgucuuc

SEQ ID NO: 17969 - RNA, 20 nt, Artificial Sequence
  targeting sequence with CTCN PAM
gagaaggcgggccugggccu

SEQ ID NO: 17970 - RNA, 20 nt, Artificial Sequence
  targeting sequence with CTCN PAM
gagccagcauagccguugac

SEQ ID NO: 17971 - RNA, 20 nt, Artificial Sequence
  targeting sequence with CTCN PAM
ccucugacugcccagggcag

SEQ ID NO: 17972 - RNA, 20 nt, Artificial Sequence
  targeting sequence with CTCN PAM
gacugcccagggcagagcug

SEQ ID NO: 17973 - RNA, 20 nt, Artificial Sequence
  targeting sequence with CTCN PAM
gcccugggcagucagaggug

SEQ ID NO: 17974 - RNA, 20 nt, Artificial Sequence
  targeting sequence with CTCN PAM
cagcucugcccugggcaguc

SEQ ID NO: 17975 - RNA, 20 nt, Artificial Sequence
  targeting sequence with CTCN PAM
ucacagcucugcccugggca

SEQ ID NO: 17976 - RNA, 20 nt, Artificial Sequence
  targeting sequence with CTCN PAM
gucuccucacagcucugccc

SEQ ID NO: 17977 - RNA, 20 nt, Artificial Sequence
  targeting sequence with CTCN PAM
cagcgcaacccuggccccac

SEQ ID NO: 17978 - RNA, 20 nt, Artificial Sequence
  targeting sequence with CTCN PAM
ucccagcgcaacccuggccc

SEQ ID NO: 17979 - RNA, 20 nt, Artificial Sequence
  targeting sequence with CTCN PAM
ugcccucccgucccuugggc

SEQ ID NO: 17980 - RNA, 20 nt, Artificial Sequence
  targeting sequence with CTCN PAM
cgucccuugggccuggccuc

SEQ ID NO: 17981 - RNA, 20 nt, Artificial Sequence
  targeting sequence with CTCN PAM
gagaacguuuccuugcagga

SEQ ID NO: 17982 - RNA, 20 nt, Artificial Sequence
  targeting sequence with CTCN PAM
gaggccaggcccaagggacg

SEQ ID NO: 17983 - RNA, 20 nt, Artificial Sequence
  targeting sequence with CTCN PAM
aaagcauuaaccuugcaggg

SEQ ID NO: 17984 - RNA, 20 nt, Artificial Sequence
  targeting sequence with CTCN PAM
gccacaggaaggugcuggaa

SEQ ID NO: 17985 - RNA, 20 nt, Artificial Sequence
  targeting sequence with CTCN PAM
uguuuccagcaccuuccugu

SEQ ID NO: 17986 - RNA, 20 nt, Artificial Sequence
  targeting sequence with CTCN PAM
cggcaccaccuaggcccaug

SEQ ID NO: 17987 - RNA, 20 nt, Artificial Sequence
  targeting sequence with CTCN PAM
ggggcuggacccgucucauu

SEQ ID NO: 17988 - RNA, 20 nt, Artificial Sequence
  targeting sequence with CTCN PAM
uuuccccgugggagcaaccc

SEQ ID NO: 17989 - RNA, 20 nt, Artificial Sequence
  targeting sequence with CTCN PAM
cacggggaaaugagacgggu

SEQ ID NO: 17990 - RNA, 20 nt, Artificial Sequence
  targeting sequence with CTCN PAM
uaggugggaacugaacaaug

SEQ ID NO: 17991 - RNA, 20 nt, Artificial Sequence
  targeting sequence with CTCN PAM
cucauaggugggaacugaac

SEQ ID NO: 17992 - RNA, 20 nt, Artificial Sequence
  targeting sequence with CTCN PAM
gaaugaugguuuccagcuuc

SEQ ID NO: 17993 - RNA, 20 nt, Artificial Sequence
  targeting sequence with CTCN PAM
uccuuuuuuauggcugcaua

SEQ ID NO: 17994 - RNA, 20 nt, Artificial Sequence
  targeting sequence with CTCN PAM
ccuccugagcacagacacuu

SEQ ID NO: 17995 - RNA, 20 nt, Artificial Sequence
  targeting sequence with CTCN PAM
uccugagcacagacacuuaa

SEQ ID NO: 17996 - RNA, 20 nt, Artificial Sequence
  targeting sequence with CTCN PAM
ugagcacagacacuuaaggc

SEQ ID NO: 17997 - RNA, 20 nt, Artificial Sequence
  targeting sequence with CTCN PAM
ggaggagaggggaaggaaug

SEQ ID NO: 17998 - RNA, 20 nt, Artificial Sequence
  targeting sequence with CTCN PAM
gagaggccuagaggcccacc

SEQ ID NO: 17999 - RNA, 20 nt, Artificial Sequence
  targeting sequence with CTCN PAM
gagccuuaagugucugugcu

SEQ ID NO: 18000 - RNA, 20 nt, Artificial Sequence
  targeting sequence with CTCN PAM
cugagccuuaagugucugug

SEQ ID NO: 18001 - RNA, 20 nt, Artificial Sequence
  targeting sequence with CTCN PAM
aggccucucugagccuuaag

SEQ ID NO: 18002 - RNA, 20 nt, Artificial Sequence
  targeting sequence with CTCN PAM
ggugggccucuaggccucuc

SEQ ID NO: 18003 - RNA, 20 nt, Artificial Sequence
  targeting sequence with CTCN PAM
cuuugccaccuguuugcugu

SEQ ID NO: 18004 - RNA, 20 nt, Artificial Sequence
  targeting sequence with CTCN PAM
caucucuguguccccguggg

SEQ ID NO: 18005 - RNA, 20 nt, Artificial Sequence
  targeting sequence with CTCN PAM
ucucuguguccccguggggc

SEQ ID NO: 18006 - RNA, 20 nt, Artificial Sequence
  targeting sequence with CTCN PAM
guguccccguggggcuggag

SEQ ID NO: 18007 - RNA, 20 nt, Artificial Sequence
  targeting sequence with CTCN PAM
agccccacggggacacagag

SEQ ID NO: 18008 - RNA, 20 nt, Artificial Sequence
  targeting sequence with CTCN PAM
uuccugcaugugaacgacgc

SEQ ID NO: 18009 - RNA, 20 nt, Artificial Sequence
  targeting sequence with CTCN PAM
cccgacucugggcagguccu

SEQ ID NO: 18010 - RNA, 20 nt, Artificial Sequence
  targeting sequence with CTCN PAM
cgacucugggcagguccuug

SEQ ID NO: 18011 - RNA, 20 nt, Artificial Sequence
  targeting sequence with CTCN PAM
gggcagguccuugcccucug

SEQ ID NO: 18012 - RNA, 20 nt, Artificial Sequence
  targeting sequence with CTCN PAM
gugcucaggggacucauggg

SEQ ID NO: 18013 - RNA, 20 nt, Artificial Sequence
  targeting sequence with CTCN PAM
ggggacucaugggccggggu

SEQ ID NO: 18014 - RNA, 20 nt, Artificial Sequence
  targeting sequence with CTCN PAM
ugggccgggguggggacccg

SEQ ID NO: 18015 - RNA, 20 nt, Artificial Sequence
  targeting sequence with CTCN PAM
ggguccccaccccggcccau

SEQ ID NO: 18016 - RNA, 20 nt, Artificial Sequence
  targeting sequence with CTCN PAM
cugggggcgccuggccugcc

SEQ ID NO: 18017 - RNA, 20 nt, Artificial Sequence
  targeting sequence with CTCN PAM
gcaggccaggcgcccccagu

SEQ ID NO: 18018 - RNA, 20 nt, Artificial Sequence
  targeting sequence with CTCN PAM
gugaguuggauaaugggcgg

SEQ ID NO: 18019 - RNA, 20 nt, Artificial Sequence
  targeting sequence with CTCN PAM
cagagcacaaaggggccaug

SEQ ID NO: 18020 - RNA, 20 nt, Artificial Sequence
  targeting sequence with CTCN PAM
gacguccagucaugggucug

SEQ ID NO: 18021 - RNA, 20 nt, Artificial Sequence
  targeting sequence with CTCN PAM
acacugaggccucuguccag

SEQ ID NO: 18022 - RNA, 20 nt, Artificial Sequence
  targeting sequence with CTCN PAM
guguggagcugcccgggucc

SEQ ID NO: 18023 - RNA, 20 nt, Artificial Sequence
  targeting sequence with CTCN PAM
guccagcagaagccucagag

SEQ ID NO: 18024 - RNA, 20 nt, Artificial Sequence
  targeting sequence with CTCN PAM
gaggggcagggccgccgcgg

SEQ ID NO: 18025 - RNA, 20 nt, Artificial Sequence
  targeting sequence with CTCN PAM
gaggcuucugcuggacagag

SEQ ID NO: 18026 - RNA, 20 nt, Artificial Sequence
  targeting sequence with CTCN PAM
aggcgacaaccgccugagug

SEQ ID NO: 18027 - RNA, 20 nt, Artificial Sequence
  targeting sequence with CTCN PAM
auuuaugcaccuaucaaaug

SEQ ID NO: 18028 - RNA, 20 nt, Artificial Sequence
  targeting sequence with CTCN PAM
ggagaugaggcccugguccu

SEQ ID NO: 18029 - RNA, 20 nt, Artificial Sequence
  targeting sequence with CTCN PAM
ugagccucaauuuaugcacc

SEQ ID NO: 18030 - RNA, 20 nt, Artificial Sequence
  targeting sequence with CTCN PAM
ucuccugagccucaauuuau

SEQ ID NO: 18031 - RNA, 20 nt, Artificial Sequence
  targeting sequence with CTCN PAM
guuucccuaccuguaaauag

SEQ ID NO: 18032 - RNA, 20 nt, Artificial Sequence
  targeting sequence with CTCN PAM
ugccucaguuucccuaccug

SEQ ID NO: 18033 - RNA, 20 nt, Artificial Sequence
  targeting sequence with CTCN PAM
ccuccugccucaguuucccu

SEQ ID NO: 18034 - RNA, 20 nt, Artificial Sequence
  targeting sequence with CTCN PAM
ggcaagucaccucaccuccu

SEQ ID NO: 18035 - RNA, 20 nt, Artificial Sequence
  targeting sequence with CTCN PAM
gcucugcaaccucugccucc

SEQ ID NO: 18036 - RNA, 20 nt, Artificial Sequence
  targeting sequence with CTCN PAM
gcaaccucugccuccugggu

SEQ ID NO: 18037 - RNA, 20 nt, Artificial Sequence
  targeting sequence with CTCN PAM
gccuccugggugcaagcgau

SEQ ID NO: 18038 - RNA, 20 nt, Artificial Sequence
  targeting sequence with CTCN PAM
ugggugcaagcgauucuccu

SEQ ID NO: 18039 - RNA, 20 nt, Artificial Sequence
  targeting sequence with CTCN PAM
ugccucagccucccgaguag

SEQ ID NO: 18040 - RNA, 20 nt, Artificial Sequence
  targeting sequence with CTCN PAM
gccucccgaguagcugggau

SEQ ID NO: 18041 - RNA, 20 nt, Artificial Sequence
  targeting sequence with CTCN PAM
cgaguagcugggauuacagg

SEQ ID NO: 18042 - RNA, 20 nt, Artificial Sequence
  targeting sequence with CTCN PAM
ggaggcugaggcaggagaau

SEQ ID NO: 18043 - RNA, 20 nt, Artificial Sequence
  targeting sequence with CTCN PAM
caccuguaaucccagcacuu

SEQ ID NO: 18044 - RNA, 20 nt, Artificial Sequence
  targeting sequence with CTCN PAM
ggccgggugcgguggcucac

SEQ ID NO: 18045 - RNA, 20 nt, Artificial Sequence
  targeting sequence with CTCN PAM
aguucauuaagaacaggacu

SEQ ID NO: 18046 - RNA, 20 nt, Artificial Sequence
  targeting sequence with CTCN PAM
auggccccaggccccagugc

SEQ ID NO: 18047 - RNA, 20 nt, Artificial Sequence
  targeting sequence with CTCN PAM
agacccaacccaauuucacc

SEQ ID NO: 18048 - RNA, 20 nt, Artificial Sequence
  targeting sequence with CTCN PAM
ggaaagucuuuccuagugaa

SEQ ID NO: 18049 - RNA, 20 nt, Artificial Sequence
  targeting sequence with CTCN PAM
uaggccucccucaagaccua

SEQ ID NO: 18050 - RNA, 20 nt, Artificial Sequence
  targeting sequence with CTCN PAM
cucaagaccuagucuaaaga

SEQ ID NO: 18051 - RNA, 20 nt, Artificial Sequence
  targeting sequence with CTCN PAM
agaccuagucuaaagaccuu

SEQ ID NO: 18052 - RNA, 20 nt, Artificial Sequence
  targeting sequence with CTCN PAM
gaaggucuuuagacuagguc

SEQ ID NO: 18053 - RNA, 20 nt, Artificial Sequence
  targeting sequence with CTCN PAM
cagccaccaagagagaggca

SEQ ID NO: 18054 - RNA, 20 nt, Artificial Sequence
  targeting sequence with CTCN PAM
ugguggcugggagcugggcc

SEQ ID NO: 18055 - RNA, 20 nt, Artificial Sequence
  targeting sequence with CTCN PAM
cuugguggcugggagcuggg

SEQ ID NO: 18056 - RNA, 20 nt, Artificial Sequence
  targeting sequence with CTCN PAM
cucuugguggcugggagcug

SEQ ID NO: 18057 - RNA, 20 nt, Artificial Sequence
  targeting sequence with CTCN PAM
ggauuucccuggccagaguc

SEQ ID NO: 18058 - RNA, 20 nt, Artificial Sequence
  targeting sequence with CTCN PAM
ggccagggaaauccagagug

SEQ ID NO: 18059 - RNA, 20 nt, Artificial Sequence
  targeting sequence with CTCN PAM
cugcggaggaacuugggacc

SEQ ID NO: 18060 - RNA, 20 nt, Artificial Sequence
  targeting sequence with CTCN PAM
gcggaggaacuugggaccag

SEQ ID NO: 18061 - RNA, 20 nt, Artificial Sequence
  targeting sequence with CTCN PAM
gcagagaggacucuggccag

SEQ ID NO: 18062 - RNA, 20 nt, Artificial Sequence
  targeting sequence with CTCN PAM
cuaaagaacuggucccaagu

SEQ ID NO: 18063 - RNA, 20 nt, Artificial Sequence
  targeting sequence with CTCN PAM
uuacucaagagcagccuuac

SEQ ID NO: 18064 - RNA, 20 nt, Artificial Sequence
  targeting sequence with CTCN PAM
agagcagccuuacgagaacg

SEQ ID NO: 18065 - RNA, 20 nt, Artificial Sequence
  targeting sequence with CTCN PAM
ugaguaaggagggaugaugu

SEQ ID NO: 18066 - RNA, 20 nt, Artificial Sequence
  targeting sequence with CTCN PAM
uaaggcugcucuugaguaag

SEQ ID NO: 18067 - RNA, 20 nt, Artificial Sequence
  targeting sequence with CTCN PAM
ggaugagccacccucuuucc

SEQ ID NO: 18068 - RNA, 20 nt, Artificial Sequence
  targeting sequence with CTCN PAM
ucccgagauacccagcuguc

SEQ ID NO: 18069 - RNA, 20 nt, Artificial Sequence
  targeting sequence with CTCN PAM
uuccccuguggcuuccccug

SEQ ID NO: 18070 - RNA, 20 nt, Artificial Sequence
  targeting sequence with CTCN PAM
aagauuuggaucuggcugcu

SEQ ID NO: 18071 - RNA, 20 nt, Artificial Sequence
  targeting sequence with CTCN PAM
ucuuccaggcagccuucuca

SEQ ID NO: 18072 - RNA, 20 nt, Artificial Sequence
  targeting sequence with CTCN PAM
uccaggcagccuucucagcu

SEQ ID NO: 18073 - RNA, 20 nt, Artificial Sequence
  targeting sequence with CTCN PAM
gcucucacaggcuggguuag

SEQ ID NO: 18074 - RNA, 20 nt, Artificial Sequence
  targeting sequence with CTCN PAM
cacaggcuggguuaggcuuc

SEQ ID NO: 18075 - RNA, 20 nt, Artificial Sequence
  targeting sequence with CTCN PAM
caggcuggguuaggcuuccu

SEQ ID NO: 18076 - RNA, 20 nt, Artificial Sequence
  targeting sequence with CTCN PAM
uccucuacccccacaguacc

SEQ ID NO: 18077 - RNA, 20 nt, Artificial Sequence
  targeting sequence with CTCN PAM
aaaaguauguuuccaccuca

SEQ ID NO: 18078 - RNA, 20 nt, Artificial Sequence
  targeting sequence with CTCN PAM
ggaagcauuagcugcauuga

SEQ ID NO: 18079 - RNA, 20 nt, Artificial Sequence
  targeting sequence with CTCN PAM
caguggccucaggaagcauu

SEQ ID NO: 18080 - RNA, 20 nt, Artificial Sequence
  targeting sequence with CTCN PAM
gugagaugggggccgaggag

SEQ ID NO: 18081 - RNA, 20 nt, Artificial Sequence
  targeting sequence with CTCN PAM
cugagggugccugucagggu

SEQ ID NO: 18082 - RNA, 20 nt, Artificial Sequence
  targeting sequence with CTCN PAM
cggguucugccuugggcagc

SEQ ID NO: 18083 - RNA, 20 nt, Artificial Sequence
  targeting sequence with CTCN PAM
caccuguccagagguugcuu

SEQ ID NO: 18084 - RNA, 20 nt, Artificial Sequence
  targeting sequence with CTCN PAM
acccccacccugugcucaca

SEQ ID NO: 18085 - RNA, 20 nt, Artificial Sequence
  targeting sequence with CTCN PAM
ccuggauggugggacaggcc

SEQ ID NO: 18086 - RNA, 20 nt, Artificial Sequence
  targeting sequence with CTCN PAM
cagaaguaggaagugaguca

SEQ ID NO: 18087 - RNA, 20 nt, Artificial Sequence
  targeting sequence with CTCN PAM
cuuccuacuucugggagcug

SEQ ID NO: 18088 - RNA, 20 nt, Artificial Sequence
  targeting sequence with CTCN PAM
cccauagugccggcggccgc

SEQ ID NO: 18089 - RNA, 20 nt, Artificial Sequence
  targeting sequence with CTCN PAM
gccgucucgcccauagugcc

SEQ ID NO: 18090 - RNA, 20 nt, Artificial Sequence
  targeting sequence with CTCN PAM
uuccugccacccuggguggu

SEQ ID NO: 18091 - RNA, 20 nt, Artificial Sequence
  targeting sequence with CTCN PAM
aggccuccuuccugccaccc

SEQ ID NO: 18092 - RNA, 20 nt, Artificial Sequence
  targeting sequence with CTCN PAM
uccucuaggccuccuuccug

SEQ ID NO: 18093 - RNA, 20 nt, Artificial Sequence
  targeting sequence with CTCN PAM
uauccucuuccucuaggccu

SEQ ID NO: 18094 - RNA, 20 nt, Artificial Sequence
  targeting sequence with CTCN PAM
ccccagcaaaacaggcagcc

SEQ ID NO: 18095 - RNA, 20 nt, Artificial Sequence
  targeting sequence with CTCN PAM
ccagcaaaacaggcagcccu

SEQ ID NO: 18096 - RNA, 20 nt, Artificial Sequence
  targeting sequence with CTCN PAM
agcccaaacccuccaaccca

SEQ ID NO: 18097 - RNA, 20 nt, Artificial Sequence
  targeting sequence with CTCN PAM
aacccaguggacacccgucc

SEQ ID NO: 18098 - RNA, 20 nt, Artificial Sequence
  targeting sequence with CTCN PAM
auuuccccauccucacucga

SEQ ID NO: 18099 - RNA, 20 nt, Artificial Sequence
  targeting sequence with CTCN PAM
cucgagaggcuuggcugggc

SEQ ID NO: 18100 - RNA, 20 nt, Artificial Sequence
  targeting sequence with CTCN PAM
agaggcuuggcugggcagac

SEQ ID NO: 18101 - RNA, 20 nt, Artificial Sequence
  targeting sequence with CTCN PAM
agugaggauggggaaauuga

SEQ ID NO: 18102 - RNA, 20 nt, Artificial Sequence
  targeting sequence with CTCN PAM
cgagugaggauggggaaauu

SEQ ID NO: 18103 - RNA, 20 nt, Artificial Sequence
  targeting sequence with CTCN PAM
gucugcccagccaagccucu

SEQ ID NO: 18104 - RNA, 20 nt, Artificial Sequence
  targeting sequence with CTCN PAM
ggcaccaaaagggaagugag

SEQ ID NO: 18105 - RNA, 20 nt, Artificial Sequence
  targeting sequence with CTCN PAM
gccucaaaaggaucugggcu

SEQ ID NO: 18106 - RNA, 20 nt, Artificial Sequence
  targeting sequence with CTCN PAM
aaaggaucugggcuuggaug

SEQ ID NO: 18107 - RNA, 20 nt, Artificial Sequence
  targeting sequence with CTCN PAM
gggugcccaucuaguugcac

SEQ ID NO: 18108 - RNA, 20 nt, Artificial Sequence
  targeting sequence with CTCN PAM
aagaauauguauuauuucug

SEQ ID NO: 18109 - RNA, 20 nt, Artificial Sequence
  targeting sequence with CTCN PAM
auguuuuuuuuaacagaaau

SEQ ID NO: 18110 - RNA, 20 nt, Artificial Sequence
  targeting sequence with CTCN PAM
uucugccuccauguuuuuuu

SEQ ID NO: 18111 - RNA, 20 nt, Artificial Sequence
  targeting sequence with CTCN PAM
ccaaggggccuggggucaca

SEQ ID NO: 18112 - RNA, 20 nt, Artificial Sequence
  targeting sequence with CTCN PAM
cagcauccuccccaaggggc

SEQ ID NO: 18113 - RNA, 20 nt, Artificial Sequence
  targeting sequence with CTCN PAM
ugccuucucccagcauccuc

SEQ ID NO: 18114 - RNA, 20 nt, Artificial Sequence
  targeting sequence with CTCN PAM
cgccgggacuggccggguca

SEQ ID NO: 18115 - RNA, 20 nt, Artificial Sequence
  targeting sequence with CTCN PAM
gauacauggggauaacagca

SEQ ID NO: 18116 - RNA, 20 nt, Artificial Sequence
  targeting sequence with CTCN PAM
auuuccuucucugauacaug

SEQ ID NO: 18117 - RNA, 20 nt, Artificial Sequence
  targeting sequence with CTCN PAM
cugcccaaggccacacagcc

SEQ ID NO: 18118 - RNA, 20 nt, Artificial Sequence
  targeting sequence with CTCN PAM
gaugauucuggcuguguggc

SEQ ID NO: 18119 - RNA, 20 nt, Artificial Sequence
  targeting sequence with CTCN PAM
uucugugccacuguccccca

SEQ ID NO: 18120 - RNA, 20 nt, Artificial Sequence
  targeting sequence with CTCN PAM
uguguaaguuugacucuccc

SEQ ID NO: 18121 - RNA, 20 nt, Artificial Sequence
  targeting sequence with CTCN PAM
ccccucugcuuucuccgcau

SEQ ID NO: 18122 - RNA, 20 nt, Artificial Sequence
  targeting sequence with CTCN PAM
ccucugcuuucuccgcaucu

SEQ ID NO: 18123 - RNA, 20 nt, Artificial Sequence
  targeting sequence with CTCN PAM
gcuuucuccgcaucugcacc

SEQ ID NO: 18124 - RNA, 20 nt, Artificial Sequence
  targeting sequence with CTCN PAM
gcaucugcaccucccacccc

SEQ ID NO: 18125 - RNA, 20 nt, Artificial Sequence
  targeting sequence with CTCN PAM
cacccccagauggagacucc

SEQ ID NO: 18126 - RNA, 20 nt, Artificial Sequence
  targeting sequence with CTCN PAM
aucugggggugggaggugca

SEQ ID NO: 18127 - RNA, 20 nt, Artificial Sequence
  targeting sequence with CTCN PAM
ugagcaggcagugaggacug

SEQ ID NO: 18128 - RNA, 20 nt, Artificial Sequence
  targeting sequence with CTCN PAM
ggagucuccaucugggggug

SEQ ID NO: 18129 - RNA, 20 nt, Artificial Sequence
  targeting sequence with CTCN PAM
cugccugcucaggagucucc

SEQ ID NO: 18130 - RNA, 20 nt, Artificial Sequence
  targeting sequence with CTCN PAM
gcaguccucacugccugcuc

SEQ ID NO: 18131 - RNA, 20 nt, Artificial Sequence
  targeting sequence with CTCN PAM
gcucagcuguccacuaaggg

SEQ ID NO: 18132 - RNA, 20 nt, Artificial Sequence
  targeting sequence with CTCN PAM
gcuguccacuaagggccguc

SEQ ID NO: 18133 - RNA, 20 nt, Artificial Sequence
  targeting sequence with CTCN PAM
gcagaggagggggccauaag

SEQ ID NO: 18134 - RNA, 20 nt, Artificial Sequence
  targeting sequence with CTCN PAM
gcugagccagcacccagcac

SEQ ID NO: 18135 - RNA, 20 nt, Artificial Sequence
  targeting sequence with CTCN PAM
ucugcugagccagcacccag

SEQ ID NO: 18136 - RNA, 20 nt, Artificial Sequence
  targeting sequence with CTCN PAM
ugaaguugcauuccaucuuc

SEQ ID NO: 18137 - RNA, 20 nt, Artificial Sequence
  targeting sequence with CTCN PAM
caugaaguugcauuccaucu

SEQ ID NO: 18138 - RNA, 20 nt, Artificial Sequence
  targeting sequence with CTCN PAM
ucuugcucucaugaaguugc

SEQ ID NO: 18139 - RNA, 20 nt, Artificial Sequence
  targeting sequence with CTCN PAM
gugcagggaggucagagagg

SEQ ID NO: 18140 - RNA, 20 nt, Artificial Sequence
  targeting sequence with CTCN PAM
cugcaccgaggcuaaacugc

SEQ ID NO: 18141 - RNA, 20 nt, Artificial Sequence
  targeting sequence with CTCN PAM
gaccucccugcaccgaggcu

SEQ ID NO: 18142 - RNA, 20 nt, Artificial Sequence
  targeting sequence with CTCN PAM
cugaccucccugcaccgagg

SEQ ID NO: 18143 - RNA, 20 nt, Artificial Sequence
  targeting sequence with CTCN PAM
aggaagcccucucugaccuc

SEQ ID NO: 18144 - RNA, 20 nt, Artificial Sequence
  targeting sequence with CTCN PAM
uccaggaagcccucucugac

SEQ ID NO: 18145 - RNA, 20 nt, Artificial Sequence
  targeting sequence with CTCN PAM
aagaggcaccggagcugcca

SEQ ID NO: 18146 - RNA, 20 nt, Artificial Sequence
  targeting sequence with CTCN PAM
uugagguuaggcaucaccuc

SEQ ID NO: 18147 - RNA, 20 nt, Artificial Sequence
  targeting sequence with CTCN PAM
ggugccucuuugagguuagg

SEQ ID NO: 18148 - RNA, 20 nt, Artificial Sequence
  targeting sequence with CTCN PAM
cugccugaacuacugcaucc

SEQ ID NO: 18149 - RNA, 20 nt, Artificial Sequence
  targeting sequence with CTCN PAM
cccugccugaacuacugcau

SEQ ID NO: 18150 - RNA, 20 nt, Artificial Sequence
  targeting sequence with CTCN PAM
ucucccugccugaacuacug

SEQ ID NO: 18151 - RNA, 20 nt, Artificial Sequence
  targeting sequence with CTCN PAM
gggucuuugcacaugcuguu

SEQ ID NO: 18152 - RNA, 20 nt, Artificial Sequence
  targeting sequence with CTCN PAM
uuccugccucugggucuuug

SEQ ID NO: 18153 - RNA, 20 nt, Artificial Sequence
  targeting sequence with CTCN PAM
ccuccccauccgugcccucc

SEQ ID NO: 18154 - RNA, 20 nt, Artificial Sequence
  targeting sequence with CTCN PAM
ccauccgugcccucccugac

SEQ ID NO: 18155 - RNA, 20 nt, Artificial Sequence
  targeting sequence with CTCN PAM
cugaccucccccacccacac

SEQ ID NO: 18156 - RNA, 20 nt, Artificial Sequence
  targeting sequence with CTCN PAM
cccacccacacccauccucu

SEQ ID NO: 18157 - RNA, 20 nt, Artificial Sequence
  targeting sequence with CTCN PAM
ccugccggcuccucugcaga

SEQ ID NO: 18158 - RNA, 20 nt, Artificial Sequence
  targeting sequence with CTCN PAM
ugccggcuccucugcagacc

SEQ ID NO: 18159 - RNA, 20 nt, Artificial Sequence
  targeting sequence with CTCN PAM
ucugcagaccggaaggcgag

SEQ ID NO: 18160 - RNA, 20 nt, Artificial Sequence
  targeting sequence with CTCN PAM
gcagaccggaaggcgaggug

SEQ ID NO: 18161 - RNA, 20 nt, Artificial Sequence
  targeting sequence with CTCN PAM
ccuuccggucugcagaggag

SEQ ID NO: 18162 - RNA, 20 nt, Artificial Sequence
  targeting sequence with CTCN PAM
caaugaagagaaacugcuug

SEQ ID NO: 18163 - RNA, 20 nt, Artificial Sequence
  targeting sequence with CTCN PAM
augaagagaaacugcuugga

SEQ ID NO: 18164 - RNA, 20 nt, Artificial Sequence
  targeting sequence with CTCN PAM
ucauugagagcugugggacu

SEQ ID NO: 18165 - RNA, 20 nt, Artificial Sequence
  targeting sequence with CTCN PAM
acucccagauccugccugaa

SEQ ID NO: 18166 - RNA, 20 nt, Artificial Sequence
  targeting sequence with CTCN PAM
cagauccugccugaaaaaca

SEQ ID NO: 18167 - RNA, 20 nt, Artificial Sequence
  targeting sequence with CTCN PAM
ccagcugggguuugauuuuu

SEQ ID NO: 18168 - RNA, 20 nt, Artificial Sequence
  targeting sequence with CTCN PAM
ccagauagccagauaaaacc

SEQ ID NO: 18169 - RNA, 20 nt, Artificial Sequence
  targeting sequence with CTCN PAM
uugaaagccucgccagauag

SEQ ID NO: 18170 - RNA, 20 nt, Artificial Sequence
  targeting sequence with CTCN PAM
accgcccacggggguccggg

SEQ ID NO: 18171 - RNA, 20 nt, Artificial Sequence
  targeting sequence with CTCN PAM
accacccagggaaaccaggc

SEQ ID NO: 18172 - RNA, 20 nt, Artificial Sequence
  targeting sequence with CTCN PAM
augcuccugccaaaucccug

SEQ ID NO: 18173 - RNA, 20 nt, Artificial Sequence
  targeting sequence with CTCN PAM
ugccaaaucccugcaugcuc

SEQ ID NO: 18174 - RNA, 20 nt, Artificial Sequence
  targeting sequence with CTCN PAM
caccuccuagcucagcaggu

SEQ ID NO: 18175 - RNA, 20 nt, Artificial Sequence
  targeting sequence with CTCN PAM
uagcucagcaggugcugggc

SEQ ID NO: 18176 - RNA, 20 nt, Artificial Sequence
  targeting sequence with CTCN PAM
gcaggugcugggcggucgcu

SEQ ID NO: 18177 - RNA, 20 nt, Artificial Sequence
  targeting sequence with CTCN PAM
ucccuaauaacuucaguuag

SEQ ID NO: 18178 - RNA, 20 nt, Artificial Sequence
  targeting sequence with CTCN PAM
agggcuggcagggaacuaac

SEQ ID NO: 18179 - RNA, 20 nt, Artificial Sequence
  targeting sequence with CTCN PAM
ugaccaggcacacccuuuga

SEQ ID NO: 18180 - RNA, 20 nt, Artificial Sequence
  targeting sequence with CTCN PAM
gucacacagcagagcuggga

SEQ ID NO: 18181 - RNA, 20 nt, Artificial Sequence
  targeting sequence with CTCN PAM
gcugugugacugaggacucc

SEQ ID NO: 18182 - RNA, 20 nt, Artificial Sequence
  targeting sequence with CTCN PAM
ggggccagaaaaccccaggu

SEQ ID NO: 18183 - RNA, 20 nt, Artificial Sequence
  targeting sequence with CTCN PAM
ugccacagugcacagggcuc

SEQ ID NO: 18184 - RNA, 20 nt, Artificial Sequence
  targeting sequence with CTCN PAM
aggggcaguuaaugaagagg

SEQ ID NO: 18185 - RNA, 20 nt, Artificial Sequence
  targeting sequence with CTCN PAM
ucauuaacugccccuagagc

SEQ ID NO: 18186 - RNA, 20 nt, Artificial Sequence
  targeting sequence with CTCN PAM
uucccccgccccacacaugc

SEQ ID NO: 18187 - RNA, 20 nt, Artificial Sequence
  targeting sequence with CTCN PAM
cacuuccagggacagggagc

SEQ ID NO: 18188 - RNA, 20 nt, Artificial Sequence
  targeting sequence with CTCN PAM
cugucccuggaagugugagc

SEQ ID NO: 18189 - RNA, 20 nt, Artificial Sequence
  targeting sequence with CTCN PAM
cuccucaccgucagccucac

SEQ ID NO: 18190 - RNA, 20 nt, Artificial Sequence
  targeting sequence with CTCN PAM
ucaccgucagccucacacau

SEQ ID NO: 18191 - RNA, 20 nt, Artificial Sequence
  targeting sequence with CTCN PAM
ccgucagccucacacauaug

SEQ ID NO: 18192 - RNA, 20 nt, Artificial Sequence
  targeting sequence with CTCN PAM
cacauauguccccuugcugg

SEQ ID NO: 18193 - RNA, 20 nt, Artificial Sequence
  targeting sequence with CTCN PAM
cacccccaccccggccaggu

SEQ ID NO: 18194 - RNA, 20 nt, Artificial Sequence
  targeting sequence with CTCN PAM
cggucagugauuaggaaccu

SEQ ID NO: 18195 - RNA, 20 nt, Artificial Sequence
  targeting sequence with CTCN PAM
uggucucccggucagugauu

SEQ ID NO: 18196 - RNA, 20 nt, Artificial Sequence
  targeting sequence with CTCN PAM
agaaugguggggcaggacug

SEQ ID NO: 18197 - RNA, 20 nt, Artificial Sequence
  targeting sequence with CTCN PAM
aguccugccccaccauucua

SEQ ID NO: 18198 - RNA, 20 nt, Artificial Sequence
  targeting sequence with CTCN PAM
uauguuccauggucuucacc

SEQ ID NO: 18199 - RNA, 20 nt, Artificial Sequence
  targeting sequence with CTCN PAM
gccuuuccuagaaagaagcu

SEQ ID NO: 18200 - RNA, 20 nt, Artificial Sequence
  targeting sequence with CTCN PAM
ugcucagccuggguggggau

SEQ ID NO: 18201 - RNA, 20 nt, Artificial Sequence
  targeting sequence with CTCN PAM
gccuggguggggaugaaggc

SEQ ID NO: 18202 - RNA, 20 nt, Artificial Sequence
  targeting sequence with CTCN PAM
ggggcaugugguuagcacac

SEQ ID NO: 18203 - RNA, 20 nt, Artificial Sequence
  targeting sequence with CTCN PAM
uccuguccuugcccagugcu

SEQ ID NO: 18204 - RNA, 20 nt, Artificial Sequence
  targeting sequence with CTCN PAM
uguccuugcccagugcuggc

SEQ ID NO: 18205 - RNA, 20 nt, Artificial Sequence
  targeting sequence with CTCN PAM
cuuggccugggcuugggacc

SEQ ID NO: 18206 - RNA, 20 nt, Artificial Sequence
  targeting sequence with CTCN PAM
gauggggaugugucgggucc

SEQ ID NO: 18207 - RNA, 20 nt, Artificial Sequence
  targeting sequence with CTCN PAM
uucguggauacugaucucag

SEQ ID NO: 18208 - RNA, 20 nt, Artificial Sequence
  targeting sequence with CTCN PAM
gugugaugcgagggccugcc

SEQ ID NO: 18209 - RNA, 20 nt, Artificial Sequence
  targeting sequence with CTCN PAM
caucacaccgagucuccuuc

SEQ ID NO: 18210 - RNA, 20 nt, Artificial Sequence
  targeting sequence with CTCN PAM
ucugcuggcucugccgacag

SEQ ID NO: 18211 - RNA, 20 nt, Artificial Sequence
  targeting sequence with CTCN PAM
gccgacagcacuauggggac

SEQ ID NO: 18212 - RNA, 20 nt, Artificial Sequence
  targeting sequence with CTCN PAM
ugucuucacaguccccauag

SEQ ID NO: 18213 - RNA, 20 nt, Artificial Sequence
  targeting sequence with CTCN PAM
cuccugucuucacagucccc

SEQ ID NO: 18214 - RNA, 20 nt, Artificial Sequence
  targeting sequence with CTCN PAM
uuccccuucucccuccuguc

SEQ ID NO: 18215 - RNA, 20 nt, Artificial Sequence
  targeting sequence with CTCN PAM
uguggccguccuguucuccu

SEQ ID NO: 18216 - RNA, 20 nt, Artificial Sequence
  targeting sequence with CTCN PAM
uucccuccuguggccguccu

SEQ ID NO: 18217 - RNA, 20 nt, Artificial Sequence
  targeting sequence with CTCN PAM
gauaaccuuacuccccaaag

SEQ ID NO: 18218 - RNA, 20 nt, Artificial Sequence
  targeting sequence with CTCN PAM
ccaaagccccucacagcccu

SEQ ID NO: 18219 - RNA, 20 nt, Artificial Sequence
  targeting sequence with CTCN PAM
cagcccugugggccauauca

SEQ ID NO: 18220 - RNA, 20 nt, Artificial Sequence
  targeting sequence with CTCN PAM
agaggguguaauuaggccca

SEQ ID NO: 18221 - RNA, 20 nt, Artificial Sequence
  targeting sequence with CTCN PAM
ggaggacuguggggcaaugg

SEQ ID NO: 18222 - RNA, 20 nt, Artificial Sequence
  targeting sequence with CTCN PAM
agugugccccaucuguaaaa

SEQ ID NO: 18223 - RNA, 20 nt, Artificial Sequence
  targeting sequence with CTCN PAM
aaaagcagcaaggggucccc

SEQ ID NO: 18224 - RNA, 20 nt, Artificial Sequence
  targeting sequence with CTCN PAM
cccuuccacuucccuccagg

SEQ ID NO: 18225 - RNA, 20 nt, Artificial Sequence
  targeting sequence with CTCN PAM
aggguugaccucagcagcuc

SEQ ID NO: 18226 - RNA, 20 nt, Artificial Sequence
  targeting sequence with CTCN PAM
gcagcuccugguugggcuuu

SEQ ID NO: 18227 - RNA, 20 nt, Artificial Sequence
  targeting sequence with CTCN PAM
ugguugggcuuuucccagag

SEQ ID NO: 18228 - RNA, 20 nt, Artificial Sequence
  targeting sequence with CTCN PAM
gggaaaagcccaaccaggag

SEQ ID NO: 18229 - RNA, 20 nt, Artificial Sequence
  targeting sequence with CTCN PAM
ugcuuccggccuuggcucug

SEQ ID NO: 18230 - RNA, 20 nt, Artificial Sequence
  targeting sequence with CTCN PAM
ggacucgugcuuccggccuu

SEQ ID NO: 18231 - RNA, 20 nt, Artificial Sequence
  targeting sequence with CTCN PAM
gggcuggcgaggcggaaaca

SEQ ID NO: 18232 - RNA, 20 nt, Artificial Sequence
  targeting sequence with CTCN PAM
ccagcccggagccccagccc

SEQ ID NO: 18233 - RNA, 20 nt, Artificial Sequence
  targeting sequence with CTCN PAM
cccaccgggaggaaggagga

SEQ ID NO: 18234 - RNA, 20 nt, Artificial Sequence
  targeting sequence with CTCN PAM
cggugggggagccugacccc

SEQ ID NO: 18235 - RNA, 20 nt, Artificial Sequence
  targeting sequence with CTCN PAM
uuccucccggugggggagcc

SEQ ID NO: 18236 - RNA, 20 nt, Artificial Sequence
  targeting sequence with CTCN PAM
uuccuccuuccucccggugg

SEQ ID NO: 18237 - RNA, 20 nt, Artificial Sequence
  targeting sequence with CTCN PAM
ggccuuuccuccuuccuccu

SEQ ID NO: 18238 - RNA, 20 nt, Artificial Sequence
  targeting sequence with CTCN PAM
uccggccuuuccuccuuccu

SEQ ID NO: 18239 - RNA, 20 nt, Artificial Sequence
  targeting sequence with CTCN PAM
ugcuccuccggccuuuccuc

SEQ ID NO: 18240 - RNA, 20 nt, Artificial Sequence
  targeting sequence with CTCN PAM
ggccuccugcuccuccggcc

SEQ ID NO: 18241 - RNA, 20 nt, Artificial Sequence
  targeting sequence with CTCN PAM
cccagccagguucucaccuc

SEQ ID NO: 18242 - RNA, 20 nt, Artificial Sequence
  targeting sequence with CTCN PAM
cagccagguucucaccucca

SEQ ID NO: 18243 - RNA, 20 nt, Artificial Sequence
  targeting sequence with CTCN PAM
ccuccagccuugccuuccuc

SEQ ID NO: 18244 - RNA, 20 nt, Artificial Sequence
  targeting sequence with CTCN PAM
agccuugccuuccucacccc

SEQ ID NO: 18245 - RNA, 20 nt, Artificial Sequence
  targeting sequence with CTCN PAM
cccccagaggcugggcugca

SEQ ID NO: 18246 - RNA, 20 nt, Artificial Sequence
  targeting sequence with CTCN PAM
gggggugaggaaggcaaggc

SEQ ID NO: 18247 - RNA, 20 nt, Artificial Sequence
  targeting sequence with CTCN PAM
guggcugaggaaggagaugu

SEQ ID NO: 18248 - RNA, 20 nt, Artificial Sequence
  targeting sequence with CTCN PAM
gccacugagcgccuacugug

SEQ ID NO: 18249 - RNA, 20 nt, Artificial Sequence
  targeting sequence with CTCN PAM
uuccucagccacugagcgcc

SEQ ID NO: 18250 - RNA, 20 nt, Artificial Sequence
  targeting sequence with CTCN PAM
ccucuccuucacucagccgg

SEQ ID NO: 18251 - RNA, 20 nt, Artificial Sequence
  targeting sequence with CTCN PAM
ucuccuucacucagccgggg

SEQ ID NO: 18252 - RNA, 20 nt, Artificial Sequence
  targeting sequence with CTCN PAM
ccuucacucagccggggcuc

SEQ ID NO: 18253 - RNA, 20 nt, Artificial Sequence
  targeting sequence with CTCN PAM
uucacucagccggggcucag

SEQ ID NO: 18254 - RNA, 20 nt, Artificial Sequence
  targeting sequence with CTCN PAM
gccggggcucaggccccaau

SEQ ID NO: 18255 - RNA, 20 nt, Artificial Sequence
  targeting sequence with CTCN PAM
ggccccaaucccaaucgccc

SEQ ID NO: 18256 - RNA, 20 nt, Artificial Sequence
  targeting sequence with CTCN PAM
ucuuccuucugucuuagucc

SEQ ID NO: 18257 - RNA, 20 nt, Artificial Sequence
  targeting sequence with CTCN PAM
uccuucugucuuaguccaaa

SEQ ID NO: 18258 - RNA, 20 nt, Artificial Sequence
  targeting sequence with CTCN PAM
ggaugagacuguaucuggag

SEQ ID NO: 18259 - RNA, 20 nt, Artificial Sequence
  targeting sequence with CTCN PAM
uccugagguauuggggguuu

SEQ ID NO: 18260 - RNA, 20 nt, Artificial Sequence
  targeting sequence with CTCN PAM
agauacagucucauccugag

SEQ ID NO: 18261 - RNA, 20 nt, Artificial Sequence
  targeting sequence with CTCN PAM
uuaaaggcugucuccagaua

SEQ ID NO: 18262 - RNA, 20 nt, Artificial Sequence
  targeting sequence with CTCN PAM
uuuuaacuuaaugaacucuu

SEQ ID NO: 18263 - RNA, 20 nt, Artificial Sequence
  targeting sequence with CTCN PAM
uaccaucucauuuuaacuua

SEQ ID NO: 18264 - RNA, 20 nt, Artificial Sequence
  targeting sequence with CTCN PAM
ucauaccaucucauuuuaac

SEQ ID NO: 18265 - RNA, 20 nt, Artificial Sequence
  targeting sequence with CTCN PAM
cgccugugauccuagcacuu

SEQ ID NO: 18266 - RNA, 20 nt, Artificial Sequence
  targeting sequence with CTCN PAM
caaagugcuaggaucacagg

SEQ ID NO: 18267 - RNA, 20 nt, Artificial Sequence
  targeting sequence with CTCN PAM
ugcaucagccucccaaagug

SEQ ID NO: 18268 - RNA, 20 nt, Artificial Sequence
  targeting sequence with CTCN PAM
agcgauccuccugcaucagc

SEQ ID NO: 18269 - RNA, 20 nt, Artificial Sequence
  targeting sequence with CTCN PAM
ugggcucaagcgauccuccu

SEQ ID NO: 18270 - RNA, 20 nt, Artificial Sequence
  targeting sequence with CTCN PAM
aacuccugggcucaagcgau

SEQ ID NO: 18271 - RNA, 20 nt, Artificial Sequence
  targeting sequence with CTCN PAM
cuguguugccuaggcugguc

SEQ ID NO: 18272 - RNA, 20 nt, Artificial Sequence
  targeting sequence with CTCN PAM
acaaaaaguuagcugggcau

SEQ ID NO: 18273 - RNA, 20 nt, Artificial Sequence
  targeting sequence with CTCN PAM
augcccagcuaacuuuuugu

SEQ ID NO: 18274 - RNA, 20 nt, Artificial Sequence
  targeting sequence with CTCN PAM
gcuacuuagaggaccgaggu

SEQ ID NO: 18275 - RNA, 20 nt, Artificial Sequence
  targeting sequence with CTCN PAM
aaguagcugagacuacgggc

SEQ ID NO: 18276 - RNA, 20 nt, Artificial Sequence
  targeting sequence with CTCN PAM
guccucuaaguagcugagac

SEQ ID NO: 18277 - RNA, 20 nt, Artificial Sequence
  targeting sequence with CTCN PAM
agccaucuucccaccucggu

SEQ ID NO: 18278 - RNA, 20 nt, Artificial Sequence
  targeting sequence with CTCN PAM
ugggcucaagccaucuuccc

SEQ ID NO: 18279 - RNA, 20 nt, Artificial Sequence
  targeting sequence with CTCN PAM
cugcagccuugaccuccugg

SEQ ID NO: 18280 - RNA, 20 nt, Artificial Sequence
  targeting sequence with CTCN PAM
agaacugagaggaaauaggu

SEQ ID NO: 18281 - RNA, 20 nt, Artificial Sequence
  targeting sequence with CTCN PAM
guucuggagggugcaagugg

SEQ ID NO: 18282 - RNA, 20 nt, Artificial Sequence
  targeting sequence with CTCN PAM
caguucuggagggugcaagu

SEQ ID NO: 18283 - RNA, 20 nt, Artificial Sequence
  targeting sequence with CTCN PAM
acaacagaaaccuauuuccu

SEQ ID NO: 18284 - RNA, 20 nt, Artificial Sequence
  targeting sequence with CTCN PAM
uguuacggcagccuagcaag

SEQ ID NO: 18285 - RNA, 20 nt, Artificial Sequence
  targeting sequence with CTCN PAM
cccuggccccgugaccucuc

SEQ ID NO: 18286 - RNA, 20 nt, Artificial Sequence
  targeting sequence with CTCN PAM
cccgcuguucuggaggcugc

SEQ ID NO: 18287 - RNA, 20 nt, Artificial Sequence
  targeting sequence with CTCN PAM
cgcuguucuggaggcugcaa

SEQ ID NO: 18288 - RNA, 20 nt, Artificial Sequence
  targeting sequence with CTCN PAM
agaacagcgggagaggucac

SEQ ID NO: 18289 - RNA, 20 nt, Artificial Sequence
  targeting sequence with CTCN PAM
uuggucuuggacuuggccuu

SEQ ID NO: 18290 - RNA, 20 nt, Artificial Sequence
  targeting sequence with CTCN PAM
cuccuuggcuugcagauggu

SEQ ID NO: 18291 - RNA, 20 nt, Artificial Sequence
  targeting sequence with CTCN PAM
ccuuggcuugcagauggugc

SEQ ID NO: 18292 - RNA, 20 nt, Artificial Sequence
  targeting sequence with CTCN PAM
uuggcuugcagauggugccu

SEQ ID NO: 18293 - RNA, 20 nt, Artificial Sequence
  targeting sequence with CTCN PAM
caugaucuucccucacuucc

SEQ ID NO: 18294 - RNA, 20 nt, Artificial Sequence
  targeting sequence with CTCN PAM
cuuccugcauaucugaaucc

SEQ ID NO: 18295 - RNA, 20 nt, Artificial Sequence
  targeting sequence with CTCN PAM
gcuccacuucuuuauuuuuu

SEQ ID NO: 18296 - RNA, 20 nt, Artificial Sequence
  targeting sequence with CTCN PAM
acuucuuuauuuuuuuuuuu

SEQ ID NO: 18297 - RNA, 20 nt, Artificial Sequence
  targeting sequence with CTCN PAM
aaaaaaaaaaaauaaagaag

SEQ ID NO: 18298 - RNA, 20 nt, Artificial Sequence
  targeting sequence with CTCN PAM
gucacccaggcuggagugca

SEQ ID NO: 18299 - RNA, 20 nt, Artificial Sequence
  targeting sequence with CTCN PAM
agccugggugacagagucag

SEQ ID NO: 18300 - RNA, 20 nt, Artificial Sequence
  targeting sequence with CTCN PAM
gcucacugcagccucgacuu

SEQ ID NO: 18301 - RNA, 20 nt, Artificial Sequence
  targeting sequence with CTCN PAM
cugcagccucgacuuccuag

SEQ ID NO: 18302 - RNA, 20 nt, Artificial Sequence
  targeting sequence with CTCN PAM
acuuccuaggcucaagccau

SEQ ID NO: 18303 - RNA, 20 nt, Artificial Sequence
  targeting sequence with CTCN PAM
agccauccuccaaccucagc

SEQ ID NO: 18304 - RNA, 20 nt, Artificial Sequence
  targeting sequence with CTCN PAM
aaccucagccuccugaguag

SEQ ID NO: 18305 - RNA, 20 nt, Artificial Sequence
  targeting sequence with CTCN PAM
gccuccugaguagcugggac

SEQ ID NO: 18306 - RNA, 20 nt, Artificial Sequence
  targeting sequence with CTCN PAM
ugaguagcugggaccccugg

SEQ ID NO: 18307 - RNA, 20 nt, Artificial Sequence
  targeting sequence with CTCN PAM
ggaggcugagguuggaggau

SEQ ID NO: 18308 - RNA, 20 nt, Artificial Sequence
  targeting sequence with CTCN PAM
gccaggggucccagcuacuc

SEQ ID NO: 18309 - RNA, 20 nt, Artificial Sequence
  targeting sequence with CTCN PAM
auggugccucugccaggggu

SEQ ID NO: 18310 - RNA, 20 nt, Artificial Sequence
  targeting sequence with CTCN PAM
ccgcuccagcagcacuggcc

SEQ ID NO: 18311 - RNA, 20 nt, Artificial Sequence
  targeting sequence with CTCN PAM
gcuccagcagcacuggccuc

SEQ ID NO: 18312 - RNA, 20 nt, Artificial Sequence
  targeting sequence with CTCN PAM
agcagcacuggccuccucac

SEQ ID NO: 18313 - RNA, 20 nt, Artificial Sequence
  targeting sequence with CTCN PAM
ucacugagcuugguccagga

SEQ ID NO: 18314 - RNA, 20 nt, Artificial Sequence
  targeting sequence with CTCN PAM
cugagcuugguccaggacgg

SEQ ID NO: 18315 - RNA, 20 nt, Artificial Sequence
  targeting sequence with CTCN PAM
gugaggaggccagugcugcu

SEQ ID NO: 18316 - RNA, 20 nt, Artificial Sequence
  targeting sequence with CTCN PAM
ccagggcugccgccuucuua

SEQ ID NO: 18317 - RNA, 20 nt, Artificial Sequence
  targeting sequence with CTCN PAM
gguuucugcucaaauauccc

SEQ ID NO: 18318 - RNA, 20 nt, Artificial Sequence
  targeting sequence with CTCN PAM
aauaucccccuccaaagagg

SEQ ID NO: 18319 - RNA, 20 nt, Artificial Sequence
  targeting sequence with CTCN PAM
aaagaggcccucccugacca

SEQ ID NO: 18320 - RNA, 20 nt, Artificial Sequence
  targeting sequence with CTCN PAM
uuggagggggauauuugagc

SEQ ID NO: 18321 - RNA, 20 nt, Artificial Sequence
  targeting sequence with CTCN PAM
cugaccaaagugccaaucag

SEQ ID NO: 18322 - RNA, 20 nt, Artificial Sequence
  targeting sequence with CTCN PAM
cucacuggauggaccuucac

SEQ ID NO: 18323 - RNA, 20 nt, Artificial Sequence
  targeting sequence with CTCN PAM
cacuggauggaccuucacca

SEQ ID NO: 18324 - RNA, 20 nt, Artificial Sequence
  targeting sequence with CTCN PAM
cuggauggaccuucaccagg

SEQ ID NO: 18325 - RNA, 20 nt, Artificial Sequence
  targeting sequence with CTCN PAM
agggccacagcagggcccgg

SEQ ID NO: 18326 - RNA, 20 nt, Artificial Sequence
  targeting sequence with CTCN PAM
ccuugguacugccaccccau

SEQ ID NO: 18327 - RNA, 20 nt, Artificial Sequence
  targeting sequence with CTCN PAM
caaaacacagggucacaggg

SEQ ID NO: 18328 - RNA, 20 nt, Artificial Sequence
  targeting sequence with CTCN PAM
gaggcagagcagggccucca

SEQ ID NO: 18329 - RNA, 20 nt, Artificial Sequence
  targeting sequence with CTCN PAM
gagacccugugacccugugu

SEQ ID NO: 18330 - RNA, 20 nt, Artificial Sequence
  targeting sequence with CTCN PAM
gccucugagacccugugacc

SEQ ID NO: 18331 - RNA, 20 nt, Artificial Sequence
  targeting sequence with CTCN PAM
aggggggcccguggaugugg

SEQ ID NO: 18332 - RNA, 20 nt, Artificial Sequence
  targeting sequence with CTCN PAM
ugguuggaccacccacaucc

SEQ ID NO: 18333 - RNA, 20 nt, Artificial Sequence
  targeting sequence with CTCN PAM
gcuucccacgcagcaccugu

SEQ ID NO: 18334 - RNA, 20 nt, Artificial Sequence
  targeting sequence with CTCN PAM
agaggcugcuuguuugggaa

SEQ ID NO: 18335 - RNA, 20 nt, Artificial Sequence
  targeting sequence with CTCN PAM
ggaggaaucacuggaagaca

SEQ ID NO: 18336 - RNA, 20 nt, Artificial Sequence
  targeting sequence with CTCN PAM
gccagugccucccugcucca

SEQ ID NO: 18337 - RNA, 20 nt, Artificial Sequence
  targeting sequence with CTCN PAM
cugcuccagugucugaggag

SEQ ID NO: 18338 - RNA, 20 nt, Artificial Sequence
  targeting sequence with CTCN PAM
agugucugaggaggacuuga

SEQ ID NO: 18339 - RNA, 20 nt, Artificial Sequence
  targeting sequence with CTCN PAM
gacacuggagcagggaggca

SEQ ID NO: 18340 - RNA, 20 nt, Artificial Sequence
  targeting sequence with CTCN PAM
ucagacacuggagcagggag

SEQ ID NO: 18341 - RNA, 20 nt, Artificial Sequence
  targeting sequence with CTCN PAM
aguccuccucagacacugga

SEQ ID NO: 18342 - RNA, 20 nt, Artificial Sequence
  targeting sequence with CTCN PAM
guccugggacucguggggug

SEQ ID NO: 18343 - RNA, 20 nt, Artificial Sequence
  targeting sequence with CTCN PAM
ugggguggagcauucaccug

SEQ ID NO: 18344 - RNA, 20 nt, Artificial Sequence
  targeting sequence with CTCN PAM
accccacgagucccaggacu

SEQ ID NO: 18345 - RNA, 20 nt, Artificial Sequence
  targeting sequence with CTCN PAM
ugggguagagcuggggcugg

SEQ ID NO: 18346 - RNA, 20 nt, Artificial Sequence
  targeting sequence with CTCN PAM
accccacgaguccccaggug

SEQ ID NO: 18347 - RNA, 20 nt, Artificial Sequence
  targeting sequence with CTCN PAM
aucugggagcaggaugaggg

SEQ ID NO: 18348 - RNA, 20 nt, Artificial Sequence
  targeting sequence with CTCN PAM
cagauggaggugcaggcagu

SEQ ID NO: 18349 - RNA, 20 nt, Artificial Sequence
  targeting sequence with CTCN PAM
uccugcucccagauggaggu

SEQ ID NO: 18350 - RNA, 20 nt, Artificial Sequence
  targeting sequence with CTCN PAM
cagugguuuccugcccuucc

SEQ ID NO: 18351 - RNA, 20 nt, Artificial Sequence
  targeting sequence with CTCN PAM
cacccagcgccucccagugg

SEQ ID NO: 18352 - RNA, 20 nt, Artificial Sequence
  targeting sequence with CTCN PAM
uugcucagucaacccugucu

SEQ ID NO: 18353 - RNA, 20 nt, Artificial Sequence
  targeting sequence with CTCN PAM
gucaacccugucuugagaca

SEQ ID NO: 18354 - RNA, 20 nt, Artificial Sequence
  targeting sequence with CTCN PAM
agacaggguugacugagcaa

SEQ ID NO: 18355 - RNA, 20 nt, Artificial Sequence
  targeting sequence with CTCN PAM
cacuugaaaggcugagacag

SEQ ID NO: 18356 - RNA, 20 nt, Artificial Sequence
  targeting sequence with CTCN PAM
gccuuucaagugggaguagg

SEQ ID NO: 18357 - RNA, 20 nt, Artificial Sequence
  targeting sequence with CTCN PAM
cccacacuugguggugucag

SEQ ID NO: 18358 - RNA, 20 nt, Artificial Sequence
  targeting sequence with CTCN PAM
acauccucacccacacuugg

SEQ ID NO: 18359 - RNA, 20 nt, Artificial Sequence
  targeting sequence with CTCN PAM
guaaaaccuuuugcuaguuu

SEQ ID NO: 18360 - RNA, 20 nt, Artificial Sequence
  targeting sequence with CTCN PAM
cgccuguaaucccagcacuu

SEQ ID NO: 18361 - RNA, 20 nt, Artificial Sequence
  targeting sequence with CTCN PAM
caaagugcugggauuacagg

SEQ ID NO: 18362 - RNA, 20 nt, Artificial Sequence
  targeting sequence with CTCN PAM
gccucccaaagugcugggau

SEQ ID NO: 18363 - RNA, 20 nt, Artificial Sequence
  targeting sequence with CTCN PAM
ugauccgcccgccucggccu

SEQ ID NO: 18364 - RNA, 20 nt, Artificial Sequence
  targeting sequence with CTCN PAM
ugaccucgugauccgcccgc

SEQ ID NO: 18365 - RNA, 20 nt, Artificial Sequence
  targeting sequence with CTCN PAM
aucuccugaccucgugaucc

SEQ ID NO: 18366 - RNA, 20 nt, Artificial Sequence
  targeting sequence with CTCN PAM
ggaggcugaggcaggagaau

SEQ ID NO: 18367 - RNA, 20 nt, Artificial Sequence
  targeting sequence with CTCN PAM
ugaguagcugggauuacagg

SEQ ID NO: 18368 - RNA, 20 nt, Artificial Sequence
  targeting sequence with CTCN PAM
gccuccugaguagcugggau

SEQ ID NO: 18369 - RNA, 20 nt, Artificial Sequence
  targeting sequence with CTCN PAM
ugccucagccuccugaguag

SEQ ID NO: 18370 - RNA, 20 nt, Artificial Sequence
  targeting sequence with CTCN PAM
cggguucaugccauucuccu

SEQ ID NO: 18371 - RNA, 20 nt, Artificial Sequence
  targeting sequence with CTCN PAM
gccucccggguucaugccau

SEQ ID NO: 18372 - RNA, 20 nt, Artificial Sequence
  targeting sequence with CTCN PAM
cugcaagcuccgccucccgg

SEQ ID NO: 18373 - RNA, 20 nt, Artificial Sequence
  targeting sequence with CTCN PAM
gcucacugcaagcuccgccu

SEQ ID NO: 18374 - RNA, 20 nt, Artificial Sequence
  targeting sequence with CTCN PAM
ugggacagacagagugagac

SEQ ID NO: 18375 - RNA, 20 nt, Artificial Sequence
  targeting sequence with CTCN PAM
gucugucccaggagugcagu

SEQ ID NO: 18376 - RNA, 20 nt, Artificial Sequence
  targeting sequence with CTCN PAM
cucugucugucccaggagug

SEQ ID NO: 18377 - RNA, 20 nt, Artificial Sequence
  targeting sequence with CTCN PAM
aaaaaaaaaaaaaaaaaaaa

SEQ ID NO: 18378 - RNA, 20 nt, Artificial Sequence
  targeting sequence with CTCN PAM
auugauaauuucugcaaucu

SEQ ID NO: 18379 - RNA, 20 nt, Artificial Sequence
  targeting sequence with CTCN PAM
ucaccagcccagggacacuu

SEQ ID NO: 18380 - RNA, 20 nt, Artificial Sequence
  targeting sequence with CTCN PAM
auguguuuaccucuucacca

SEQ ID NO: 18381 - RNA, 20 nt, Artificial Sequence
  targeting sequence with CTCN PAM
auacaauggaacgaaaagga

SEQ ID NO: 18382 - RNA, 20 nt, Artificial Sequence
  targeting sequence with CTCN PAM
ugauacuccgacacaaggau

SEQ ID NO: 18383 - RNA, 20 nt, Artificial Sequence
  targeting sequence with CTCN PAM
gacacaaggaugcaucucca

SEQ ID NO: 18384 - RNA, 20 nt, Artificial Sequence
  targeting sequence with CTCN PAM
aagccaggcuggaaaggcuc

SEQ ID NO: 18385 - RNA, 20 nt, Artificial Sequence
  targeting sequence with CTCN PAM
acgcugcaggaucccaugua

SEQ ID NO: 18386 - RNA, 20 nt, Artificial Sequence
  targeting sequence with CTCN PAM
ccccagccccagcccuagcc

SEQ ID NO: 18387 - RNA, 20 nt, Artificial Sequence
  targeting sequence with CTCN PAM
gaacaagacauggaacauuc

SEQ ID NO: 18388 - RNA, 20 nt, Artificial Sequence
  targeting sequence with CTCN PAM
aaugugaagucugguaaacu

SEQ ID NO: 18389 - RNA, 20 nt, Artificial Sequence
  targeting sequence with CTCN PAM
gaucucaaaugugaagucug

SEQ ID NO: 18390 - RNA, 20 nt, Artificial Sequence
  targeting sequence with CTCN PAM
ugauguaaauuauaacucaa

SEQ ID NO: 18391 - RNA, 20 nt, Artificial Sequence
  targeting sequence with CTCN PAM
augaauaaaaguuuuuaaaa

SEQ ID NO: 18392 - RNA, 20 nt, Artificial Sequence
  targeting sequence with CTCN PAM
ccagccugugccagguucuu

SEQ ID NO: 18393 - RNA, 20 nt, Artificial Sequence
  targeting sequence with CTCN PAM
guccccaggcuaagaaccug

SEQ ID NO: 18394 - RNA, 20 nt, Artificial Sequence
  targeting sequence with CTCN PAM
caccccugccggucagaaag

SEQ ID NO: 18395 - RNA, 20 nt, Artificial Sequence
  targeting sequence with CTCN PAM
cuggguugccuucgcagcac

SEQ ID NO: 18396 - RNA, 20 nt, Artificial Sequence
  targeting sequence with CTCN PAM
ggcgcccucccuggguugcc

SEQ ID NO: 18397 - RNA, 20 nt, Artificial Sequence
  targeting sequence with CTCN PAM
cccgugcucccgccccgcag

SEQ ID NO: 18398 - RNA, 20 nt, Artificial Sequence
  targeting sequence with CTCN PAM
cgugcucccgccccgcagag

SEQ ID NO: 18399 - RNA, 20 nt, Artificial Sequence
  targeting sequence with CTCN PAM
cgccccgcagagagaggccg

SEQ ID NO: 18400 - RNA, 20 nt, Artificial Sequence
  targeting sequence with CTCN PAM
gcggggcgggagcacgggag

SEQ ID NO: 18401 - RNA, 20 nt, Artificial Sequence
  targeting sequence with CTCN PAM
cugcggggcgggagcacggg

SEQ ID NO: 18402 - RNA, 20 nt, Artificial Sequence
  targeting sequence with CTCN PAM
cucugcggggcgggagcacg

SEQ ID NO: 18403 - RNA, 20 nt, Artificial Sequence
  targeting sequence with CTCN PAM
ggggccgcuuccggccucuc

SEQ ID NO: 18404 - RNA, 20 nt, Artificial Sequence
  targeting sequence with CTCN PAM
gccucguccucccgcggcca

SEQ ID NO: 18405 - RNA, 20 nt, Artificial Sequence
  targeting sequence with CTCN PAM
uccucccgcggccagaggug

SEQ ID NO: 18406 - RNA, 20 nt, Artificial Sequence
  targeting sequence with CTCN PAM
cgcggccagaggugcgaccu

SEQ ID NO: 18407 - RNA, 20 nt, Artificial Sequence
  targeting sequence with CTCN PAM
ggccgcgggaggacgaggcg

SEQ ID NO: 18408 - RNA, 20 nt, Artificial Sequence
  targeting sequence with CTCN PAM
gagccccuggccagcuccca

SEQ ID NO: 18409 - RNA, 20 nt, Artificial Sequence
  targeting sequence with CTCN PAM
gaggucgcaccucuggccgc

SEQ ID NO: 18410 - RNA, 20 nt, Artificial Sequence
  targeting sequence with CTCN PAM
cagccggccuaggggggcgg

SEQ ID NO: 18411 - RNA, 20 nt, Artificial Sequence
  targeting sequence with CTCN PAM
gccccgugcccccgcccccc

SEQ ID NO: 18412 - RNA, 20 nt, Artificial Sequence
  targeting sequence with CTCN PAM
ucccgccucgcuuggaggga

SEQ ID NO: 18413 - RNA, 20 nt, Artificial Sequence
  targeting sequence with CTCN PAM
cuuggagggagcaagggcuc

SEQ ID NO: 18414 - RNA, 20 nt, Artificial Sequence
  targeting sequence with CTCN PAM
aagcgaggcgggacgagcac

SEQ ID NO: 18415 - RNA, 20 nt, Artificial Sequence
  targeting sequence with CTCN PAM
cuccaagcgaggcgggacga

SEQ ID NO: 18416 - RNA, 20 nt, Artificial Sequence
  targeting sequence with CTCN PAM
gagcccugggcccagguccu

SEQ ID NO: 18417 - RNA, 20 nt, Artificial Sequence
  targeting sequence with CTCN PAM
gagcccuugcucccuccaag

SEQ ID NO: 18418 - RNA, 20 nt, Artificial Sequence
  targeting sequence with CTCN PAM
gcuuccccggcugcggguac

SEQ ID NO: 18419 - RNA, 20 nt, Artificial Sequence
  targeting sequence with CTCN PAM
ggaagcuggggguguacccg

SEQ ID NO: 18420 - RNA, 20 nt, Artificial Sequence
  targeting sequence with CTCN PAM
cugcuccacccagaaguugc

SEQ ID NO: 18421 - RNA, 20 nt, Artificial Sequence
  targeting sequence with CTCN PAM
acccagaaguugcggugacu

SEQ ID NO: 18422 - RNA, 20 nt, Artificial Sequence
  targeting sequence with CTCN PAM
gggggcagcaugcugcgcaa

SEQ ID NO: 18423 - RNA, 20 nt, Artificial Sequence
  targeting sequence with CTCN PAM
uucacccccuugggcccuug

SEQ ID NO: 18424 - RNA, 20 nt, Artificial Sequence
  targeting sequence with CTCN PAM
agggcccaagggggugaaug

SEQ ID NO: 18425 - RNA, 20 nt, Artificial Sequence
  targeting sequence with CTCN PAM
uuggcaucugcggcuucuaa

SEQ ID NO: 18426 - RNA, 20 nt, Artificial Sequence
  targeting sequence with CTCN PAM
cggauggucacuugggagca

SEQ ID NO: 18427 - RNA, 20 nt, Artificial Sequence
  targeting sequence with CTCN PAM
caagugaccauccgcgaggc

SEQ ID NO: 18428 - RNA, 20 nt, Artificial Sequence
  targeting sequence with CTCN PAM
gucccugguuccuuuagucc

SEQ ID NO: 18429 - RNA, 20 nt, Artificial Sequence
  targeting sequence with CTCN PAM
cgccaaauuggccgcucugg

SEQ ID NO: 18430 - RNA, 20 nt, Artificial Sequence
  targeting sequence with CTCN PAM
ccaaauuggccgcucugggc

SEQ ID NO: 18431 - RNA, 20 nt, Artificial Sequence
  targeting sequence with CTCN PAM
gggccaggcacugaggacac

SEQ ID NO: 18432 - RNA, 20 nt, Artificial Sequence
  targeting sequence with CTCN PAM
gugccuggcccagagcggcc

SEQ ID NO: 18433 - RNA, 20 nt, Artificial Sequence
  targeting sequence with CTCN PAM
gggcccuguccggaagagga

SEQ ID NO: 18434 - RNA, 20 nt, Artificial Sequence
  targeting sequence with CTCN PAM
uccggacagggcccugagga

SEQ ID NO: 18435 - RNA, 20 nt, Artificial Sequence
  targeting sequence with CTCN PAM
aguccgcggcaaugaaugaa

SEQ ID NO: 18436 - RNA, 20 nt, Artificial Sequence
  targeting sequence with CTCN PAM
aggcugcccaguccucuucc

SEQ ID NO: 18437 - RNA, 20 nt, Artificial Sequence
  targeting sequence with CTCN PAM
ccaucugugcaauugaacau

SEQ ID NO: 18438 - RNA, 20 nt, Artificial Sequence
  targeting sequence with CTCN PAM
uucgccuccccaucugugca

SEQ ID NO: 18439 - RNA, 20 nt, Artificial Sequence
  targeting sequence with CTCN PAM
cuccuucgccuccccaucug

SEQ ID NO: 18440 - RNA, 20 nt, Artificial Sequence
  targeting sequence with CTCN PAM
cucccuccuucgccucccca

SEQ ID NO: 18441 - RNA, 20 nt, Artificial Sequence
  targeting sequence with CTCN PAM
cucccucccuccuucgccuc

SEQ ID NO: 18442 - RNA, 20 nt, Artificial Sequence
  targeting sequence with CTCN PAM
cucccucccucccuccuucg

SEQ ID NO: 18443 - RNA, 20 nt, Artificial Sequence
  targeting sequence with CTCN PAM
aaugaccgcccaagcgacug

SEQ ID NO: 18444 - RNA, 20 nt, Artificial Sequence
  targeting sequence with CTCN PAM
gggaggcuaugcgccggcaa

SEQ ID NO: 18445 - RNA, 20 nt, Artificial Sequence
  targeting sequence with CTCN PAM
cagagccuccaaugaccgcc

SEQ ID NO: 18446 - RNA, 20 nt, Artificial Sequence
  targeting sequence with CTCN PAM
accccgcugcuucuugccgg

SEQ ID NO: 18447 - RNA, 20 nt, Artificial Sequence
  targeting sequence with CTCN PAM
cgcagggcugccuccacccc

SEQ ID NO: 18448 - RNA, 20 nt, Artificial Sequence
  targeting sequence with CTCN PAM
ccgacucccgcagggcugcc

SEQ ID NO: 18449 - RNA, 20 nt, Artificial Sequence
  targeting sequence with CTCN PAM
gugguuuugaggccaguggc

SEQ ID NO: 18450 - RNA, 20 nt, Artificial Sequence
  targeting sequence with CTCN PAM
aaaccaccgagcacauccac

SEQ ID NO: 18451 - RNA, 20 nt, Artificial Sequence
  targeting sequence with CTCN PAM
agccacuggccucaaaacca

SEQ ID NO: 18452 - RNA, 20 nt, Artificial Sequence
  targeting sequence with CTCN PAM
cgccccuccagccacuggcc

SEQ ID NO: 18453 - RNA, 20 nt, Artificial Sequence
  targeting sequence with CTCN PAM
cacgccccuccagccacugg

SEQ ID NO: 18454 - RNA, 20 nt, Artificial Sequence
  targeting sequence with CTCN PAM
cacucucacgccccuccagc

SEQ ID NO: 18455 - RNA, 20 nt, Artificial Sequence
  targeting sequence with CTCN PAM
agucuggucucccacucuca

SEQ ID NO: 18456 - RNA, 20 nt, Artificial Sequence
  targeting sequence with CTCN PAM
ccucaagucuggucucccac

SEQ ID NO: 18457 - RNA, 20 nt, Artificial Sequence
  targeting sequence with CTCN PAM
agccacuccccucaagucug

SEQ ID NO: 18458 - RNA, 20 nt, Artificial Sequence
  targeting sequence with CTCN PAM
acuccagccacuccccucaa

SEQ ID NO: 18459 - RNA, 20 nt, Artificial Sequence
  targeting sequence with CTCN PAM
aauccaagaaggaaacggug

SEQ ID NO: 18460 - RNA, 20 nt, Artificial Sequence
  targeting sequence with CTCN PAM
guaggcaagugguccaagcc

SEQ ID NO: 18461 - RNA, 20 nt, Artificial Sequence
  targeting sequence with CTCN PAM
gggccucagcuucccagguu

SEQ ID NO: 18462 - RNA, 20 nt, Artificial Sequence
  targeting sequence with CTCN PAM
gcuucccagguuguagaaag

SEQ ID NO: 18463 - RNA, 20 nt, Artificial Sequence
  targeting sequence with CTCN PAM
aacccugaugcuuucuacaa

SEQ ID NO: 18464 - RNA, 20 nt, Artificial Sequence
  targeting sequence with CTCN PAM
gaaauucuggcuccucucaa

SEQ ID NO: 18465 - RNA, 20 nt, Artificial Sequence
  targeting sequence with CTCN PAM
ucucaagccaagauuaguau

SEQ ID NO: 18466 - RNA, 20 nt, Artificial Sequence
  targeting sequence with CTCN PAM
caagccaagauuaguaugac

SEQ ID NO: 18467 - RNA, 20 nt, Artificial Sequence
  targeting sequence with CTCN PAM
agccaagauuaguaugacuu

SEQ ID NO: 18468 - RNA, 20 nt, Artificial Sequence
  targeting sequence with CTCN PAM
gcgaaccgcugcaggcccau

SEQ ID NO: 18469 - RNA, 20 nt, Artificial Sequence
  targeting sequence with CTCN PAM
gccucugcgaaccgcugcag

SEQ ID NO: 18470 - RNA, 20 nt, Artificial Sequence
  targeting sequence with CTCN PAM
cgacguuccugccuacgccg

SEQ ID NO: 18471 - RNA, 20 nt, Artificial Sequence
  targeting sequence with CTCN PAM
cugccuggggucugggcucc

SEQ ID NO: 18472 - RNA, 20 nt, Artificial Sequence
  targeting sequence with CTCN PAM
guguccaagaccuuaaacuc

SEQ ID NO: 18473 - RNA, 20 nt, Artificial Sequence
  targeting sequence with CTCN PAM
ucgaagcagccacaaagcgg

SEQ ID NO: 18474 - RNA, 20 nt, Artificial Sequence
  targeting sequence with CTCN PAM
aagcagccacaaagcgguga

SEQ ID NO: 18475 - RNA, 20 nt, Artificial Sequence
  targeting sequence with CTCN PAM
gucaccgcuuuguggcugcu

SEQ ID NO: 18476 - RNA, 20 nt, Artificial Sequence
  targeting sequence with CTCN PAM
cggcuuuucuguuacuuuga

SEQ ID NO: 18477 - RNA, 20 nt, Artificial Sequence
  targeting sequence with CTCN PAM
gaacuauucucacggcuuuu

SEQ ID NO: 18478 - RNA, 20 nt, Artificial Sequence
  targeting sequence with CTCN PAM
cuuauuaaugcagauucacc

SEQ ID NO: 18479 - RNA, 20 nt, Artificial Sequence
  targeting sequence with CTCN PAM
ccagcccuugcauauucaag

SEQ ID NO: 18480 - RNA, 20 nt, Artificial Sequence
  targeting sequence with CTCN PAM
gaugcuugcaaugggggcuu

SEQ ID NO: 18481 - RNA, 20 nt, Artificial Sequence
  targeting sequence with CTCN PAM
ccgaugcuugcaaugggggc

SEQ ID NO: 18482 - RNA, 20 nt, Artificial Sequence
  targeting sequence with CTCN PAM
aauguguauugcccaagaac

SEQ ID NO: 18483 - RNA, 20 nt, Artificial Sequence
  targeting sequence with CTCN PAM
aucuugaaaaccacuggggu

SEQ ID NO: 18484 - RNA, 20 nt, Artificial Sequence
  targeting sequence with CTCN PAM
aauaucaccaaaugucgcaa

SEQ ID NO: 18485 - RNA, 20 nt, Artificial Sequence
  targeting sequence with CTCN PAM
uugcgacauuuggugauauu

SEQ ID NO: 18486 - RNA, 20 nt, Artificial Sequence
  targeting sequence with CTCN PAM
uggauggggaugggaagggg

SEQ ID NO: 18487 - RNA, 20 nt, Artificial Sequence
  targeting sequence with CTCN PAM
ucuuaaauaauaauaauuaa

SEQ ID NO: 18488 - RNA, 20 nt, Artificial Sequence
  targeting sequence with CTCN PAM
cucugucgcccaggcuggag

SEQ ID NO: 18489 - RNA, 20 nt, Artificial Sequence
  targeting sequence with CTCN PAM
gucgcccaggcuggagugca

SEQ ID NO: 18490 - RNA, 20 nt, Artificial Sequence
  targeting sequence with CTCN PAM
agccugggcgacagagcgag

SEQ ID NO: 18491 - RNA, 20 nt, Artificial Sequence
  targeting sequence with CTCN PAM
gcucacugcaagcuccgccu

SEQ ID NO: 18492 - RNA, 20 nt, Artificial Sequence
  targeting sequence with CTCN PAM
cugcaagcuccgccucccgg

SEQ ID NO: 18493 - RNA, 20 nt, Artificial Sequence
  targeting sequence with CTCN PAM
gccucccggguucacgccau

SEQ ID NO: 18494 - RNA, 20 nt, Artificial Sequence
  targeting sequence with CTCN PAM
cggguucacgccauucuccu

SEQ ID NO: 18495 - RNA, 20 nt, Artificial Sequence
  targeting sequence with CTCN PAM
ugccucagccucccgaguag

SEQ ID NO: 18496 - RNA, 20 nt, Artificial Sequence
  targeting sequence with CTCN PAM
gccucccgaguagcugggac

SEQ ID NO: 18497 - RNA, 20 nt, Artificial Sequence
  targeting sequence with CTCN PAM
cgaguagcugggacuacagg

SEQ ID NO: 18498 - RNA, 20 nt, Artificial Sequence
  targeting sequence with CTCN PAM
ggaggcugaggcaggagaau

SEQ ID NO: 18499 - RNA, 20 nt, Artificial Sequence
  targeting sequence with CTCN PAM
acuaaaaauacaaaaaauua

SEQ ID NO: 18500 - RNA, 20 nt, Artificial Sequence
  targeting sequence with CTCN PAM
aucuccugaccucgugaucc

SEQ ID NO: 18501 - RNA, 20 nt, Artificial Sequence
  targeting sequence with CTCN PAM
ugaccucgugauccgcccgc

SEQ ID NO: 18502 - RNA, 20 nt, Artificial Sequence
  targeting sequence with CTCN PAM
ugauccgcccgccucggccu

SEQ ID NO: 18503 - RNA, 20 nt, Artificial Sequence
  targeting sequence with CTCN PAM
gccucccaaagugcugggau

SEQ ID NO: 18504 - RNA, 20 nt, Artificial Sequence
  targeting sequence with CTCN PAM
caaagugcugggauuacagg

SEQ ID NO: 18505 - RNA, 20 nt, Artificial Sequence
  targeting sequence with CTCN PAM
cgccuguaaucccagcacuu

SEQ ID NO: 18506 - RNA, 20 nt, Artificial Sequence
  targeting sequence with CTCN PAM
aaacaaacaaacgaaauaaa

SEQ ID NO: 18507 - RNA, 20 nt, Artificial Sequence
  targeting sequence with CTCN PAM
agccuggaugacacagcaag

SEQ ID NO: 18508 - RNA, 20 nt, Artificial Sequence
  targeting sequence with CTCN PAM
cugcagccuugaauuuuugg

SEQ ID NO: 18509 - RNA, 20 nt, Artificial Sequence
  targeting sequence with CTCN PAM
agggauccucuccccucagu

SEQ ID NO: 18510 - RNA, 20 nt, Artificial Sequence
  targeting sequence with CTCN PAM
ccccucagucugcagaguag

SEQ ID NO: 18511 - RNA, 20 nt, Artificial Sequence
  targeting sequence with CTCN PAM
ccucagucugcagaguagcu

SEQ ID NO: 18512 - RNA, 20 nt, Artificial Sequence
  targeting sequence with CTCN PAM
gucugcagaguagcugggac

SEQ ID NO: 18513 - RNA, 20 nt, Artificial Sequence
  targeting sequence with CTCN PAM
gcagacugaggggagaggau

SEQ ID NO: 18514 - RNA, 20 nt, Artificial Sequence
  targeting sequence with CTCN PAM
ccaaaaggcaccaacuccuu

SEQ ID NO: 18515 - RNA, 20 nt, Artificial Sequence
  targeting sequence with CTCN PAM
uugagaaggcagcuuugggg

SEQ ID NO: 18516 - RNA, 20 nt, Artificial Sequence
  targeting sequence with CTCN PAM
aggaguuggugccuuuuggg

SEQ ID NO: 18517 - RNA, 20 nt, Artificial Sequence
  targeting sequence with CTCN PAM
ccauccugagacagacaaaa

SEQ ID NO: 18518 - RNA, 20 nt, Artificial Sequence
  targeting sequence with CTCN PAM
ggauggggaguauguucccc

SEQ ID NO: 18519 - RNA, 20 nt, Artificial Sequence
  targeting sequence with CTCN PAM
auuaguugacaaguugguug

SEQ ID NO: 18520 - RNA, 20 nt, Artificial Sequence
  targeting sequence with CTCN PAM
acuuuugccuguguuuacau

SEQ ID NO: 18521 - RNA, 20 nt, Artificial Sequence
  targeting sequence with CTCN PAM
aguacucccuccuuucccuu

SEQ ID NO: 18522 - RNA, 20 nt, Artificial Sequence
  targeting sequence with CTCN PAM
cuccuuucccuuugcuuauu

SEQ ID NO: 18523 - RNA, 20 nt, Artificial Sequence
  targeting sequence with CTCN PAM
uuucccuuugcuuauuuaug

SEQ ID NO: 18524 - RNA, 20 nt, Artificial Sequence
  targeting sequence with CTCN PAM
gugcuuaccucuauaaaaau

SEQ ID NO: 18525 - RNA, 20 nt, Artificial Sequence
  targeting sequence with CTCN PAM
auaaaaaugagaaauuggaa

SEQ ID NO: 18526 - RNA, 20 nt, Artificial Sequence
  targeting sequence with CTCN PAM
uuuuuauagagguaagcacu

SEQ ID NO: 18527 - RNA, 20 nt, Artificial Sequence
  targeting sequence with CTCN PAM
uccaauuucucauuuuuaua

SEQ ID NO: 18528 - RNA, 20 nt, Artificial Sequence
  targeting sequence with CTCN PAM
aguagcugggacuucagaca

SEQ ID NO: 18529 - RNA, 20 nt, Artificial Sequence
  targeting sequence with CTCN PAM
ccaguagcugggacuucaga

SEQ ID NO: 18530 - RNA, 20 nt, Artificial Sequence
  targeting sequence with CTCN PAM
gccucuccaguagcugggac

SEQ ID NO: 18531 - RNA, 20 nt, Artificial Sequence
  targeting sequence with CTCN PAM
ugccucagccucuccaguag

SEQ ID NO: 18532 - RNA, 20 nt, Artificial Sequence
  targeting sequence with CTCN PAM
agugauccuccugccucagc

SEQ ID NO: 18533 - RNA, 20 nt, Artificial Sequence
  targeting sequence with CTCN PAM
cagucucaagugauccuccu

SEQ ID NO: 18534 - RNA, 20 nt, Artificial Sequence
  targeting sequence with CTCN PAM
cugcauccuugaccucccag

SEQ ID NO: 18535 - RNA, 20 nt, Artificial Sequence
  targeting sequence with CTCN PAM
uaaaaaaaauucugguaagu

SEQ ID NO: 18536 - RNA, 20 nt, Artificial Sequence
  targeting sequence with CTCN PAM
cugucacccaggcuggggug

SEQ ID NO: 18537 - RNA, 20 nt, Artificial Sequence
  targeting sequence with CTCN PAM
aaccccuggccucaaacuau

SEQ ID NO: 18538 - RNA, 20 nt, Artificial Sequence
  targeting sequence with CTCN PAM
aacuauccucccaugucaca

SEQ ID NO: 18539 - RNA, 20 nt, Artificial Sequence
  targeting sequence with CTCN PAM
ugccugaaaguaucuuauug

SEQ ID NO: 18540 - RNA, 20 nt, Artificial Sequence
  targeting sequence with CTCN PAM
aaguuugugggggcagugga

SEQ ID NO: 18541 - RNA, 20 nt, Artificial Sequence
  targeting sequence with CTCN PAM
uauucaauuccacugccccc

SEQ ID NO: 18542 - RNA, 20 nt, Artificial Sequence
  targeting sequence with CTCN PAM
uagaaacucguauucaauuc

SEQ ID NO: 18543 - RNA, 20 nt, Artificial Sequence
  targeting sequence with CTCN PAM
guggcucacgccuguaaucc

SEQ ID NO: 18544 - RNA, 20 nt, Artificial Sequence
  targeting sequence with CTCN PAM
caaagugcugggauuacagg

SEQ ID NO: 18545 - RNA, 20 nt, Artificial Sequence
  targeting sequence with CTCN PAM
gccucccaaagugcugggau

SEQ ID NO: 18546 - RNA, 20 nt, Artificial Sequence
  targeting sequence with CTCN PAM
ucagccucccaaagugcugg

SEQ ID NO: 18547 - RNA, 20 nt, Artificial Sequence
  targeting sequence with CTCN PAM
ggugauccacccuccucagc

SEQ ID NO: 18548 - RNA, 20 nt, Artificial Sequence
  targeting sequence with CTCN PAM
ugaccucaggugauccaccc

SEQ ID NO: 18549 - RNA, 20 nt, Artificial Sequence
  targeting sequence with CTCN PAM
aacuccugaccucaggugau

SEQ ID NO: 18550 - RNA, 20 nt, Artificial Sequence
  targeting sequence with CTCN PAM
acuaacaauacaaaaaauua

SEQ ID NO: 18551 - RNA, 20 nt, Artificial Sequence
  targeting sequence with CTCN PAM
cgcccguaagcacuuuggga

SEQ ID NO: 18552 - RNA, 20 nt, Artificial Sequence
  targeting sequence with CTCN PAM
caaagugcuuacgggcguga

SEQ ID NO: 18553 - RNA, 20 nt, Artificial Sequence
  targeting sequence with CTCN PAM
ucccaaagugcuuacgggcg

SEQ ID NO: 18554 - RNA, 20 nt, Artificial Sequence
  targeting sequence with CTCN PAM
ugccuuggcuuacuccuccc

SEQ ID NO: 18555 - RNA, 20 nt, Artificial Sequence
  targeting sequence with CTCN PAM
aaugauccuccugccuuggc

SEQ ID NO: 18556 - RNA, 20 nt, Artificial Sequence
  targeting sequence with CTCN PAM
accaacaaagaagaaauuag

SEQ ID NO: 18557 - RNA, 20 nt, Artificial Sequence
  targeting sequence with CTCN PAM
agccugggagauagagugag

SEQ ID NO: 18558 - RNA, 20 nt, Artificial Sequence
  targeting sequence with CTCN PAM
caggcuggagugcaacggca

SEQ ID NO: 18559 - RNA, 20 nt, Artificial Sequence
  targeting sequence with CTCN PAM
aucucccaggcuggagugca

SEQ ID NO: 18560 - RNA, 20 nt, Artificial Sequence
  targeting sequence with CTCN PAM
cucuaucucccaggcuggag

SEQ ID NO: 18561 - RNA, 20 nt, Artificial Sequence
  targeting sequence with CTCN PAM
aaaaugaauaaauaaauaag

SEQ ID NO: 18562 - RNA, 20 nt, Artificial Sequence
  targeting sequence with CTCN PAM
agcagacuccaguuccucua

SEQ ID NO: 18563 - RNA, 20 nt, Artificial Sequence
  targeting sequence with CTCN PAM
aguuccucuagguaccuguu

SEQ ID NO: 18564 - RNA, 20 nt, Artificial Sequence
  targeting sequence with CTCN PAM
agguaccuguucuauuuuuu

SEQ ID NO: 18565 - RNA, 20 nt, Artificial Sequence
  targeting sequence with CTCN PAM
aagaaaaaaaaaauagaaca

SEQ ID NO: 18566 - RNA, 20 nt, Artificial Sequence
  targeting sequence with CTCN PAM
ugcaucaggagaggacaggg

SEQ ID NO: 18567 - RNA, 20 nt, Artificial Sequence
  targeting sequence with CTCN PAM
ugaugcaugagauuauuuua

SEQ ID NO: 18568 - RNA, 20 nt, Artificial Sequence
  targeting sequence with CTCN PAM
ccugaugcaugagauuauuu

SEQ ID NO: 18569 - RNA, 20 nt, Artificial Sequence
  targeting sequence with CTCN PAM
auggucuguggcuggggagg

SEQ ID NO: 18570 - RNA, 20 nt, Artificial Sequence
  targeting sequence with CTCN PAM
ccagccacagaccauagagg

SEQ ID NO: 18571 - RNA, 20 nt, Artificial Sequence
  targeting sequence with CTCN PAM
gcucagggcuggagggcucu

SEQ ID NO: 18572 - RNA, 20 nt, Artificial Sequence
  targeting sequence with CTCN PAM
gggcuggagggcucuguggg

SEQ ID NO: 18573 - RNA, 20 nt, Artificial Sequence
  targeting sequence with CTCN PAM
agcccugagcggagcccacc

SEQ ID NO: 18574 - RNA, 20 nt, Artificial Sequence
  targeting sequence with CTCN PAM
gugggcuaugggggcagagg

SEQ ID NO: 18575 - RNA, 20 nt, Artificial Sequence
  targeting sequence with CTCN PAM
gcccccauagcccacagagc

SEQ ID NO: 18576 - RNA, 20 nt, Artificial Sequence
  targeting sequence with CTCN PAM
aggccccugcugaacagccc

SEQ ID NO: 18577 - RNA, 20 nt, Artificial Sequence
  targeting sequence with CTCN PAM
agcacagacaccgcucacgg

SEQ ID NO: 18578 - RNA, 20 nt, Artificial Sequence
  targeting sequence with CTCN PAM
cggcccugccgagagaggcu

SEQ ID NO: 18579 - RNA, 20 nt, Artificial Sequence
  targeting sequence with CTCN PAM
gcagggccgugagcgguguc

SEQ ID NO: 18580 - RNA, 20 nt, Artificial Sequence
  targeting sequence with CTCN PAM
cggcagggccgugagcggug

SEQ ID NO: 18581 - RNA, 20 nt, Artificial Sequence
  targeting sequence with CTCN PAM
ccaggcagccugggccuccu

SEQ ID NO: 18582 - RNA, 20 nt, Artificial Sequence
  targeting sequence with CTCN PAM
gcagggccuugggcuuugac

SEQ ID NO: 18583 - RNA, 20 nt, Artificial Sequence
  targeting sequence with CTCN PAM
uuccccuggucaaagcccaa

SEQ ID NO: 18584 - RNA, 20 nt, Artificial Sequence
  targeting sequence with CTCN PAM
ugagcucugcauucaacugc

SEQ ID NO: 18585 - RNA, 20 nt, Artificial Sequence
  targeting sequence with CTCN PAM
ggagccaugguuggggccaa

SEQ ID NO: 18586 - RNA, 20 nt, Artificial Sequence
  targeting sequence with CTCN PAM
gcauucaacugcugccccac

SEQ ID NO: 18587 - RNA, 20 nt, Artificial Sequence
  targeting sequence with CTCN PAM
ggggcugggcuucccuccuc

SEQ ID NO: 18588 - RNA, 20 nt, Artificial Sequence
  targeting sequence with CTCN PAM
ccauggagcgggugcgaagu

SEQ ID NO: 18589 - RNA, 20 nt, Artificial Sequence
  targeting sequence with CTCN PAM
auggugagcugugcugugug

SEQ ID NO: 18590 - RNA, 20 nt, Artificial Sequence
  targeting sequence with CTCN PAM
uuaaugcagcuaaaaaauug

SEQ ID NO: 18591 - RNA, 20 nt, Artificial Sequence
  targeting sequence with CTCN PAM
ggcaauccacuucacuucug

SEQ ID NO: 18592 - RNA, 20 nt, Artificial Sequence
  targeting sequence with CTCN PAM
agaauaccugcucugcccac

SEQ ID NO: 18593 - RNA, 20 nt, Artificial Sequence
  targeting sequence with CTCN PAM
gcccacuucggguaugccuc

SEQ ID NO: 18594 - RNA, 20 nt, Artificial Sequence
  targeting sequence with CTCN PAM
acucuggccucugugucugg

SEQ ID NO: 18595 - RNA, 20 nt, Artificial Sequence
  targeting sequence with CTCN PAM
ggccucugugucugggcuuu

SEQ ID NO: 18596 - RNA, 20 nt, Artificial Sequence
  targeting sequence with CTCN PAM
gugucugggcuuugccugcc

SEQ ID NO: 18597 - RNA, 20 nt, Artificial Sequence
  targeting sequence with CTCN PAM
cuugugacuucaugcucagg

SEQ ID NO: 18598 - RNA, 20 nt, Artificial Sequence
  targeting sequence with CTCN PAM
ggucuauccagacugugcuc

SEQ ID NO: 18599 - RNA, 20 nt, Artificial Sequence
  targeting sequence with CTCN PAM
agggauggacacgugaucua

SEQ ID NO: 18600 - RNA, 20 nt, Artificial Sequence
  targeting sequence with CTCN PAM
ggcucaagggauggacacgu

SEQ ID NO: 18601 - RNA, 20 nt, Artificial Sequence
  targeting sequence with CTCN PAM
aucucuugaccucgugaucc

SEQ ID NO: 18602 - RNA, 20 nt, Artificial Sequence
  targeting sequence with CTCN PAM
ugaccucgugauccgccugc

SEQ ID NO: 18603 - RNA, 20 nt, Artificial Sequence
  targeting sequence with CTCN PAM
ugauccgccugccucggccu

SEQ ID NO: 18604 - RNA, 20 nt, Artificial Sequence
  targeting sequence with CTCN PAM
gccucccaaagugcugggau

SEQ ID NO: 18605 - RNA, 20 nt, Artificial Sequence
  targeting sequence with CTCN PAM
caaagugcugggauuacagg

SEQ ID NO: 18606 - RNA, 20 nt, Artificial Sequence
  targeting sequence with CTCN PAM
cgccuguaaucccagcacuu

SEQ ID NO: 18607 - RNA, 20 nt, Artificial Sequence
  targeting sequence with CTCN PAM
gaguugccuacacccuuuuu

SEQ ID NO: 18608 - RNA, 20 nt, Artificial Sequence
  targeting sequence with CTCN PAM
gaguucaguucuuuuaaaaa

SEQ ID NO: 18609 - RNA, 20 nt, Artificial Sequence
  targeting sequence with CTCN PAM
ucacaguuuuuugauaagug

SEQ ID NO: 18610 - RNA, 20 nt, Artificial Sequence
  targeting sequence with CTCN PAM
acuuacaggaucaauaggca

SEQ ID NO: 18611 - RNA, 20 nt, Artificial Sequence
  targeting sequence with CTCN PAM
aacacccaacugauugggau

SEQ ID NO: 18612 - RNA, 20 nt, Artificial Sequence
  targeting sequence with CTCN PAM
aagggcuguaauuaaacaga

SEQ ID NO: 18613 - RNA, 20 nt, Artificial Sequence
  targeting sequence with CTCN PAM
uguagucacaagguaaaccu

SEQ ID NO: 18614 - RNA, 20 nt, Artificial Sequence
  targeting sequence with CTCN PAM
cacauucuuucaggcacccu

SEQ ID NO: 18615 - RNA, 20 nt, Artificial Sequence
  targeting sequence with CTCN PAM
uuauccauugcuugaacugc

SEQ ID NO: 18616 - RNA, 20 nt, Artificial Sequence
  targeting sequence with CTCN PAM
ccuaggccguuuucaccucu

SEQ ID NO: 18617 - RNA, 20 nt, Artificial Sequence
  targeting sequence with CTCN PAM
gugguuuugcuaauaccucc

SEQ ID NO: 18618 - RNA, 20 nt, Artificial Sequence
  targeting sequence with CTCN PAM
aauagaaaugcccccucacc

SEQ ID NO: 18619 - RNA, 20 nt, Artificial Sequence
  targeting sequence with CTCN PAM
ccuauuucugcucaucauaa

SEQ ID NO: 18620 - RNA, 20 nt, Artificial Sequence
  targeting sequence with CTCN PAM
ucauaaagccaccaucuuuc

SEQ ID NO: 18621 - RNA, 20 nt, Artificial Sequence
  targeting sequence with CTCN PAM
uccguugagccuuucccuau

SEQ ID NO: 18622 - RNA, 20 nt, Artificial Sequence
  targeting sequence with CTCN PAM
guugagccuuucccuauugc

SEQ ID NO: 18623 - RNA, 20 nt, Artificial Sequence
  targeting sequence with CTCN PAM
acggaggaggccaugguauc

SEQ ID NO: 18624 - RNA, 20 nt, Artificial Sequence
  targeting sequence with CTCN PAM
guuagaauugcuuccuccuc

SEQ ID NO: 18625 - RNA, 20 nt, Artificial Sequence
  targeting sequence with CTCN PAM
ucuuugcucccacacgucuu

SEQ ID NO: 18626 - RNA, 20 nt, Artificial Sequence
  targeting sequence with CTCN PAM
uugcucccacacgucuucug

SEQ ID NO: 18627 - RNA, 20 nt, Artificial Sequence
  targeting sequence with CTCN PAM
cacacgucuucugccucuuu

SEQ ID NO: 18628 - RNA, 20 nt, Artificial Sequence
  targeting sequence with CTCN PAM
uuaccacauguauuucauuc

SEQ ID NO: 18629 - RNA, 20 nt, Artificial Sequence
  targeting sequence with CTCN PAM
auacaagacugggcugugga

SEQ ID NO: 18630 - RNA, 20 nt, Artificial Sequence
  targeting sequence with CTCN PAM
uaagugcugcuggcuaaaua

SEQ ID NO: 18631 - RNA, 20 nt, Artificial Sequence
  targeting sequence with CTCN PAM
uauuuagccagcagcacuua

SEQ ID NO: 18632 - RNA, 20 nt, Artificial Sequence
  targeting sequence with CTCN PAM
gcacgugcuccuccuucuca

SEQ ID NO: 18633 - RNA, 20 nt, Artificial Sequence
  targeting sequence with CTCN PAM
uccuucucagcccgcagggc

SEQ ID NO: 18634 - RNA, 20 nt, Artificial Sequence
  targeting sequence with CTCN PAM
uucucagcccgcagggcuuc

SEQ ID NO: 18635 - RNA, 20 nt, Artificial Sequence
  targeting sequence with CTCN PAM
gcccgcagggcuucuggcag

SEQ ID NO: 18636 - RNA, 20 nt, Artificial Sequence
  targeting sequence with CTCN PAM
agggguggcccaaacuuggu

SEQ ID NO: 18637 - RNA, 20 nt, Artificial Sequence
  targeting sequence with CTCN PAM
agaccaaguuugggccaccc

SEQ ID NO: 18638 - RNA, 20 nt, Artificial Sequence
  targeting sequence with CTCN PAM
aaggcaaucuggaggcaaaa

SEQ ID NO: 18639 - RNA, 20 nt, Artificial Sequence
  targeting sequence with CTCN PAM
agauugccuuagagggggcu

SEQ ID NO: 18640 - RNA, 20 nt, Artificial Sequence
  targeting sequence with CTCN PAM
cuggaccuauuuuuaaguuu

SEQ ID NO: 18641 - RNA, 20 nt, Artificial Sequence
  targeting sequence with CTCN PAM
uugaagaaaauguauuugug

SEQ ID NO: 18642 - RNA, 20 nt, Artificial Sequence
  targeting sequence with CTCN PAM
cucucccuucccaaaauaac

SEQ ID NO: 18643 - RNA, 20 nt, Artificial Sequence
  targeting sequence with CTCN PAM
cccuucccaaaauaacggga

SEQ ID NO: 18644 - RNA, 20 nt, Artificial Sequence
  targeting sequence with CTCN PAM
cuucccaaaauaacgggaaa

SEQ ID NO: 18645 - RNA, 20 nt, Artificial Sequence
  targeting sequence with CTCN PAM
acauaaaugggagacaauau

SEQ ID NO: 18646 - RNA, 20 nt, Artificial Sequence
  targeting sequence with CTCN PAM
cauuuauguugagaauaugu

SEQ ID NO: 18647 - RNA, 20 nt, Artificial Sequence
  targeting sequence with CTCN PAM
uguauaaucagugcauuaag

SEQ ID NO: 18648 - RNA, 20 nt, Artificial Sequence
  targeting sequence with CTCN PAM
aaaaaaaaaaaagaaaagaa

SEQ ID NO: 18649 - RNA, 20 nt, Artificial Sequence
  targeting sequence with CTCN PAM
gucucaaaaaaaaaaaaaga

SEQ ID NO: 18650 - RNA, 20 nt, Artificial Sequence
  targeting sequence with CTCN PAM
cucugucgcccuggcugcug

SEQ ID NO: 18651 - RNA, 20 nt, Artificial Sequence
  targeting sequence with CTCN PAM
gucgcccuggcugcuggagu

SEQ ID NO: 18652 - RNA, 20 nt, Artificial Sequence
  targeting sequence with CTCN PAM
agcagccagggcgacagagc

SEQ ID NO: 18653 - RNA, 20 nt, Artificial Sequence
  targeting sequence with CTCN PAM
gcucacugcaagcuccgcuu

SEQ ID NO: 18654 - RNA, 20 nt, Artificial Sequence
  targeting sequence with CTCN PAM
cugcaagcuccgcuuccugg

SEQ ID NO: 18655 - RNA, 20 nt, Artificial Sequence
  targeting sequence with CTCN PAM
gcuuccuggguucacgccau

SEQ ID NO: 18656 - RNA, 20 nt, Artificial Sequence
  targeting sequence with CTCN PAM
ugccucagccucccgaguag

SEQ ID NO: 18657 - RNA, 20 nt, Artificial Sequence
  targeting sequence with CTCN PAM
gccucccgaguagcugggac

SEQ ID NO: 18658 - RNA, 20 nt, Artificial Sequence
  targeting sequence with CTCN PAM
cgaguagcugggacuacagg

SEQ ID NO: 18659 - RNA, 20 nt, Artificial Sequence
  targeting sequence with CTCN PAM
ggaggcugaggcaggagaau

SEQ ID NO: 18660 - RNA, 20 nt, Artificial Sequence
  targeting sequence with CTCN PAM
ucauuggaacucucucagaa

SEQ ID NO: 18661 - RNA, 20 nt, Artificial Sequence
  targeting sequence with CTCN PAM
uuggaacucucucagaacuc

SEQ ID NO: 18662 - RNA, 20 nt, Artificial Sequence
  targeting sequence with CTCN PAM
cucagaacucagcauuuuca

SEQ ID NO: 18663 - RNA, 20 nt, Artificial Sequence
  targeting sequence with CTCN PAM
cagaacucagcauuuucauc

SEQ ID NO: 18664 - RNA, 20 nt, Artificial Sequence
  targeting sequence with CTCN PAM
gaacucagcauuuucaucug

SEQ ID NO: 18665 - RNA, 20 nt, Artificial Sequence
  targeting sequence with CTCN PAM
gcauuuucaucugacuguac

SEQ ID NO: 18666 - RNA, 20 nt, Artificial Sequence
  targeting sequence with CTCN PAM
aaggaacaugaaaucagaaa

SEQ ID NO: 18667 - RNA, 20 nt, Artificial Sequence
  targeting sequence with CTCN PAM
uuauuuggacauggcuagug

SEQ ID NO: 18668 - RNA, 20 nt, Artificial Sequence
  targeting sequence with CTCN PAM
cuagccauguccaaauaaug

SEQ ID NO: 18669 - RNA, 20 nt, Artificial Sequence
  targeting sequence with CTCN PAM
cucccaauauuugucuuggc

SEQ ID NO: 18670 - RNA, 20 nt, Artificial Sequence
  targeting sequence with CTCN PAM
caauauuugucuuggcauca

SEQ ID NO: 18671 - RNA, 20 nt, Artificial Sequence
  targeting sequence with CTCN PAM
auucagaacaggggagagag

SEQ ID NO: 18672 - RNA, 20 nt, Artificial Sequence
  targeting sequence with CTCN PAM
ccuguucugaauggaguaaa

SEQ ID NO: 18673 - RNA, 20 nt, Artificial Sequence
  targeting sequence with CTCN PAM
ccccuguucugaauggagua

SEQ ID NO: 18674 - RNA, 20 nt, Artificial Sequence
  targeting sequence with CTCN PAM
cuccccuguucugaauggag

SEQ ID NO: 18675 - RNA, 20 nt, Artificial Sequence
  targeting sequence with CTCN PAM
uuaagaagcaaaaguagguu

SEQ ID NO: 18676 - RNA, 20 nt, Artificial Sequence
  targeting sequence with CTCN PAM
acuggcuccuuaagaagcaa

SEQ ID NO: 18677 - RNA, 20 nt, Artificial Sequence
  targeting sequence with CTCN PAM
guauguccuaguaaggaagg

SEQ ID NO: 18678 - RNA, 20 nt, Artificial Sequence
  targeting sequence with CTCN PAM
aauuuccauuccuugguaua

SEQ ID NO: 18679 - RNA, 20 nt, Artificial Sequence
  targeting sequence with CTCN PAM
cccaggcuagaggcauggac

SEQ ID NO: 18680 - RNA, 20 nt, Artificial Sequence
  targeting sequence with CTCN PAM
agccugggugagugaagcug

SEQ ID NO: 18681 - RNA, 20 nt, Artificial Sequence
  targeting sequence with CTCN PAM
aaaaaaaaaagaaaagaaaa

SEQ ID NO: 18682 - RNA, 20 nt, Artificial Sequence
  targeting sequence with CTCN PAM
ucuaaaaaaaaaagaaaaga

SEQ ID NO: 18683 - RNA, 20 nt, Artificial Sequence
  targeting sequence with CTCN PAM
uuugaaugcuccucuaaaaa

SEQ ID NO: 18684 - RNA, 20 nt, Artificial Sequence
  targeting sequence with CTCN PAM
aauggcuuaacaguuguucu

SEQ ID NO: 18685 - RNA, 20 nt, Artificial Sequence
  targeting sequence with CTCN PAM
cucuaauggcuuaacaguug

SEQ ID NO: 18686 - RNA, 20 nt, Artificial Sequence
  targeting sequence with CTCN PAM
ucuauaaccucgcucuaaug

SEQ ID NO: 18687 - RNA, 20 nt, Artificial Sequence
  targeting sequence with CTCN PAM
gacaagacaaaagaacccaa

SEQ ID NO: 18688 - RNA, 20 nt, Artificial Sequence
  targeting sequence with CTCN PAM
aaaguaacaggaugggcagc

SEQ ID NO: 18689 - RNA, 20 nt, Artificial Sequence
  targeting sequence with CTCN PAM
aacugucuuaggaaggaccu

SEQ ID NO: 18690 - RNA, 20 nt, Artificial Sequence
  targeting sequence with CTCN PAM
agccaaauagucccaugcug

SEQ ID NO: 18691 - RNA, 20 nt, Artificial Sequence
  targeting sequence with CTCN PAM
aagguucuagcuuagaaaaa

SEQ ID NO: 18692 - RNA, 20 nt, Artificial Sequence
  targeting sequence with CTCN PAM
cuacucugagcaauuacgcu

SEQ ID NO: 18693 - RNA, 20 nt, Artificial Sequence
  targeting sequence with CTCN PAM
acucugagcaauuacgcuaa

SEQ ID NO: 18694 - RNA, 20 nt, Artificial Sequence
  targeting sequence with CTCN PAM
gagcaauuacgcuaaagcag

SEQ ID NO: 18695 - RNA, 20 nt, Artificial Sequence
  targeting sequence with CTCN PAM
gaguagagagcccccacaaa

SEQ ID NO: 18696 - RNA, 20 nt, Artificial Sequence
  targeting sequence with CTCN PAM
uaacuuucugcuuuagcgua

SEQ ID NO: 18697 - RNA, 20 nt, Artificial Sequence
  targeting sequence with CTCN PAM
ugccuaaaaagucacugcaa

SEQ ID NO: 18698 - RNA, 20 nt, Artificial Sequence
  targeting sequence with CTCN PAM
gggugcaguuuugagggggc

SEQ ID NO: 18699 - RNA, 20 nt, Artificial Sequence
  targeting sequence with CTCN PAM
aaacugcacccagagcaggg

SEQ ID NO: 18700 - RNA, 20 nt, Artificial Sequence
  targeting sequence with CTCN PAM
guugcccccucaaaacugca

SEQ ID NO: 18701 - RNA, 20 nt, Artificial Sequence
  targeting sequence with CTCN PAM
gcugauuguaguacaccugc

SEQ ID NO: 18702 - RNA, 20 nt, Artificial Sequence
  targeting sequence with CTCN PAM
agucuucaccccaaccucag

SEQ ID NO: 18703 - RNA, 20 nt, Artificial Sequence
  targeting sequence with CTCN PAM
gguacuccagucuucacccc

SEQ ID NO: 18704 - RNA, 20 nt, Artificial Sequence
  targeting sequence with CTCN PAM
gagaaauccagcuugccaaa

SEQ ID NO: 18705 - RNA, 20 nt, Artificial Sequence
  targeting sequence with CTCN PAM
gagccagcauguuguuucca

SEQ ID NO: 18706 - RNA, 20 nt, Artificial Sequence
  targeting sequence with CTCN PAM
uuuugcuuuggcaagcugga

SEQ ID NO: 18707 - RNA, 20 nt, Artificial Sequence
  targeting sequence with CTCN PAM
uuucagggcaucuuauaugc

SEQ ID NO: 18708 - RNA, 20 nt, Artificial Sequence
  targeting sequence with CTCN PAM
uucugugcaaccaagugcau

SEQ ID NO: 18709 - RNA, 20 nt, Artificial Sequence
  targeting sequence with CTCN PAM
uagccucauucugugcaacc

SEQ ID NO: 18710 - RNA, 20 nt, Artificial Sequence
  targeting sequence with CTCN PAM
cuagauaaacucuaaauguu

SEQ ID NO: 18711 - RNA, 20 nt, Artificial Sequence
  targeting sequence with CTCN PAM
agauaaacucuaaauguuca

SEQ ID NO: 18712 - RNA, 20 nt, Artificial Sequence
  targeting sequence with CTCN PAM
aaauguucaaguuccaccag

SEQ ID NO: 18713 - RNA, 20 nt, Artificial Sequence
  targeting sequence with CTCN PAM
guucauuuuucaaaaccauc

SEQ ID NO: 18714 - RNA, 20 nt, Artificial Sequence
  targeting sequence with CTCN PAM
guggacuucuauagaugguu

SEQ ID NO: 18715 - RNA, 20 nt, Artificial Sequence
  targeting sequence with CTCN PAM
uuaggagaaucaccuuuggu

SEQ ID NO: 18716 - RNA, 20 nt, Artificial Sequence
  targeting sequence with CTCN PAM
uaaagagcagugaaggaaau

SEQ ID NO: 18717 - RNA, 20 nt, Artificial Sequence
  targeting sequence with CTCN PAM
uaggcagacagaauaaagcu

SEQ ID NO: 18718 - RNA, 20 nt, Artificial Sequence
  targeting sequence with CTCN PAM
acaucaucacuuugguugua

SEQ ID NO: 18719 - RNA, 20 nt, Artificial Sequence
  targeting sequence with CTCN PAM
uauagucucaacuuuuccua

SEQ ID NO: 18720 - RNA, 20 nt, Artificial Sequence
  targeting sequence with CTCN PAM
acuuuuccuaaagacaaccc

SEQ ID NO: 18721 - RNA, 20 nt, Artificial Sequence
  targeting sequence with CTCN PAM
ugcucuccuugcacaacccu

SEQ ID NO: 18722 - RNA, 20 nt, Artificial Sequence
  targeting sequence with CTCN PAM
ccuugcacaacccuuuccuc

SEQ ID NO: 18723 - RNA, 20 nt, Artificial Sequence
  targeting sequence with CTCN PAM
uugcacaacccuuuccucuu

SEQ ID NO: 18724 - RNA, 20 nt, Artificial Sequence
  targeting sequence with CTCN PAM
ucaacuaagccaaacccaua

SEQ ID NO: 18725 - RNA, 20 nt, Artificial Sequence
  targeting sequence with CTCN PAM
ggcugcugcugcugcuuuuu

SEQ ID NO: 18726 - RNA, 20 nt, Artificial Sequence
  targeting sequence with CTCN PAM
cucuggcugcugcugcugcu

SEQ ID NO: 18727 - RNA, 20 nt, Artificial Sequence
  targeting sequence with CTCN PAM
aaacaaaggcggcagagggc

SEQ ID NO: 18728 - RNA, 20 nt, Artificial Sequence
  targeting sequence with CTCN PAM
gccgccuuuguuuugagaug

SEQ ID NO: 18729 - RNA, 20 nt, Artificial Sequence
  targeting sequence with CTCN PAM
aacuguuucaagacaagagg

SEQ ID NO: 18730 - RNA, 20 nt, Artificial Sequence
  targeting sequence with CTCN PAM
ugucuugaaacaguuugagu

SEQ ID NO: 18731 - RNA, 20 nt, Artificial Sequence
  targeting sequence with CTCN PAM
cucuugucuugaaacaguuu

SEQ ID NO: 18732 - RNA, 20 nt, Artificial Sequence
  targeting sequence with CTCN PAM
caacccuguccaaaaaaacc

SEQ ID NO: 18733 - RNA, 20 nt, Artificial Sequence
  targeting sequence with CTCN PAM
gugcuuccuuaugguuucua

SEQ ID NO: 18734 - RNA, 20 nt, Artificial Sequence
  targeting sequence with CTCN PAM
cagugcuuccuuaugguuuc

SEQ ID NO: 18735 - RNA, 20 nt, Artificial Sequence
  targeting sequence with CTCN PAM
aacucucagugcuuccuuau

SEQ ID NO: 18736 - RNA, 20 nt, Artificial Sequence
  targeting sequence with CTCN PAM
aaauacuuaauuuuaagcaa

SEQ ID NO: 18737 - RNA, 20 nt, Artificial Sequence
  targeting sequence with CTCN PAM
ucaagguuaaggggcagguu

SEQ ID NO: 18738 - RNA, 20 nt, Artificial Sequence
  targeting sequence with CTCN PAM
cccaaguuggccacuuacgc

SEQ ID NO: 18739 - RNA, 20 nt, Artificial Sequence
  targeting sequence with CTCN PAM
ggcuuucucacccaaguugg

SEQ ID NO: 18740 - RNA, 20 nt, Artificial Sequence
  targeting sequence with CTCN PAM
cuggcuuucucacccaaguu

SEQ ID NO: 18741 - RNA, 20 nt, Artificial Sequence
  targeting sequence with CTCN PAM
cuaucccagacuaacuuuac

SEQ ID NO: 18742 - RNA, 20 nt, Artificial Sequence
  targeting sequence with CTCN PAM
cccuaucccagacuaacuuu

SEQ ID NO: 18743 - RNA, 20 nt, Artificial Sequence
  targeting sequence with CTCN PAM
ucaccucucccuaucccaga

SEQ ID NO: 18744 - RNA, 20 nt, Artificial Sequence
  targeting sequence with CTCN PAM
ucagguuuucgcaucuuuuu

SEQ ID NO: 18745 - RNA, 20 nt, Artificial Sequence
  targeting sequence with CTCN PAM
agauuguugguucauauuaa

SEQ ID NO: 18746 - RNA, 20 nt, Artificial Sequence
  targeting sequence with CTCN PAM
ugaagaaaaaaacauuauuc

SEQ ID NO: 18747 - RNA, 20 nt, Artificial Sequence
  targeting sequence with CTCN PAM
acucuuuuuuuguuguagaa

SEQ ID NO: 18748 - RNA, 20 nt, Artificial Sequence
  targeting sequence with CTCN PAM
uuuuuuguuguagaaaacuu

SEQ ID NO: 18749 - RNA, 20 nt, Artificial Sequence
  targeting sequence with CTCN PAM
gaaguuuucuacaacaaaaa

SEQ ID NO: 18750 - RNA, 20 nt, Artificial Sequence
  targeting sequence with CTCN PAM
cugcugcaugcacucgccag

SEQ ID NO: 18751 - RNA, 20 nt, Artificial Sequence
  targeting sequence with CTCN PAM
gcugcaugcacucgccagag

SEQ ID NO: 18752 - RNA, 20 nt, Artificial Sequence
  targeting sequence with CTCN PAM
ccagaggguagggaacaaug

SEQ ID NO: 18753 - RNA, 20 nt, Artificial Sequence
  targeting sequence with CTCN PAM
ggcgagugcaugcagcagag

SEQ ID NO: 18754 - RNA, 20 nt, Artificial Sequence
  targeting sequence with CTCN PAM
ucagcuauguggaacgguuc

SEQ ID NO: 18755 - RNA, 20 nt, Artificial Sequence
  targeting sequence with CTCN PAM
ggaagcacugggacgcccuc

SEQ ID NO: 18756 - RNA, 20 nt, Artificial Sequence
  targeting sequence with CTCN PAM
caacaggacguucagcacuu

SEQ ID NO: 18757 - RNA, 20 nt, Artificial Sequence
  targeting sequence with CTCN PAM
ugaagacucgcaacaggacg

SEQ ID NO: 18758 - RNA, 20 nt, Artificial Sequence
  targeting sequence with CTCN PAM
acuguagccaacuguguggu

SEQ ID NO: 18759 - RNA, 20 nt, Artificial Sequence
  targeting sequence with CTCN PAM
uggcugucauggcaguccuu

SEQ ID NO: 18760 - RNA, 20 nt, Artificial Sequence
  targeting sequence with CTCN PAM
ucaacauccuccuggcuguc

SEQ ID NO: 18761 - RNA, 20 nt, Artificial Sequence
  targeting sequence with CTCN PAM
agcccuucuagcugcaccac

SEQ ID NO: 18762 - RNA, 20 nt, Artificial Sequence
  targeting sequence with CTCN PAM
aucuuggagaugcgcgucug

SEQ ID NO: 18763 - RNA, 20 nt, Artificial Sequence
  targeting sequence with CTCN PAM
aagauggagcugcagcagca

SEQ ID NO: 18764 - RNA, 20 nt, Artificial Sequence
  targeting sequence with CTCN PAM
agggccuccugugggccaga

SEQ ID NO: 18765 - RNA, 20 nt, Artificial Sequence
  targeting sequence with CTCN PAM
ugugggccagaacagggaag

SEQ ID NO: 18766 - RNA, 20 nt, Artificial Sequence
  targeting sequence with CTCN PAM
ucccuguucuggcccacagg

SEQ ID NO: 18767 - RNA, 20 nt, Artificial Sequence
  targeting sequence with CTCN PAM
caaguauucugagaugcuga

SEQ ID NO: 18768 - RNA, 20 nt, Artificial Sequence
  targeting sequence with CTCN PAM
gaauacuugugagcagaagg

SEQ ID NO: 18769 - RNA, 20 nt, Artificial Sequence
  targeting sequence with CTCN PAM
agaugcaucuggcuugccca

SEQ ID NO: 18770 - RNA, 20 nt, Artificial Sequence
  targeting sequence with CTCN PAM
agcauauuuauaaaaucauu

SEQ ID NO: 18771 - RNA, 20 nt, Artificial Sequence
  targeting sequence with CTCN PAM
cuauucaagugauuauuauu

SEQ ID NO: 18772 - RNA, 20 nt, Artificial Sequence
  targeting sequence with CTCN PAM
acugcauuccagugggauga

SEQ ID NO: 18773 - RNA, 20 nt, Artificial Sequence
  targeting sequence with CTCN PAM
ucccacuggaaugcagugga

SEQ ID NO: 18774 - RNA, 20 nt, Artificial Sequence
  targeting sequence with CTCN PAM
uuuuucauugaaaauuaauc

SEQ ID NO: 18775 - RNA, 20 nt, Artificial Sequence
  targeting sequence with CTCN PAM
cuugacauuuccuucaauuc

SEQ ID NO: 18776 - RNA, 20 nt, Artificial Sequence
  targeting sequence with CTCN PAM
ugacauuuccuucaauucca

SEQ ID NO: 18777 - RNA, 20 nt, Artificial Sequence
  targeting sequence with CTCN PAM
gggacagggauuggaauuga

SEQ ID NO: 18778 - RNA, 20 nt, Artificial Sequence
  targeting sequence with CTCN PAM
cucuuggccaaaguggaccc

SEQ ID NO: 18779 - RNA, 20 nt, Artificial Sequence
  targeting sequence with CTCN PAM
uggccaaaguggaccccaaa

SEQ ID NO: 18780 - RNA, 20 nt, Artificial Sequence
  targeting sequence with CTCN PAM
cuuuuucagguuucuuuggg

SEQ ID NO: 18781 - RNA, 20 nt, Artificial Sequence
  targeting sequence with CTCN PAM
uucccaucauugccaagaac

SEQ ID NO: 18782 - RNA, 20 nt, Artificial Sequence
  targeting sequence with CTCN PAM
cuuuuugaguuguggcacaa

SEQ ID NO: 18783 - RNA, 20 nt, Artificial Sequence
  targeting sequence with CTCN PAM
aaaagggaggggauauaaua

SEQ ID NO: 18784 - RNA, 20 nt, Artificial Sequence
  targeting sequence with CTCN PAM
auuuucacauuaaugcuggu

SEQ ID NO: 18785 - RNA, 20 nt, Artificial Sequence
  targeting sequence with CTCN PAM
uuguggcaguaagacaucaa

SEQ ID NO: 18786 - RNA, 20 nt, Artificial Sequence
  targeting sequence with CTCN PAM
cccuauaaaccauaaaaucu

SEQ ID NO: 18787 - RNA, 20 nt, Artificial Sequence
  targeting sequence with CTCN PAM
ucaguuuuuaaaaaaauuaa

SEQ ID NO: 18788 - RNA, 20 nt, Artificial Sequence
  targeting sequence with CTCN PAM
gguauagcaucacaugacag

SEQ ID NO: 18789 - RNA, 20 nt, Artificial Sequence
  targeting sequence with CTCN PAM
guuaacuuaggcauuuuugu

SEQ ID NO: 18790 - RNA, 20 nt, Artificial Sequence
  targeting sequence with CTCN PAM
uucaaccgacugccagcuaa

SEQ ID NO: 18791 - RNA, 20 nt, Artificial Sequence
  targeting sequence with CTCN PAM
aaguaggggcuaacaaguca

SEQ ID NO: 18792 - RNA, 20 nt, Artificial Sequence
  targeting sequence with CTCN PAM
cugaaauguauaaagccaaa

SEQ ID NO: 18793 - RNA, 20 nt, Artificial Sequence
  targeting sequence with CTCN PAM
ggaccucuucagacuguguu

SEQ ID NO: 18794 - RNA, 20 nt, Artificial Sequence
  targeting sequence with CTCN PAM
ucagacuguguuccccaggc

SEQ ID NO: 18795 - RNA, 20 nt, Artificial Sequence
  targeting sequence with CTCN PAM
gaauaaaccucuuuaaaaua

SEQ ID NO: 18796 - RNA, 20 nt, Artificial Sequence
  targeting sequence with CTCN PAM
uuaaaauauuuuacaggguu

SEQ ID NO: 18797 - RNA, 20 nt, Artificial Sequence
  targeting sequence with CTCN PAM
ccaugucaauacacagaauc

SEQ ID NO: 18798 - RNA, 20 nt, Artificial Sequence
  targeting sequence with CTCN PAM
augucaauacacagaaucua

SEQ ID NO: 18799 - RNA, 20 nt, Artificial Sequence
  targeting sequence with CTCN PAM
uuuuuuuuuaacugcugccu

SEQ ID NO: 18800 - RNA, 20 nt, Artificial Sequence
  targeting sequence with CTCN PAM
gaucugccuucuuaagaagg

SEQ ID NO: 18801 - RNA, 20 nt, Artificial Sequence
  targeting sequence with CTCN PAM
ccuuuaguuugauccucugu

SEQ ID NO: 18802 - RNA, 20 nt, Artificial Sequence
  targeting sequence with CTCN PAM
uuuaguuugauccucuguaa

SEQ ID NO: 18803 - RNA, 20 nt, Artificial Sequence
  targeting sequence with CTCN PAM
guaaagaggacacuaugccc

SEQ ID NO: 18804 - RNA, 20 nt, Artificial Sequence
  targeting sequence with CTCN PAM
uuacagaggaucaaacuaaa

SEQ ID NO: 18805 - RNA, 20 nt, Artificial Sequence
  targeting sequence with CTCN PAM
aaaaaauagcaagaauagac

SEQ ID NO: 18806 - RNA, 20 nt, Artificial Sequence
  targeting sequence with CTCN PAM
gucucaaaaaaauagcaaga

SEQ ID NO: 18807 - RNA, 20 nt, Artificial Sequence
  targeting sequence with CTCN PAM
cucugucacccaggcuagag

SEQ ID NO: 18808 - RNA, 20 nt, Artificial Sequence
  targeting sequence with CTCN PAM
gucacccaggcuagagugca

SEQ ID NO: 18809 - RNA, 20 nt, Artificial Sequence
  targeting sequence with CTCN PAM
agccugggugacagagcgag

SEQ ID NO: 18810 - RNA, 20 nt, Artificial Sequence
  targeting sequence with CTCN PAM
gcucacugccagcuccaccu

SEQ ID NO: 18811 - RNA, 20 nt, Artificial Sequence
  targeting sequence with CTCN PAM
cugccagcuccaccucccag

SEQ ID NO: 18812 - RNA, 20 nt, Artificial Sequence
  targeting sequence with CTCN PAM
accucccagguucaggccau

SEQ ID NO: 18813 - RNA, 20 nt, Artificial Sequence
  targeting sequence with CTCN PAM
cagguucaggccauucuucu

SEQ ID NO: 18814 - RNA, 20 nt, Artificial Sequence
  targeting sequence with CTCN PAM
gccuccugaguagcugggac

SEQ ID NO: 18815 - RNA, 20 nt, Artificial Sequence
  targeting sequence with CTCN PAM
ugaguagcugggacuacagg

SEQ ID NO: 18816 - RNA, 20 nt, Artificial Sequence
  targeting sequence with CTCN PAM
ggaggcugaggcagaagaau

SEQ ID NO: 18817 - RNA, 20 nt, Artificial Sequence
  targeting sequence with CTCN PAM
acuaaaaauacaaaaauuag

SEQ ID NO: 18818 - RNA, 20 nt, Artificial Sequence
  targeting sequence with CTCN PAM
ugaccuugugauccgcccgc

SEQ ID NO: 18819 - RNA, 20 nt, Artificial Sequence
  targeting sequence with CTCN PAM
gccucccaaaaucccaaauc

SEQ ID NO: 18820 - RNA, 20 nt, Artificial Sequence
  targeting sequence with CTCN PAM
caaaaucccaaauccccugg

SEQ ID NO: 18821 - RNA, 20 nt, Artificial Sequence
  targeting sequence with CTCN PAM
auuacuaaaaaaacuugaaa

SEQ ID NO: 18822 - RNA, 20 nt, Artificial Sequence
  targeting sequence with CTCN PAM
uuaauguauuagcacuuuau

SEQ ID NO: 18823 - RNA, 20 nt, Artificial Sequence
  targeting sequence with CTCN PAM
ccccaacccccccaaaaaaa

SEQ ID NO: 18824 - RNA, 20 nt, Artificial Sequence
  targeting sequence with CTCN PAM
ucaaggucauagccuucacu

SEQ ID NO: 18825 - RNA, 20 nt, Artificial Sequence
  targeting sequence with CTCN PAM
aggucauagccuucacucau

SEQ ID NO: 18826 - RNA, 20 nt, Artificial Sequence
  targeting sequence with CTCN PAM
ugaguuuaaauuaauuccaa

SEQ ID NO: 18827 - RNA, 20 nt, Artificial Sequence
  targeting sequence with CTCN PAM
ugagugaaggcuaugaccuu

SEQ ID NO: 18828 - RNA, 20 nt, Artificial Sequence
  targeting sequence with CTCN PAM
aaaguuggucugagccuuga

SEQ ID NO: 18829 - RNA, 20 nt, Artificial Sequence
  targeting sequence with CTCN PAM
gaccaacuuuggaggauauc

SEQ ID NO: 18830 - RNA, 20 nt, Artificial Sequence
  targeting sequence with CTCN PAM
aggcucagaccaacuuugga

SEQ ID NO: 18831 - RNA, 20 nt, Artificial Sequence
  targeting sequence with CTCN PAM
aaucccaggaaaccaggacc

SEQ ID NO: 18832 - RNA, 20 nt, Artificial Sequence
  targeting sequence with CTCN PAM
gagacuagugucuuucaaaa

SEQ ID NO: 18833 - RNA, 20 nt, Artificial Sequence
  targeting sequence with CTCN PAM
gagaagggaagugggccaga

SEQ ID NO: 18834 - RNA, 20 nt, Artificial Sequence
  targeting sequence with CTCN PAM
auauagaaauaagaaaaaau

SEQ ID NO: 18835 - RNA, 20 nt, Artificial Sequence
  targeting sequence with CTCN PAM
cagaauaaaauagaugggcu

SEQ ID NO: 18836 - RNA, 20 nt, Artificial Sequence
  targeting sequence with CTCN PAM
cggguuauucuugcaaacug

SEQ ID NO: 18837 - RNA, 20 nt, Artificial Sequence
  targeting sequence with CTCN PAM
uauaggcacauugccugaca

SEQ ID NO: 18838 - RNA, 20 nt, Artificial Sequence
  targeting sequence with CTCN PAM
uucugugggaaagggggcuu

SEQ ID NO: 18839 - RNA, 20 nt, Artificial Sequence
  targeting sequence with CTCN PAM
gacaaguauuugggccauuu

SEQ ID NO: 18840 - RNA, 20 nt, Artificial Sequence
  targeting sequence with CTCN PAM
guguauggaaaaccacauga

SEQ ID NO: 18841 - RNA, 20 nt, Artificial Sequence
  targeting sequence with CTCN PAM
aaaguuuauaccauuuuggg

SEQ ID NO: 18842 - RNA, 20 nt, Artificial Sequence
  targeting sequence with CTCN PAM
aucauuuuaagaguagguau

SEQ ID NO: 18843 - RNA, 20 nt, Artificial Sequence
  targeting sequence with CTCN PAM
uaaaaugauugagaugcauu

SEQ ID NO: 18844 - RNA, 20 nt, Artificial Sequence
  targeting sequence with CTCN PAM
uacacaguugguauaagcuu

SEQ ID NO: 18845 - RNA, 20 nt, Artificial Sequence
  targeting sequence with CTCN PAM
accuucucaucuuuuuuccu

SEQ ID NO: 18846 - RNA, 20 nt, Artificial Sequence
  targeting sequence with CTCN PAM
ucuuuuuuccuuccgcuguu

SEQ ID NO: 18847 - RNA, 20 nt, Artificial Sequence
  targeting sequence with CTCN PAM
accagaaugaaaucuugaac

SEQ ID NO: 18848 - RNA, 20 nt, Artificial Sequence
  targeting sequence with CTCN PAM
guuaggucauuuagcuguuc

SEQ ID NO: 18849 - RNA, 20 nt, Artificial Sequence
  targeting sequence with CTCN PAM
uuagaugugaacgauuggaa

SEQ ID NO: 18850 - RNA, 20 nt, Artificial Sequence
  targeting sequence with CTCN PAM
caaaacacauucuacaaagg

SEQ ID NO: 18851 - RNA, 20 nt, Artificial Sequence
  targeting sequence with CTCN PAM
auuucuuugugcuucuauuc

SEQ ID NO: 18852 - RNA, 20 nt, Artificial Sequence
  targeting sequence with CTCN PAM
uagucucuggaaaagauagc

SEQ ID NO: 18853 - RNA, 20 nt, Artificial Sequence
  targeting sequence with CTCN PAM
ggaaaagauagcuugucuca

SEQ ID NO: 18854 - RNA, 20 nt, Artificial Sequence
  targeting sequence with CTCN PAM
aggccaaaucacguggcaac

SEQ ID NO: 18855 - RNA, 20 nt, Artificial Sequence
  targeting sequence with CTCN PAM
aagcuaaucagggcugcugg

SEQ ID NO: 18856 - RNA, 20 nt, Artificial Sequence
  targeting sequence with CTCN PAM
ucugaacaacauaugggaga

SEQ ID NO: 18857 - RNA, 20 nt, Artificial Sequence
  targeting sequence with CTCN PAM
gaacaacauaugggagaggc

SEQ ID NO: 18858 - RNA, 20 nt, Artificial Sequence
  targeting sequence with CTCN PAM
cauauguuguucagaggagc

SEQ ID NO: 18859 - RNA, 20 nt, Artificial Sequence
  targeting sequence with CTCN PAM
cccauauguuguucagagga

SEQ ID NO: 18860 - RNA, 20 nt, Artificial Sequence
  targeting sequence with CTCN PAM
ugaaaagauaacacaccaau

SEQ ID NO: 18861 - RNA, 20 nt, Artificial Sequence
  targeting sequence with CTCN PAM
cucacccggauguuugcgau

SEQ ID NO: 18862 - RNA, 20 nt, Artificial Sequence
  targeting sequence with CTCN PAM
cccggauguuugcgauucag

SEQ ID NO: 18863 - RNA, 20 nt, Artificial Sequence
  targeting sequence with CTCN PAM
gaaucgcaaacauccgggug

SEQ ID NO: 18864 - RNA, 20 nt, Artificial Sequence
  targeting sequence with CTCN PAM
ggcauucuagggcucugaau

SEQ ID NO: 18865 - RNA, 20 nt, Artificial Sequence
  targeting sequence with CTCN PAM
ggcucuggcauucuagggcu

SEQ ID NO: 18866 - RNA, 20 nt, Artificial Sequence
  targeting sequence with CTCN PAM
guaaauauuuguugacagaa

SEQ ID NO: 18867 - RNA, 20 nt, Artificial Sequence
  targeting sequence with CTCN PAM
caguaaauauuuguugacag

SEQ ID NO: 18868 - RNA, 20 nt, Artificial Sequence
  targeting sequence with CTCN PAM
gucuugcuuaccacaauauu

SEQ ID NO: 18869 - RNA, 20 nt, Artificial Sequence
  targeting sequence with CTCN PAM
ggaguuuguacucuaaggag

SEQ ID NO: 18870 - RNA, 20 nt, Artificial Sequence
  targeting sequence with CTCN PAM
ugagggcaggcacucugucu

SEQ ID NO: 18871 - RNA, 20 nt, Artificial Sequence
  targeting sequence with CTCN PAM
aaggagugggggaggcaaga

SEQ ID NO: 18872 - RNA, 20 nt, Artificial Sequence
  targeting sequence with CTCN PAM
uuagaguacaaacuccugag

SEQ ID NO: 18873 - RNA, 20 nt, Artificial Sequence
  targeting sequence with CTCN PAM
cccacuccuuagaguacaaa

SEQ ID NO: 18874 - RNA, 20 nt, Artificial Sequence
  targeting sequence with CTCN PAM
auaugggaaaucaucuugcc

SEQ ID NO: 18875 - RNA, 20 nt, Artificial Sequence
  targeting sequence with CTCN PAM
acugaucuucuuuguuuuac

SEQ ID NO: 18876 - RNA, 20 nt, Artificial Sequence
  targeting sequence with CTCN PAM
gucuuauaccucuacugauc

SEQ ID NO: 18877 - RNA, 20 nt, Artificial Sequence
  targeting sequence with CTCN PAM
caaagugcugggauuacagg

SEQ ID NO: 18878 - RNA, 20 nt, Artificial Sequence
  targeting sequence with CTCN PAM
cgccuguaaucccagcacuu

SEQ ID NO: 18879 - RNA, 20 nt, Artificial Sequence
  targeting sequence with CTCN PAM
uccuuuaaaccuuuucuagg

SEQ ID NO: 18880 - RNA, 20 nt, Artificial Sequence
  targeting sequence with CTCN PAM
gaucucauccuuuaaaccuu

SEQ ID NO: 18881 - RNA, 20 nt, Artificial Sequence
  targeting sequence with CTCN PAM
cauucauuuuuccaccuaga

SEQ ID NO: 18882 - RNA, 20 nt, Artificial Sequence
  targeting sequence with CTCN PAM
agcccuuuacucacauucau

SEQ ID NO: 18883 - RNA, 20 nt, Artificial Sequence
  targeting sequence with CTCN PAM
ccagcccuuuacucacauuc

SEQ ID NO: 18884 - RNA, 20 nt, Artificial Sequence
  targeting sequence with CTCN PAM
aacauagaugcacuauucua

SEQ ID NO: 18885 - RNA, 20 nt, Artificial Sequence
  targeting sequence with CTCN PAM
ucggaucuuccagauuuccc

SEQ ID NO: 18886 - RNA, 20 nt, Artificial Sequence
  targeting sequence with CTCN PAM
uuuaauaucaauucuagaau

SEQ ID NO: 18887 - RNA, 20 nt, Artificial Sequence
  targeting sequence with CTCN PAM
guagucuucuuugggcucau

SEQ ID NO: 18888 - RNA, 20 nt, Artificial Sequence
  targeting sequence with CTCN PAM
gcucaguagucuucuuuggg

SEQ ID NO: 18889 - RNA, 20 nt, Artificial Sequence
  targeting sequence with CTCN PAM
ucugcucaguagucuucuuu

SEQ ID NO: 18890 - RNA, 20 nt, Artificial Sequence
  targeting sequence with CTCN PAM
uuuuccuaaaaacacauauu

SEQ ID NO: 18891 - RNA, 20 nt, Artificial Sequence
  targeting sequence with CTCN PAM
uaguggugaagaagaccgac

SEQ ID NO: 18892 - RNA, 20 nt, Artificial Sequence
  targeting sequence with CTCN PAM
gucggucuucuucaccacua

SEQ ID NO: 18893 - RNA, 20 nt, Artificial Sequence
  targeting sequence with CTCN PAM
acauacaaccuaccucaguc

SEQ ID NO: 18894 - RNA, 20 nt, Artificial Sequence
  targeting sequence with CTCN PAM
uuaguuccugggacuccaca

SEQ ID NO: 18895 - RNA, 20 nt, Artificial Sequence
  targeting sequence with CTCN PAM
uaucuacuuagcucuuuagu

SEQ ID NO: 18896 - RNA, 20 nt, Artificial Sequence
  targeting sequence with CTCN PAM
acauuuaaaaaacacuagaa

SEQ ID NO: 18897 - RNA, 20 nt, Artificial Sequence
  targeting sequence with CTCN PAM
cugucaggcagagggcagau

SEQ ID NO: 18898 - RNA, 20 nt, Artificial Sequence
  targeting sequence with CTCN PAM
gucaggcagagggcagaugg

SEQ ID NO: 18899 - RNA, 20 nt, Artificial Sequence
  targeting sequence with CTCN PAM
gccugacagagagguuucca

SEQ ID NO: 18900 - RNA, 20 nt, Artificial Sequence
  targeting sequence with CTCN PAM
caucccaacagggaauguac

SEQ ID NO: 18901 - RNA, 20 nt, Artificial Sequence
  targeting sequence with CTCN PAM
ucccaacagggaauguacua

SEQ ID NO: 18902 - RNA, 20 nt, Artificial Sequence
  targeting sequence with CTCN PAM
gguagcauacauuuaacauu

SEQ ID NO: 18903 - RNA, 20 nt, Artificial Sequence
  targeting sequence with CTCN PAM
caugcugguguuaauguuaa

SEQ ID NO: 18904 - RNA, 20 nt, Artificial Sequence
  targeting sequence with CTCN PAM
agggacuucauacuaaaaga

SEQ ID NO: 18905 - RNA, 20 nt, Artificial Sequence
  targeting sequence with CTCN PAM
cacaucuaaaacuaucuccu

SEQ ID NO: 18906 - RNA, 20 nt, Artificial Sequence
  targeting sequence with CTCN PAM
uuucuuucuucuuuuuaauc

SEQ ID NO: 18907 - RNA, 20 nt, Artificial Sequence
  targeting sequence with CTCN PAM
cuuccaauaauuaugcaaua

SEQ ID NO: 18908 - RNA, 20 nt, Artificial Sequence
  targeting sequence with CTCN PAM
acugcuuuucuaagaaacaa

SEQ ID NO: 18909 - RNA, 20 nt, Artificial Sequence
  targeting sequence with CTCN PAM
auuuaguucuucuuuauccu

SEQ ID NO: 18910 - RNA, 20 nt, Artificial Sequence
  targeting sequence with CTCN PAM
uaucaaggauaaagaagaac

SEQ ID NO: 18911 - RNA, 20 nt, Artificial Sequence
  targeting sequence with CTCN PAM
auacugccuucuuuuaugcu

SEQ ID NO: 18912 - RNA, 20 nt, Artificial Sequence
  targeting sequence with CTCN PAM
uccuguuauugaagugacug

SEQ ID NO: 18913 - RNA, 20 nt, Artificial Sequence
  targeting sequence with CTCN PAM
uuagccuguucagucacuuc

SEQ ID NO: 18914 - RNA, 20 nt, Artificial Sequence
  targeting sequence with CTCN PAM
gugacucugccuuuuccuuu

SEQ ID NO: 18915 - RNA, 20 nt, Artificial Sequence
  targeting sequence with CTCN PAM
gccuuuuccuuucaucugcu

SEQ ID NO: 18916 - RNA, 20 nt, Artificial Sequence
  targeting sequence with CTCN PAM
gggcagcagaugaaaggaaa

SEQ ID NO: 18917 - RNA, 20 nt, Artificial Sequence
  targeting sequence with CTCN PAM
ucugugguguuuucgguguu

SEQ ID NO: 18918 - RNA, 20 nt, Artificial Sequence
  targeting sequence with CTCN PAM
cucuuuaccagagaggggcc

SEQ ID NO: 18919 - RNA, 20 nt, Artificial Sequence
  targeting sequence with CTCN PAM
cuuuaccagagaggggccag

SEQ ID NO: 18920 - RNA, 20 nt, Artificial Sequence
  targeting sequence with CTCN PAM
uuaccagagaggggccagag

SEQ ID NO: 18921 - RNA, 20 nt, Artificial Sequence
  targeting sequence with CTCN PAM
gguaaagagagagaaugaug

SEQ ID NO: 18922 - RNA, 20 nt, Artificial Sequence
  targeting sequence with CTCN PAM
cugguaaagagagagaauga

SEQ ID NO: 18923 - RNA, 20 nt, Artificial Sequence
  targeting sequence with CTCN PAM
ggccccucucugguaaagag

SEQ ID NO: 18924 - RNA, 20 nt, Artificial Sequence
  targeting sequence with CTCN PAM
ugggauuuaagggaaagguu

SEQ ID NO: 18925 - RNA, 20 nt, Artificial Sequence
  targeting sequence with CTCN PAM
ccucaacuaaggacuguugg

SEQ ID NO: 18926 - RNA, 20 nt, Artificial Sequence
  targeting sequence with CTCN PAM
ucaacuaaggacuguugggu

SEQ ID NO: 18927 - RNA, 20 nt, Artificial Sequence
  targeting sequence with CTCN PAM
acuaaggacuguuggguggc

SEQ ID NO: 18928 - RNA, 20 nt, Artificial Sequence
  targeting sequence with CTCN PAM
cugccacccaacaguccuua

SEQ ID NO: 18929 - RNA, 20 nt, Artificial Sequence
  targeting sequence with CTCN PAM
ccucccugccacccaacagu

SEQ ID NO: 18930 - RNA, 20 nt, Artificial Sequence
  targeting sequence with CTCN PAM
gcaugugucccacaggcuac

SEQ ID NO: 18931 - RNA, 20 nt, Artificial Sequence
  targeting sequence with CTCN PAM
uagccuacaaauuucaggcu

SEQ ID NO: 18932 - RNA, 20 nt, Artificial Sequence
  targeting sequence with CTCN PAM
uacauaccaguagaacagau

SEQ ID NO: 18933 - RNA, 20 nt, Artificial Sequence
  targeting sequence with CTCN PAM
ugggguuguugaaaugaauu

SEQ ID NO: 18934 - RNA, 20 nt, Artificial Sequence
  targeting sequence with CTCN PAM
ucuauaaaaugcagauaaua

SEQ ID NO: 18935 - RNA, 20 nt, Artificial Sequence
  targeting sequence with CTCN PAM
gagaaguucuaaagugaauu

SEQ ID NO: 18936 - RNA, 20 nt, Artificial Sequence
  targeting sequence with CTCN PAM
gagcuucuguuuccucaucu

SEQ ID NO: 18937 - RNA, 20 nt, Artificial Sequence
  targeting sequence with CTCN PAM
acaaacccagaucaacuaac

SEQ ID NO: 18938 - RNA, 20 nt, Artificial Sequence
  targeting sequence with CTCN PAM
ccucauaaguaagaaaucag

SEQ ID NO: 18939 - RNA, 20 nt, Artificial Sequence
  targeting sequence with CTCN PAM
ucauaaguaagaaaucagag

SEQ ID NO: 18940 - RNA, 20 nt, Artificial Sequence
  targeting sequence with CTCN PAM
uaaguaagaaaucagaguca

SEQ ID NO: 18941 - RNA, 20 nt, Artificial Sequence
  targeting sequence with CTCN PAM
gauuucuuacuuaugaggag

SEQ ID NO: 18942 - RNA, 20 nt, Artificial Sequence
  targeting sequence with CTCN PAM
gacucugauuucuuacuuau

SEQ ID NO: 18943 - RNA, 20 nt, Artificial Sequence
  targeting sequence with CTCN PAM
cuuuugcuaagugauuugga

SEQ ID NO: 18944 - RNA, 20 nt, Artificial Sequence
  targeting sequence with CTCN PAM
uuccagcucacuuuugcuaa

SEQ ID NO: 18945 - RNA, 20 nt, Artificial Sequence
  targeting sequence with CTCN PAM
aaaccaucacaucaguguag

SEQ ID NO: 18946 - RNA, 20 nt, Artificial Sequence
  targeting sequence with CTCN PAM
acuuugacaucagacuccaa

SEQ ID NO: 18947 - RNA, 20 nt, Artificial Sequence
  targeting sequence with CTCN PAM
caucaacuccacuuugacau

SEQ ID NO: 18948 - RNA, 20 nt, Artificial Sequence
  targeting sequence with CTCN PAM
uucucccaucaacuccacuu

SEQ ID NO: 18949 - RNA, 20 nt, Artificial Sequence
  targeting sequence with CTCN PAM
uccuucucccaucaacucca

SEQ ID NO: 18950 - RNA, 20 nt, Artificial Sequence
  targeting sequence with CTCN PAM
uaucuuuuuaauuguagguu

SEQ ID NO: 18951 - RNA, 20 nt, Artificial Sequence
  targeting sequence with CTCN PAM
ccaacucuuaucuuuuuaau

SEQ ID NO: 18952 - RNA, 20 nt, Artificial Sequence
  targeting sequence with CTCN PAM
augcccucaccaacucuuau

SEQ ID NO: 18953 - RNA, 20 nt, Artificial Sequence
  targeting sequence with CTCN PAM
uauacugcuguugggaaugg

SEQ ID NO: 18954 - RNA, 20 nt, Artificial Sequence
  targeting sequence with CTCN PAM
gcaaaacaguuuggcaccuc

SEQ ID NO: 18955 - RNA, 20 nt, Artificial Sequence
  targeting sequence with CTCN PAM
ucaaaaaguuaacaguuacc

SEQ ID NO: 18956 - RNA, 20 nt, Artificial Sequence
  targeting sequence with CTCN PAM
aaaaguuaacaguuaccuua

SEQ ID NO: 18957 - RNA, 20 nt, Artificial Sequence
  targeting sequence with CTCN PAM
gcaauucuaccccagauaua

SEQ ID NO: 18958 - RNA, 20 nt, Artificial Sequence
  targeting sequence with CTCN PAM
uauacauauggguuguuuau

SEQ ID NO: 18959 - RNA, 20 nt, Artificial Sequence
  targeting sequence with CTCN PAM
uucaaucgauggaugcucac

SEQ ID NO: 18960 - RNA, 20 nt, Artificial Sequence
  targeting sequence with CTCN PAM
cagaaacauuagaacauaaa

SEQ ID NO: 18961 - RNA, 20 nt, Artificial Sequence
  targeting sequence with CTCN PAM
ggaucuucauaugcauacau

SEQ ID NO: 18962 - RNA, 20 nt, Artificial Sequence
  targeting sequence with CTCN PAM
cacaacauggacuuccuucc

SEQ ID NO: 18963 - RNA, 20 nt, Artificial Sequence
  targeting sequence with CTCN PAM
ugugaacuguuucugcagua

SEQ ID NO: 18964 - RNA, 20 nt, Artificial Sequence
  targeting sequence with CTCN PAM
ucuucucaccugaccuuuca

SEQ ID NO: 18965 - RNA, 20 nt, Artificial Sequence
  targeting sequence with CTCN PAM
ccugaccuuucauaauauac

SEQ ID NO: 18966 - RNA, 20 nt, Artificial Sequence
  targeting sequence with CTCN PAM
uugacuuacgaugggguuac

SEQ ID NO: 18967 - RNA, 20 nt, Artificial Sequence
  targeting sequence with CTCN PAM
agcaagaauaauucccagga

SEQ ID NO: 18968 - RNA, 20 nt, Artificial Sequence
  targeting sequence with CTCN PAM
ggccccaguccugggaauua

SEQ ID NO: 18969 - RNA, 20 nt, Artificial Sequence
  targeting sequence with CTCN PAM
agcagcagccugugggcucu

SEQ ID NO: 18970 - RNA, 20 nt, Artificial Sequence
  targeting sequence with CTCN PAM
gacucggcuuugaccuuacc

SEQ ID NO: 18971 - RNA, 20 nt, Artificial Sequence
  targeting sequence with CTCN PAM
gcuuugaccuuaccugccug

SEQ ID NO: 18972 - RNA, 20 nt, Artificial Sequence
  targeting sequence with CTCN PAM
uguuauuuguaaagauaagc

SEQ ID NO: 18973 - RNA, 20 nt, Artificial Sequence
  targeting sequence with CTCN PAM
uucuugccucauguuauuug

SEQ ID NO: 18974 - RNA, 20 nt, Artificial Sequence
  targeting sequence with CTCN PAM
ugauaccugaauucagcagu

SEQ ID NO: 18975 - RNA, 20 nt, Artificial Sequence
  targeting sequence with CTCN PAM
uguaaugaggggguagcuug

SEQ ID NO: 18976 - RNA, 20 nt, Artificial Sequence
  targeting sequence with CTCN PAM
uuacaugagcucuugauacc

SEQ ID NO: 18977 - RNA, 20 nt, Artificial Sequence
  targeting sequence with CTCN PAM
acagaacuaaggaguaaguc

SEQ ID NO: 18978 - RNA, 20 nt, Artificial Sequence
  targeting sequence with CTCN PAM
uuaguucuguggaguuacaa

SEQ ID NO: 18979 - RNA, 20 nt, Artificial Sequence
  targeting sequence with CTCN PAM
uuuucuaagauaguuuuuuu

SEQ ID NO: 18980 - RNA, 20 nt, Artificial Sequence
  targeting sequence with CTCN PAM
gguagcagggucucauuuuc

SEQ ID NO: 18981 - RNA, 20 nt, Artificial Sequence
  targeting sequence with CTCN PAM
uugaauaucucugguagcag

SEQ ID NO: 18982 - RNA, 20 nt, Artificial Sequence
  targeting sequence with CTCN PAM
ccuugaauaucucugguagc

SEQ ID NO: 18983 - RNA, 20 nt, Artificial Sequence
  targeting sequence with CTCN PAM
auugaaagagauuuaacuag

SEQ ID NO: 18984 - RNA, 20 nt, Artificial Sequence
  targeting sequence with CTCN PAM
uucaauagaggauuuauuuc

SEQ ID NO: 18985 - RNA, 20 nt, Artificial Sequence
  targeting sequence with CTCN PAM
gagaucuuuucuaacaccua

SEQ ID NO: 18986 - RNA, 20 nt, Artificial Sequence
  targeting sequence with CTCN PAM
gaggucuaguuaaaucucuu

SEQ ID NO: 18987 - RNA, 20 nt, Artificial Sequence
  targeting sequence with CTCN PAM
agguguuagaaaagaucuca

SEQ ID NO: 18988 - RNA, 20 nt, Artificial Sequence
  targeting sequence with CTCN PAM
uuaaaaaaaaaaaaaaaaaa

SEQ ID NO: 18989 - RNA, 20 nt, Artificial Sequence
  targeting sequence with CTCN PAM
gucacccaggguggagugca

SEQ ID NO: 18990 - RNA, 20 nt, Artificial Sequence
  targeting sequence with CTCN PAM
acccugggugacagagcaag

SEQ ID NO: 18991 - RNA, 20 nt, Artificial Sequence
  targeting sequence with CTCN PAM
cugcagccucaaauuccaga

SEQ ID NO: 18992 - RNA, 20 nt, Artificial Sequence
  targeting sequence with CTCN PAM
aauuccagagcucaagggau

SEQ ID NO: 18993 - RNA, 20 nt, Artificial Sequence
  targeting sequence with CTCN PAM
ggaauuugaggcugcaguga

SEQ ID NO: 18994 - RNA, 20 nt, Artificial Sequence
  targeting sequence with CTCN PAM
agggauccucccaccucagc

SEQ ID NO: 18995 - RNA, 20 nt, Artificial Sequence
  targeting sequence with CTCN PAM
caccucagccuucugaguag

SEQ ID NO: 18996 - RNA, 20 nt, Artificial Sequence
  targeting sequence with CTCN PAM
gccuucugaguagcugggac

SEQ ID NO: 18997 - RNA, 20 nt, Artificial Sequence
  targeting sequence with CTCN PAM
gaaggcugaggugggaggau

SEQ ID NO: 18998 - RNA, 20 nt, Artificial Sequence
  targeting sequence with CTCN PAM
gaaaaaaaaaaauagccagg

SEQ ID NO: 18999 - RNA, 20 nt, Artificial Sequence
  targeting sequence with CTCN PAM
cuauguugcccaggcugguc

SEQ ID NO: 19000 - RNA, 20 nt, Artificial Sequence
  targeting sequence with CTCN PAM
ugagcucaagcaauccuccu

SEQ ID NO: 19001 - RNA, 20 nt, Artificial Sequence
  targeting sequence with CTCN PAM
ggaguucaagaccagccugg

SEQ ID NO: 19002 - RNA, 20 nt, Artificial Sequence
  targeting sequence with CTCN PAM
agcaauccuccugccucagc

SEQ ID NO: 19003 - RNA, 20 nt, Artificial Sequence
  targeting sequence with CTCN PAM
ugccucagcuucccaaagug

SEQ ID NO: 19004 - RNA, 20 nt, Artificial Sequence
  targeting sequence with CTCN PAM
gcuucccaaagugcugagac

SEQ ID NO: 19005 - RNA, 20 nt, Artificial Sequence
  targeting sequence with CTCN PAM
gcacuuugggaagcugaggc

SEQ ID NO: 19006 - RNA, 20 nt, Artificial Sequence
  targeting sequence with CTCN PAM
uugccccccuuuauuguugu

SEQ ID NO: 19007 - RNA, 20 nt, Artificial Sequence
  targeting sequence with CTCN PAM
cauaccaagugaaucccaau

SEQ ID NO: 19008 - RNA, 20 nt, Artificial Sequence
  targeting sequence with CTCN PAM
ccaccucacauaccaaguga

SEQ ID NO: 19009 - RNA, 20 nt, Artificial Sequence
  targeting sequence with CTCN PAM
gauucauauauauuccucac

SEQ ID NO: 19010 - RNA, 20 nt, Artificial Sequence
  targeting sequence with CTCN PAM
gcacuuauucccaacacuuu

SEQ ID NO: 19011 - RNA, 20 nt, Artificial Sequence
  targeting sequence with CTCN PAM
agacauaauaugggaugaac

SEQ ID NO: 19012 - RNA, 20 nt, Artificial Sequence
  targeting sequence with CTCN PAM
aucuucacuccugccauuuu

SEQ ID NO: 19013 - RNA, 20 nt, Artificial Sequence
  targeting sequence with CTCN PAM
ugccauuuugcaccuagaaa

SEQ ID NO: 19014 - RNA, 20 nt, Artificial Sequence
  targeting sequence with CTCN PAM
guccagguuuuggauuaaaa

SEQ ID NO: 19015 - RNA, 20 nt, Artificial Sequence
  targeting sequence with CTCN PAM
gcaacucgcuagcuugggug

SEQ ID NO: 19016 - RNA, 20 nt, Artificial Sequence
  targeting sequence with CTCN PAM
cuagcuugggugauccuuuu

SEQ ID NO: 19017 - RNA, 20 nt, Artificial Sequence
  targeting sequence with CTCN PAM
auaaagaggaaaucuaccua

SEQ ID NO: 19018 - RNA, 20 nt, Artificial Sequence
  targeting sequence with CTCN PAM
uuauagaggaugaaaaggau

SEQ ID NO: 19019 - RNA, 20 nt, Artificial Sequence
  targeting sequence with CTCN PAM
aaagggcaauugcaaagauu

SEQ ID NO: 19020 - RNA, 20 nt, Artificial Sequence
  targeting sequence with CTCN PAM
uuuaaucuuugcaauugccc

SEQ ID NO: 19021 - RNA, 20 nt, Artificial Sequence
  targeting sequence with CTCN PAM
ugugugccagguauuugaug

SEQ ID NO: 19022 - RNA, 20 nt, Artificial Sequence
  targeting sequence with CTCN PAM
gugagacagauauaucacaa

SEQ ID NO: 19023 - RNA, 20 nt, Artificial Sequence
  targeting sequence with CTCN PAM
cagagcaccucuugugugcc

SEQ ID NO: 19024 - RNA, 20 nt, Artificial Sequence
  targeting sequence with CTCN PAM
uuugugagucuccuaguucu

SEQ ID NO: 19025 - RNA, 20 nt, Artificial Sequence
  targeting sequence with CTCN PAM
gucgcccagguuggagugca

SEQ ID NO: 19026 - RNA, 20 nt, Artificial Sequence
  targeting sequence with CTCN PAM
aaccugggcgacagagaaaa

SEQ ID NO: 19027 - RNA, 20 nt, Artificial Sequence
  targeting sequence with CTCN PAM
uuguggucucaaucuccuag

SEQ ID NO: 19028 - RNA, 20 nt, Artificial Sequence
  targeting sequence with CTCN PAM
aucuccuaggcucuagugac

SEQ ID NO: 19029 - RNA, 20 nt, Artificial Sequence
  targeting sequence with CTCN PAM
uaggcucuagugacccuucc

SEQ ID NO: 19030 - RNA, 20 nt, Artificial Sequence
  targeting sequence with CTCN PAM
agugacccuuccaccucagc

SEQ ID NO: 19031 - RNA, 20 nt, Artificial Sequence
  targeting sequence with CTCN PAM
gccucccaagcagcugggac

SEQ ID NO: 19032 - RNA, 20 nt, Artificial Sequence
  targeting sequence with CTCN PAM
caagcagcugggacuacagg

SEQ ID NO: 19033 - RNA, 20 nt, Artificial Sequence
  targeting sequence with CTCN PAM
acagaaaauacaaaaacaaa

SEQ ID NO: 19034 - RNA, 20 nt, Artificial Sequence
  targeting sequence with CTCN PAM
caaagugcugggauuacagg

SEQ ID NO: 19035 - RNA, 20 nt, Artificial Sequence
  targeting sequence with CTCN PAM
ugccuguaaucccagcacuu

SEQ ID NO: 19036 - RNA, 20 nt, Artificial Sequence
  targeting sequence with CTCN PAM
auccuccucaauccuagaua

SEQ ID NO: 19037 - RNA, 20 nt, Artificial Sequence
  targeting sequence with CTCN PAM
ucaauccuagauacaagccu

SEQ ID NO: 19038 - RNA, 20 nt, Artificial Sequence
  targeting sequence with CTCN PAM
auccuagauacaagccucuu

SEQ ID NO: 19039 - RNA, 20 nt, Artificial Sequence
  targeting sequence with CTCN PAM
uuuacuucuuauuucauaca

SEQ ID NO: 19040 - RNA, 20 nt, Artificial Sequence
  targeting sequence with CTCN PAM
aguuugccagauaauucaaa

SEQ ID NO: 19041 - RNA, 20 nt, Artificial Sequence
  targeting sequence with CTCN PAM
cacacauacauagguagaua

SEQ ID NO: 19042 - RNA, 20 nt, Artificial Sequence
  targeting sequence with CTCN PAM
aguaauuuuuauuuuuuuau

SEQ ID NO: 19043 - RNA, 20 nt, Artificial Sequence
  targeting sequence with CTCN PAM
aaaauaaaaaaauaaaaauu

SEQ ID NO: 19044 - RNA, 20 nt, Artificial Sequence
  targeting sequence with CTCN PAM
gucucuaaaauaaaaaaaua

SEQ ID NO: 19045 - RNA, 20 nt, Artificial Sequence
  targeting sequence with CTCN PAM
cuauguuguccaugcuggag

SEQ ID NO: 19046 - RNA, 20 nt, Artificial Sequence
  targeting sequence with CTCN PAM
agcauggacaacauagugag

SEQ ID NO: 19047 - RNA, 20 nt, Artificial Sequence
  targeting sequence with CTCN PAM
gaauaaccacuguacuccag

SEQ ID NO: 19048 - RNA, 20 nt, Artificial Sequence
  targeting sequence with CTCN PAM
aacuccugggcucaagugau

SEQ ID NO: 19049 - RNA, 20 nt, Artificial Sequence
  targeting sequence with CTCN PAM
ugggcucaagugauccuccc

SEQ ID NO: 19050 - RNA, 20 nt, Artificial Sequence
  targeting sequence with CTCN PAM
agugauccucccaucucagc

SEQ ID NO: 19051 - RNA, 20 nt, Artificial Sequence
  targeting sequence with CTCN PAM
caucucagccuccugaguag

SEQ ID NO: 19052 - RNA, 20 nt, Artificial Sequence
  targeting sequence with CTCN PAM
gccuccugaguagcugggac

SEQ ID NO: 19053 - RNA, 20 nt, Artificial Sequence
  targeting sequence with CTCN PAM
ugaguagcugggacuacaga

SEQ ID NO: 19054 - RNA, 20 nt, Artificial Sequence
  targeting sequence with CTCN PAM
ggaggcugagaugggaggau

SEQ ID NO: 19055 - RNA, 20 nt, Artificial Sequence
  targeting sequence with CTCN PAM
aguaaauuuuaucuaauuuu

SEQ ID NO: 19056 - RNA, 20 nt, Artificial Sequence
  targeting sequence with CTCN PAM
aaaaagaguuauauagaaac

SEQ ID NO: 19057 - RNA, 20 nt, Artificial Sequence
  targeting sequence with CTCN PAM
uuuuggagauuugaaaaaau

SEQ ID NO: 19058 - RNA, 20 nt, Artificial Sequence
  targeting sequence with CTCN PAM
ccaugcucuuacagaaaaua

SEQ ID NO: 19059 - RNA, 20 nt, Artificial Sequence
  targeting sequence with CTCN PAM
uacagaaaauaaaguccuuu

SEQ ID NO: 19060 - RNA, 20 nt, Artificial Sequence
  targeting sequence with CTCN PAM
aaaggacuuuauuuucugua

SEQ ID NO: 19061 - RNA, 20 nt, Artificial Sequence
  targeting sequence with CTCN PAM
agcugagucuucccaaauaa

SEQ ID NO: 19062 - RNA, 20 nt, Artificial Sequence
  targeting sequence with CTCN PAM
gcuugagaagaacuugcugu

SEQ ID NO: 19063 - RNA, 20 nt, Artificial Sequence
  targeting sequence with CTCN PAM
gugaacaauaguuacauuuu

SEQ ID NO: 19064 - RNA, 20 nt, Artificial Sequence
  targeting sequence with CTCN PAM
gcagaugaaacagacaaaca

SEQ ID NO: 19065 - RNA, 20 nt, Artificial Sequence
  targeting sequence with CTCN PAM
auguuugucuguuucaucug

SEQ ID NO: 19066 - RNA, 20 nt, Artificial Sequence
  targeting sequence with CTCN PAM
ggaggcugaggugggaggau

SEQ ID NO: 19067 - RNA, 20 nt, Artificial Sequence
  targeting sequence with CTCN PAM
ugaguagcugggacugcagg

SEQ ID NO: 19068 - RNA, 20 nt, Artificial Sequence
  targeting sequence with CTCN PAM
gccuccugaguagcugggac

SEQ ID NO: 19069 - RNA, 20 nt, Artificial Sequence
  targeting sequence with CTCN PAM
caccucagccuccugaguag

SEQ ID NO: 19070 - RNA, 20 nt, Artificial Sequence
  targeting sequence with CTCN PAM
agugauccucccaccucagc

SEQ ID NO: 19071 - RNA, 20 nt, Artificial Sequence
  targeting sequence with CTCN PAM
ggcucaagugauccucccac

SEQ ID NO: 19072 - RNA, 20 nt, Artificial Sequence
  targeting sequence with CTCN PAM
cgggcucaagugauccuccc

SEQ ID NO: 19073 - RNA, 20 nt, Artificial Sequence
  targeting sequence with CTCN PAM
cugcagccuugaccucucgg

SEQ ID NO: 19074 - RNA, 20 nt, Artificial Sequence
  targeting sequence with CTCN PAM
gcucacugcagccuugaccu

SEQ ID NO: 19075 - RNA, 20 nt, Artificial Sequence
  targeting sequence with CTCN PAM
agucugggugacagagcaag

SEQ ID NO: 19076 - RNA, 20 nt, Artificial Sequence
  targeting sequence with CTCN PAM
gucacccagacuggagggua

SEQ ID NO: 19077 - RNA, 20 nt, Artificial Sequence
  targeting sequence with CTCN PAM
aacaaacagaaaaacccaca

SEQ ID NO: 19078 - RNA, 20 nt, Artificial Sequence
  targeting sequence with CTCN PAM
uguuuuuguuuguggguuuu

SEQ ID NO: 19079 - RNA, 20 nt, Artificial Sequence
  targeting sequence with CTCN PAM
cuaguuaguagugagguuua

SEQ ID NO: 19080 - RNA, 20 nt, Artificial Sequence
  targeting sequence with CTCN PAM
cuacuaacuagggagucacu

SEQ ID NO: 19081 - RNA, 20 nt, Artificial Sequence
  targeting sequence with CTCN PAM
uggggucaagcaauuugccc

SEQ ID NO: 19082 - RNA, 20 nt, Artificial Sequence
  targeting sequence with CTCN PAM
acuaaaaauacaaaaaaaau

SEQ ID NO: 19083 - RNA, 20 nt, Artificial Sequence
  targeting sequence with CTCN PAM
caaguagcugggauuacagg

SEQ ID NO: 19084 - RNA, 20 nt, Artificial Sequence
  targeting sequence with CTCN PAM
gccucccaaguagcugggau

SEQ ID NO: 19085 - RNA, 20 nt, Artificial Sequence
  targeting sequence with CTCN PAM
ccucagccucccaaguagcu

SEQ ID NO: 19086 - RNA, 20 nt, Artificial Sequence
  targeting sequence with CTCN PAM
caccucagccucccaaguag

SEQ ID NO: 19087 - RNA, 20 nt, Artificial Sequence
  targeting sequence with CTCN PAM
gccuuccaugcugaagcagu

SEQ ID NO: 19088 - RNA, 20 nt, Artificial Sequence
  targeting sequence with CTCN PAM
cugcaccucugccuuccaug

SEQ ID NO: 19089 - RNA, 20 nt, Artificial Sequence
  targeting sequence with CTCN PAM
gcucacugcaccucugccuu

SEQ ID NO: 19090 - RNA, 20 nt, Artificial Sequence
  targeting sequence with CTCN PAM
agccugggugacagaguaag

SEQ ID NO: 19091 - RNA, 20 nt, Artificial Sequence
  targeting sequence with CTCN PAM
gucacccaggcuggagugca

SEQ ID NO: 19092 - RNA, 20 nt, Artificial Sequence
  targeting sequence with CTCN PAM
aagagaagacaaaaaaauuc

SEQ ID NO: 19093 - RNA, 20 nt, Artificial Sequence
  targeting sequence with CTCN PAM
uugagacaaggucuuacucu

SEQ ID NO: 19094 - RNA, 20 nt, Artificial Sequence
  targeting sequence with CTCN PAM
auuuuagaauuuagacagga

SEQ ID NO: 19095 - RNA, 20 nt, Artificial Sequence
  targeting sequence with CTCN PAM
aucuucucauuaaauauuaa

SEQ ID NO: 19096 - RNA, 20 nt, Artificial Sequence
  targeting sequence with CTCN PAM
uuaaauauuaacaccaagcc

SEQ ID NO: 19097 - RNA, 20 nt, Artificial Sequence
  targeting sequence with CTCN PAM
ccuacuguuuggcuuggugu

SEQ ID NO: 19098 - RNA, 20 nt, Artificial Sequence
  targeting sequence with CTCN PAM
gcuuuaaggaauuuuaaccc

SEQ ID NO: 19099 - RNA, 20 nt, Artificial Sequence
  targeting sequence with CTCN PAM
ccagacacaaaucggggcag

SEQ ID NO: 19100 - RNA, 20 nt, Artificial Sequence
  targeting sequence with CTCN PAM
agacacaaaucggggcagag

SEQ ID NO: 19101 - RNA, 20 nt, Artificial Sequence
  targeting sequence with CTCN PAM
gccccgauuugugucuggag

SEQ ID NO: 19102 - RNA, 20 nt, Artificial Sequence
  targeting sequence with CTCN PAM
ucugccccgauuugugucug

SEQ ID NO: 19103 - RNA, 20 nt, Artificial Sequence
  targeting sequence with CTCN PAM
cacccacccaccaucuccuc

SEQ ID NO: 19104 - RNA, 20 nt, Artificial Sequence
  targeting sequence with CTCN PAM
cuuaaugauggggacacauc

SEQ ID NO: 19105 - RNA, 20 nt, Artificial Sequence
  targeting sequence with CTCN PAM
agauguguccccaucauuaa

SEQ ID NO: 19106 - RNA, 20 nt, Artificial Sequence
  targeting sequence with CTCN PAM
uuucucaagaugugucccca

SEQ ID NO: 19107 - RNA, 20 nt, Artificial Sequence
  targeting sequence with CTCN PAM
gcuuccaagcagcugggauu

SEQ ID NO: 19108 - RNA, 20 nt, Artificial Sequence
  targeting sequence with CTCN PAM
cgguuucaagcaauugucgu

SEQ ID NO: 19109 - RNA, 20 nt, Artificial Sequence
  targeting sequence with CTCN PAM
gccucacgguuucaagcaau

SEQ ID NO: 19110 - RNA, 20 nt, Artificial Sequence
  targeting sequence with CTCN PAM
cugaaaccucugccucacgg

SEQ ID NO: 19111 - RNA, 20 nt, Artificial Sequence
  targeting sequence with CTCN PAM
gcucacugaaaccucugccu

SEQ ID NO: 19112 - RNA, 20 nt, Artificial Sequence
  targeting sequence with CTCN PAM
agccugggcaagagugagac

SEQ ID NO: 19113 - RNA, 20 nt, Artificial Sequence
  targeting sequence with CTCN PAM
ugcccaggcuggagugcagu

SEQ ID NO: 19114 - RNA, 20 nt, Artificial Sequence
  targeting sequence with CTCN PAM
cucuugcccaggcuggagug

SEQ ID NO: 19115 - RNA, 20 nt, Artificial Sequence
  targeting sequence with CTCN PAM
aucucaaaaaaacaaaacaa

SEQ ID NO: 19116 - RNA, 20 nt, Artificial Sequence
  targeting sequence with CTCN PAM
aaaaaacaaaacaaaacaaa

SEQ ID NO: 19117 - RNA, 20 nt, Artificial Sequence
  targeting sequence with CTCN PAM
gcuuggauuacaaguagcau

SEQ ID NO: 19118 - RNA, 20 nt, Artificial Sequence
  targeting sequence with CTCN PAM
ugcuacuuguaauccaagcg

SEQ ID NO: 19119 - RNA, 20 nt, Artificial Sequence
  targeting sequence with CTCN PAM
agguccuuccuaaauuguua

SEQ ID NO: 19120 - RNA, 20 nt, Artificial Sequence
  targeting sequence with CTCN PAM
uuggguuguaacaauuuagg

SEQ ID NO: 19121 - RNA, 20 nt, Artificial Sequence
  targeting sequence with CTCN PAM
ugccauauuuaaguguccag

SEQ ID NO: 19122 - RNA, 20 nt, Artificial Sequence
  targeting sequence with CTCN PAM
gaucuaggaaguugacuacu

SEQ ID NO: 19123 - RNA, 20 nt, Artificial Sequence
  targeting sequence with CTCN PAM
ucucugaucuaggaaguuga

SEQ ID NO: 19124 - RNA, 20 nt, Artificial Sequence
  targeting sequence with CTCN PAM
cauucaucaguaauuugaca

SEQ ID NO: 19125 - RNA, 20 nt, Artificial Sequence
  targeting sequence with CTCN PAM
cccaggcucccauucaucag

SEQ ID NO: 19126 - RNA, 20 nt, Artificial Sequence
  targeting sequence with CTCN PAM
uuggguguggcucaaaaguu

SEQ ID NO: 19127 - RNA, 20 nt, Artificial Sequence
  targeting sequence with CTCN PAM
aaaguuuggagccaucucug

SEQ ID NO: 19128 - RNA, 20 nt, Artificial Sequence
  targeting sequence with CTCN PAM
aaacuuuugagccacaccca

SEQ ID NO: 19129 - RNA, 20 nt, Artificial Sequence
  targeting sequence with CTCN PAM
gagaaccaauggugcuuccc

SEQ ID NO: 19130 - RNA, 20 nt, Artificial Sequence
  targeting sequence with CTCN PAM
gagauggcuccaaacuuuug

SEQ ID NO: 19131 - RNA, 20 nt, Artificial Sequence
  targeting sequence with CTCN PAM
acaaguuucuucagcuaucc

SEQ ID NO: 19132 - RNA, 20 nt, Artificial Sequence
  targeting sequence with CTCN PAM
auaccugcuccacaaguuuc

SEQ ID NO: 19133 - RNA, 20 nt, Artificial Sequence
  targeting sequence with CTCN PAM
caauaccugcuccacaaguu

SEQ ID NO: 19134 - RNA, 20 nt, Artificial Sequence
  targeting sequence with CTCN PAM
cauaguugccuguggguguu

SEQ ID NO: 19135 - RNA, 20 nt, Artificial Sequence
  targeting sequence with CTCN PAM
gguaugcauuugggaaauag

SEQ ID NO: 19136 - RNA, 20 nt, Artificial Sequence
  targeting sequence with CTCN PAM
ggucaaacacuggcagaagc

SEQ ID NO: 19137 - RNA, 20 nt, Artificial Sequence
  targeting sequence with CTCN PAM
acucuggucaaacacuggca

SEQ ID NO: 19138 - RNA, 20 nt, Artificial Sequence
  targeting sequence with CTCN PAM
cuacucuggucaaacacugg

SEQ ID NO: 19139 - RNA, 20 nt, Artificial Sequence
  targeting sequence with CTCN PAM
cuaccccaacugugucucuc

SEQ ID NO: 19140 - RNA, 20 nt, Artificial Sequence
  targeting sequence with CTCN PAM
caccgcaagucauacucccu

SEQ ID NO: 19141 - RNA, 20 nt, Artificial Sequence
  targeting sequence with CTCN PAM
ccaauucagcuaggaaccua

SEQ ID NO: 19142 - RNA, 20 nt, Artificial Sequence
  targeting sequence with CTCN PAM
ccccaauucagcuaggaacc

SEQ ID NO: 19143 - RNA, 20 nt, Artificial Sequence
  targeting sequence with CTCN PAM
uuaccuuuuguuaccuuuuu

SEQ ID NO: 19144 - RNA, 20 nt, Artificial Sequence
  targeting sequence with CTCN PAM
aguuuuuauuuauuuccugu

SEQ ID NO: 19145 - RNA, 20 nt, Artificial Sequence
  targeting sequence with CTCN PAM
auuuuuucuaggggaauaca

SEQ ID NO: 19146 - RNA, 20 nt, Artificial Sequence
  targeting sequence with CTCN PAM
uccauuuuuucuaggggaau

SEQ ID NO: 19147 - RNA, 20 nt, Artificial Sequence
  targeting sequence with CTCN PAM
uccuccauuuuuucuagggg

SEQ ID NO: 19148 - RNA, 20 nt, Artificial Sequence
  targeting sequence with CTCN PAM
cuccuccuccauuuuuucua

SEQ ID NO: 19149 - RNA, 20 nt, Artificial Sequence
  targeting sequence with CTCN PAM
acaaaugcucccuccuccuc

SEQ ID NO: 19150 - RNA, 20 nt, Artificial Sequence
  targeting sequence with CTCN PAM
uacucuaaaccaaacaucac

SEQ ID NO: 19151 - RNA, 20 nt, Artificial Sequence
  targeting sequence with CTCN PAM
aaaccaaacaucacacuagg

SEQ ID NO: 19152 - RNA, 20 nt, Artificial Sequence
  targeting sequence with CTCN PAM
uuuaauaacuucaacaacca

SEQ ID NO: 19153 - RNA, 20 nt, Artificial Sequence
  targeting sequence with CTCN PAM
guaaaaauguaaugauauuu

SEQ ID NO: 19154 - RNA, 20 nt, Artificial Sequence
  targeting sequence with CTCN PAM
cucuguaaaaauguaaugau

SEQ ID NO: 19155 - RNA, 20 nt, Artificial Sequence
  targeting sequence with CTCN PAM
guuucucccucuguaaaaau

SEQ ID NO: 19156 - RNA, 20 nt, Artificial Sequence
  targeting sequence with CTCN PAM
gaugaguuauguaaucuacu

SEQ ID NO: 19157 - RNA, 20 nt, Artificial Sequence
  targeting sequence with CTCN PAM
ucugagccucaguuucuccc

SEQ ID NO: 19158 - RNA, 20 nt, Artificial Sequence
  targeting sequence with CTCN PAM
gagcuggcaagcaaauucaa

SEQ ID NO: 19159 - RNA, 20 nt, Artificial Sequence
  targeting sequence with CTCN PAM
gaguagauuacauaacucau

SEQ ID NO: 19160 - RNA, 20 nt, Artificial Sequence
  targeting sequence with CTCN PAM
aaggaauaaggguuaauuaa

SEQ ID NO: 19161 - RNA, 20 nt, Artificial Sequence
  targeting sequence with CTCN PAM
auuccucuuuagcggcuaaa

SEQ ID NO: 19162 - RNA, 20 nt, Artificial Sequence
  targeting sequence with CTCN PAM
uuagcggcuaaacgcuaaac

SEQ ID NO: 19163 - RNA, 20 nt, Artificial Sequence
  targeting sequence with CTCN PAM
ucccaguuuagcguuuagcc

SEQ ID NO: 19164 - RNA, 20 nt, Artificial Sequence
  targeting sequence with CTCN PAM
cccauaaaucucuuuuaugg

SEQ ID NO: 19165 - RNA, 20 nt, Artificial Sequence
  targeting sequence with CTCN PAM
uuuauggaagauuguauacg

SEQ ID NO: 19166 - RNA, 20 nt, Artificial Sequence
  targeting sequence with CTCN PAM
cauaaaugaagggcuaauuu

SEQ ID NO: 19167 - RNA, 20 nt, Artificial Sequence
  targeting sequence with CTCN PAM
uaaaugaagggcuaauuuga

SEQ ID NO: 19168 - RNA, 20 nt, Artificial Sequence
  targeting sequence with CTCN PAM
guuucuauuucaaacuuauu

SEQ ID NO: 19169 - RNA, 20 nt, Artificial Sequence
  targeting sequence with CTCN PAM
agacgauauguaggcuagau

SEQ ID NO: 19170 - RNA, 20 nt, Artificial Sequence
  targeting sequence with CTCN PAM
gaucacuuuucaguugacag

SEQ ID NO: 19171 - RNA, 20 nt, Artificial Sequence
  targeting sequence with CTCN PAM
cacauagaauaaaggggcua

SEQ ID NO: 19172 - RNA, 20 nt, Artificial Sequence
  targeting sequence with CTCN PAM
gagcauacaucugagcauac

SEQ ID NO: 19173 - RNA, 20 nt, Artificial Sequence
  targeting sequence with CTCN PAM
gagguaccuguuuuagcccc

SEQ ID NO: 19174 - RNA, 20 nt, Artificial Sequence
  targeting sequence with CTCN PAM
gauguaugcucagagguacc

SEQ ID NO: 19175 - RNA, 20 nt, Artificial Sequence
  targeting sequence with CTCN PAM
aacagccugugccuaauugg

SEQ ID NO: 19176 - RNA, 20 nt, Artificial Sequence
  targeting sequence with CTCN PAM
gggugacugucuccuguauu

SEQ ID NO: 19177 - RNA, 20 nt, Artificial Sequence
  targeting sequence with CTCN PAM
uguauuuuugcucuuaugac

SEQ ID NO: 19178 - RNA, 20 nt, Artificial Sequence
  targeting sequence with CTCN PAM
uaugacucagugcaauuuaa

SEQ ID NO: 19179 - RNA, 20 nt, Artificial Sequence
  targeting sequence with CTCN PAM
gugcaauuuaaaauaucccc

SEQ ID NO: 19180 - RNA, 20 nt, Artificial Sequence
  targeting sequence with CTCN PAM
gaagccgauuuccaauggac

SEQ ID NO: 19181 - RNA, 20 nt, Artificial Sequence
  targeting sequence with CTCN PAM
ucaacaccugggggguuuuu

SEQ ID NO: 19182 - RNA, 20 nt, Artificial Sequence
  targeting sequence with CTCN PAM
guaggauuccaggccagauc

SEQ ID NO: 19183 - RNA, 20 nt, Artificial Sequence
  targeting sequence with CTCN PAM
auuaauguuuuccuagcucu

SEQ ID NO: 19184 - RNA, 20 nt, Artificial Sequence
  targeting sequence with CTCN PAM
cucuuauuuucaguacauuu

SEQ ID NO: 19185 - RNA, 20 nt, Artificial Sequence
  targeting sequence with CTCN PAM
cuuauuuucaguacauuuug

SEQ ID NO: 19186 - RNA, 20 nt, Artificial Sequence
  targeting sequence with CTCN PAM
uauuuucaguacauuuugcc

SEQ ID NO: 19187 - RNA, 20 nt, Artificial Sequence
  targeting sequence with CTCN PAM
cuacaggaacaaaacuaauc

SEQ ID NO: 19188 - RNA, 20 nt, Artificial Sequence
  targeting sequence with CTCN PAM
guuucuagcagcaaauuaaa

SEQ ID NO: 19189 - RNA, 20 nt, Artificial Sequence
  targeting sequence with CTCN PAM
gaaagauaaagugacuuuug

SEQ ID NO: 19190 - RNA, 20 nt, Artificial Sequence
  targeting sequence with CTCN PAM
acuguaaauaagauuaaucu

SEQ ID NO: 19191 - RNA, 20 nt, Artificial Sequence
  targeting sequence with CTCN PAM
ucacuuaaaaaaauuucuaa

SEQ ID NO: 19192 - RNA, 20 nt, Artificial Sequence
  targeting sequence with CTCN PAM
ugccuuccccaaauacauga

SEQ ID NO: 19193 - RNA, 20 nt, Artificial Sequence
  targeting sequence with CTCN PAM
cucauagcugaaugcacaau

SEQ ID NO: 19194 - RNA, 20 nt, Artificial Sequence
  targeting sequence with CTCN PAM
uagcugaaugcacaauggua

SEQ ID NO: 19195 - RNA, 20 nt, Artificial Sequence
  targeting sequence with CTCN PAM
auaccuagucacuagucaaa

SEQ ID NO: 19196 - RNA, 20 nt, Artificial Sequence
  targeting sequence with CTCN PAM
gccuuugacuagugacuagg

SEQ ID NO: 19197 - RNA, 20 nt, Artificial Sequence
  targeting sequence with CTCN PAM
accucagccuuugacuagug

SEQ ID NO: 19198 - RNA, 20 nt, Artificial Sequence
  targeting sequence with CTCN PAM
gcuacaauggcuuccugggc

SEQ ID NO: 19199 - RNA, 20 nt, Artificial Sequence
  targeting sequence with CTCN PAM
ucacccacauaauuguacca

SEQ ID NO: 19200 - RNA, 20 nt, Artificial Sequence
  targeting sequence with CTCN PAM
cuucacccacauaauuguac

SEQ ID NO: 19201 - RNA, 20 nt, Artificial Sequence
  targeting sequence with CTCN PAM
cucuucacccacauaauugu

SEQ ID NO: 19202 - RNA, 20 nt, Artificial Sequence
  targeting sequence with CTCN PAM
cucucuucacccacauaauu

SEQ ID NO: 19203 - RNA, 20 nt, Artificial Sequence
  targeting sequence with CTCN PAM
auaggcuuuggaaugcuucu

SEQ ID NO: 19204 - RNA, 20 nt, Artificial Sequence
  targeting sequence with CTCN PAM
ggaauaaucagaagcauucc

SEQ ID NO: 19205 - RNA, 20 nt, Artificial Sequence
  targeting sequence with CTCN PAM
aagugaagauaguugcccaa

SEQ ID NO: 19206 - RNA, 20 nt, Artificial Sequence
  targeting sequence with CTCN PAM
cuuggguagacagcaaugga

SEQ ID NO: 19207 - RNA, 20 nt, Artificial Sequence
  targeting sequence with CTCN PAM
auaauguccuucgcuuaaug

SEQ ID NO: 19208 - RNA, 20 nt, Artificial Sequence
  targeting sequence with CTCN PAM
gaaucccuucucaauaaugu

SEQ ID NO: 19209 - RNA, 20 nt, Artificial Sequence
  targeting sequence with CTCN PAM
ggaaaguuuccuaggccagu

SEQ ID NO: 19210 - RNA, 20 nt, Artificial Sequence
  targeting sequence with CTCN PAM
acuuuuaguaaacauuuacu

SEQ ID NO: 19211 - RNA, 20 nt, Artificial Sequence
  targeting sequence with CTCN PAM
gaagcauuagaugcauuggc

SEQ ID NO: 19212 - RNA, 20 nt, Artificial Sequence
  targeting sequence with CTCN PAM
cugaagcauuagaugcauug

SEQ ID NO: 19213 - RNA, 20 nt, Artificial Sequence
  targeting sequence with CTCN PAM
aucccgaaaucuauaugguu

SEQ ID NO: 19214 - RNA, 20 nt, Artificial Sequence
  targeting sequence with CTCN PAM
guaagugguaaagccaggau

SEQ ID NO: 19215 - RNA, 20 nt, Artificial Sequence
  targeting sequence with CTCN PAM
ggcaacuuuuaaaaccccac

SEQ ID NO: 19216 - RNA, 20 nt, Artificial Sequence
  targeting sequence with CTCN PAM
gugggguuuuaaaaguugcc

SEQ ID NO: 19217 - RNA, 20 nt, Artificial Sequence
  targeting sequence with CTCN PAM
ucuuuaaaaugggaauaaua

SEQ ID NO: 19218 - RNA, 20 nt, Artificial Sequence
  targeting sequence with CTCN PAM
caguaggcccuacagguaaa

SEQ ID NO: 19219 - RNA, 20 nt, Artificial Sequence
  targeting sequence with CTCN PAM
ugugaugugccuagugcuag

SEQ ID NO: 19220 - RNA, 20 nt, Artificial Sequence
  targeting sequence with CTCN PAM
cucucaucaacucagauacu

SEQ ID NO: 19221 - RNA, 20 nt, Artificial Sequence
  targeting sequence with CTCN PAM
caucaacucagauacuagua

SEQ ID NO: 19222 - RNA, 20 nt, Artificial Sequence
  targeting sequence with CTCN PAM
ucaacucagauacuaguaaa

SEQ ID NO: 19223 - RNA, 20 nt, Artificial Sequence
  targeting sequence with CTCN PAM
gauacuaguaaaauaaacua

SEQ ID NO: 19224 - RNA, 20 nt, Artificial Sequence
  targeting sequence with CTCN PAM
ggauacauuuuuuuucuacg

SEQ ID NO: 19225 - RNA, 20 nt, Artificial Sequence
  targeting sequence with CTCN PAM
guuguaggcuuugcuuuuug

SEQ ID NO: 19226 - RNA, 20 nt, Artificial Sequence
  targeting sequence with CTCN PAM
uuacuaauucuacuucuacu

SEQ ID NO: 19227 - RNA, 20 nt, Artificial Sequence
  targeting sequence with CTCN PAM
cuuuacuaauucuacuucua

SEQ ID NO: 19228 - RNA, 20 nt, Artificial Sequence
  targeting sequence with CTCN PAM
cuaacaguguggagaagaaa

SEQ ID NO: 19229 - RNA, 20 nt, Artificial Sequence
  targeting sequence with CTCN PAM
acacuguuagugagcuaccc

SEQ ID NO: 19230 - RNA, 20 nt, Artificial Sequence
  targeting sequence with CTCN PAM
uuuccauuucuucuccacac

SEQ ID NO: 19231 - RNA, 20 nt, Artificial Sequence
  targeting sequence with CTCN PAM
acaguaaauggcccuaggcu

SEQ ID NO: 19232 - RNA, 20 nt, Artificial Sequence
  targeting sequence with CTCN PAM
gguuagugaagcuguccauu

SEQ ID NO: 19233 - RNA, 20 nt, Artificial Sequence
  targeting sequence with CTCN PAM
cagguuagugaagcugucca

SEQ ID NO: 19234 - RNA, 20 nt, Artificial Sequence
  targeting sequence with CTCN PAM
aagcugaauacuaccauauc

SEQ ID NO: 19235 - RNA, 20 nt, Artificial Sequence
  targeting sequence with CTCN PAM
uuccauuaaguuagauucag

SEQ ID NO: 19236 - RNA, 20 nt, Artificial Sequence
  targeting sequence with CTCN PAM
gccuucuuuuacaaaguaca

SEQ ID NO: 19237 - RNA, 20 nt, Artificial Sequence
  targeting sequence with CTCN PAM
ugucuguaaucccagcauug

SEQ ID NO: 19238 - RNA, 20 nt, Artificial Sequence
  targeting sequence with CTCN PAM
cacaaugcugggauuacaga

SEQ ID NO: 19239 - RNA, 20 nt, Artificial Sequence
  targeting sequence with CTCN PAM
gccucccacaaugcugggau

SEQ ID NO: 19240 - RNA, 20 nt, Artificial Sequence
  targeting sequence with CTCN PAM
ggugauccacccaccucagc

SEQ ID NO: 19241 - RNA, 20 nt, Artificial Sequence
  targeting sequence with CTCN PAM
ugaccucaggugauccaccc

SEQ ID NO: 19242 - RNA, 20 nt, Artificial Sequence
  targeting sequence with CTCN PAM
aacuccugaccucaggugau

SEQ ID NO: 19243 - RNA, 20 nt, Artificial Sequence
  targeting sequence with CTCN PAM
cuuaaaaauacaaaaaagua

SEQ ID NO: 19244 - RNA, 20 nt, Artificial Sequence
  targeting sequence with CTCN PAM
uaaaaauacaaaaaaguagc

SEQ ID NO: 19245 - RNA, 20 nt, Artificial Sequence
  targeting sequence with CTCN PAM
ccaguagcugggauuacagg

SEQ ID NO: 19246 - RNA, 20 nt, Artificial Sequence
  targeting sequence with CTCN PAM
ugccuuagccuccccaguag

SEQ ID NO: 19247 - RNA, 20 nt, Artificial Sequence
  targeting sequence with CTCN PAM
uggguucaagugauucuccu

SEQ ID NO: 19248 - RNA, 20 nt, Artificial Sequence
  targeting sequence with CTCN PAM
gccuccuggguucaagugau

SEQ ID NO: 19249 - RNA, 20 nt, Artificial Sequence
  targeting sequence with CTCN PAM
agccugggcaacaagaguga

SEQ ID NO: 19250 - RNA, 20 nt, Artificial Sequence
  targeting sequence with CTCN PAM
uguugcccaggcuggagugc

SEQ ID NO: 19251 - RNA, 20 nt, Artificial Sequence
  targeting sequence with CTCN PAM
gucuccaaaaacaaagaaca

SEQ ID NO: 19252 - RNA, 20 nt, Artificial Sequence
  targeting sequence with CTCN PAM
aaaaacaaagaacaaaaaaa

SEQ ID NO: 19253 - RNA, 20 nt, Artificial Sequence
  targeting sequence with CTCN PAM
ggaggcugagguggaagcac

SEQ ID NO: 19254 - RNA, 20 nt, Artificial Sequence
  targeting sequence with CTCN PAM
ugaguagcugggacugcagg

SEQ ID NO: 19255 - RNA, 20 nt, Artificial Sequence
  targeting sequence with CTCN PAM
gccuccugaguagcugggac

SEQ ID NO: 19256 - RNA, 20 nt, Artificial Sequence
  targeting sequence with CTCN PAM
agcagugcuuccaccucagc

SEQ ID NO: 19257 - RNA, 20 nt, Artificial Sequence
  targeting sequence with CTCN PAM
ugggcucaagcagugcuucc

SEQ ID NO: 19258 - RNA, 20 nt, Artificial Sequence
  targeting sequence with CTCN PAM
uuauuuuuuaauuuuuuuuu

SEQ ID NO: 19259 - RNA, 20 nt, Artificial Sequence
  targeting sequence with CTCN PAM
aaaaaaaaauuaaaaaauaa

SEQ ID NO: 19260 - RNA, 20 nt, Artificial Sequence
  targeting sequence with CTCN PAM
gucucaaaaaaaaaauuaaa

SEQ ID NO: 19261 - RNA, 20 nt, Artificial Sequence
  targeting sequence with CTCN PAM
cucugucacccaggcuggag

SEQ ID NO: 19262 - RNA, 20 nt, Artificial Sequence
  targeting sequence with CTCN PAM
gucacccaggcuggagugca

SEQ ID NO: 19263 - RNA, 20 nt, Artificial Sequence
  targeting sequence with CTCN PAM
agccugggugacagagugag

SEQ ID NO: 19264 - RNA, 20 nt, Artificial Sequence
  targeting sequence with CTCN PAM
gcucacugcaaccuccaccu

SEQ ID NO: 19265 - RNA, 20 nt, Artificial Sequence
  targeting sequence with CTCN PAM
cugcaaccuccaccucucag

SEQ ID NO: 19266 - RNA, 20 nt, Artificial Sequence
  targeting sequence with CTCN PAM
accucucagauucaagcaau

SEQ ID NO: 19267 - RNA, 20 nt, Artificial Sequence
  targeting sequence with CTCN PAM
cagauucaagcaauucuccu

SEQ ID NO: 19268 - RNA, 20 nt, Artificial Sequence
  targeting sequence with CTCN PAM
gauucaagcaauucuccugc

SEQ ID NO: 19269 - RNA, 20 nt, Artificial Sequence
  targeting sequence with CTCN PAM
ugccucagccucccccguaa

SEQ ID NO: 19270 - RNA, 20 nt, Artificial Sequence
  targeting sequence with CTCN PAM
gccucccccguaacugggac

SEQ ID NO: 19271 - RNA, 20 nt, Artificial Sequence
  targeting sequence with CTCN PAM
cccguaacugggacuacagg

SEQ ID NO: 19272 - RNA, 20 nt, Artificial Sequence
  targeting sequence with CTCN PAM
acuaaaaauacaaaaaaaau

SEQ ID NO: 19273 - RNA, 20 nt, Artificial Sequence
  targeting sequence with CTCN PAM
aucuucugaccuugugaucc

SEQ ID NO: 19274 - RNA, 20 nt, Artificial Sequence
  targeting sequence with CTCN PAM
gccucccaaagugcuacgau

SEQ ID NO: 19275 - RNA, 20 nt, Artificial Sequence
  targeting sequence with CTCN PAM
caaagugcuacgauuacagg

SEQ ID NO: 19276 - RNA, 20 nt, Artificial Sequence
  targeting sequence with CTCN PAM
cgccuguaaucguagcacuu

SEQ ID NO: 19277 - RNA, 20 nt, Artificial Sequence
  targeting sequence with CTCN PAM
uaaaaaaaaaaaaaaaaaaa

SEQ ID NO: 19278 - RNA, 20 nt, Artificial Sequence
  targeting sequence with CTCN PAM
aaaaguucuaacagaaaagg

SEQ ID NO: 19279 - RNA, 20 nt, Artificial Sequence
  targeting sequence with CTCN PAM
ugcacauuaucuguuugaaa

SEQ ID NO: 19280 - RNA, 20 nt, Artificial Sequence
  targeting sequence with CTCN PAM
uuagaaaugauucccuauaa

SEQ ID NO: 19281 - RNA, 20 nt, Artificial Sequence
  targeting sequence with CTCN PAM
acauauccuuagacuucaaa

SEQ ID NO: 19282 - RNA, 20 nt, Artificial Sequence
  targeting sequence with CTCN PAM
uaaugaaaugugaacugguu

SEQ ID NO: 19283 - RNA, 20 nt, Artificial Sequence
  targeting sequence with CTCN PAM
uuuccucuuaaugaaaugug

SEQ ID NO: 19284 - RNA, 20 nt, Artificial Sequence
  targeting sequence with CTCN PAM
guaagcccaggaaauaggau

SEQ ID NO: 19285 - RNA, 20 nt, Artificial Sequence
  targeting sequence with CTCN PAM
aaauuuuccauuuuacuuau

SEQ ID NO: 19286 - RNA, 20 nt, Artificial Sequence
  targeting sequence with CTCN PAM
gcaaacugauuuuaaaucag

SEQ ID NO: 19287 - RNA, 20 nt, Artificial Sequence
  targeting sequence with CTCN PAM
gauuuaaaaucaguuugcug

SEQ ID NO: 19288 - RNA, 20 nt, Artificial Sequence
  targeting sequence with CTCN PAM
acugggcagauauacuuagg

SEQ ID NO: 19289 - RNA, 20 nt, Artificial Sequence
  targeting sequence with CTCN PAM
cuguauuuuagguauugaag

SEQ ID NO: 19290 - RNA, 20 nt, Artificial Sequence
  targeting sequence with CTCN PAM
cacucuuccuuuuuuuucuc

SEQ ID NO: 19291 - RNA, 20 nt, Artificial Sequence
  targeting sequence with CTCN PAM
uccuuuuuuuucucacucuu

SEQ ID NO: 19292 - RNA, 20 nt, Artificial Sequence
  targeting sequence with CTCN PAM
cucuuacacaggagcuagga

SEQ ID NO: 19293 - RNA, 20 nt, Artificial Sequence
  targeting sequence with CTCN PAM
uacacaggagcuaggacuac

SEQ ID NO: 19294 - RNA, 20 nt, Artificial Sequence
  targeting sequence with CTCN PAM
uguguaagagugagaaaaaa

SEQ ID NO: 19295 - RNA, 20 nt, Artificial Sequence
  targeting sequence with CTCN PAM
guuacuguaauugucaucuu

SEQ ID NO: 19296 - RNA, 20 nt, Artificial Sequence
  targeting sequence with CTCN PAM
gaaguucuuugucuuuucug

SEQ ID NO: 19297 - RNA, 20 nt, Artificial Sequence
  targeting sequence with CTCN PAM
cuggccaggcgcgguggcuc

SEQ ID NO: 19298 - RNA, 20 nt, Artificial Sequence
  targeting sequence with CTCN PAM
ggccaggcgcgguggcucac

SEQ ID NO: 19299 - RNA, 20 nt, Artificial Sequence
  targeting sequence with CTCN PAM
cgccuguaaucccagcacuu

SEQ ID NO: 19300 - RNA, 20 nt, Artificial Sequence
  targeting sequence with CTCN PAM
caaagugcugggauuacagg

SEQ ID NO: 19301 - RNA, 20 nt, Artificial Sequence
  targeting sequence with CTCN PAM
gccucccaaagugcugggau

SEQ ID NO: 19302 - RNA, 20 nt, Artificial Sequence
  targeting sequence with CTCN PAM
ugauuccccugccucggccu

SEQ ID NO: 19303 - RNA, 20 nt, Artificial Sequence
  targeting sequence with CTCN PAM
acuaaaaauacaaaaaacac

SEQ ID NO: 19304 - RNA, 20 nt, Artificial Sequence
  targeting sequence with CTCN PAM
caaguagcugggacugcagg

SEQ ID NO: 19305 - RNA, 20 nt, Artificial Sequence
  targeting sequence with CTCN PAM
gccucccaaguagcugggac

SEQ ID NO: 19306 - RNA, 20 nt, Artificial Sequence
  targeting sequence with CTCN PAM
ugccucagccucccaaguag

SEQ ID NO: 19307 - RNA, 20 nt, Artificial Sequence
  targeting sequence with CTCN PAM
cagguucaagcgauucuccu

SEQ ID NO: 19308 - RNA, 20 nt, Artificial Sequence
  targeting sequence with CTCN PAM
agccugggcaacagagacuc

SEQ ID NO: 19309 - RNA, 20 nt, Artificial Sequence
  targeting sequence with CTCN PAM
guugcccaggcuagagugca

SEQ ID NO: 19310 - RNA, 20 nt, Artificial Sequence
  targeting sequence with CTCN PAM
aucucaaacaaacaaacaaa

SEQ ID NO: 19311 - RNA, 20 nt, Artificial Sequence
  targeting sequence with CTCN PAM
aacaaacaaacaaacaaaca

SEQ ID NO: 19312 - RNA, 20 nt, Artificial Sequence
  targeting sequence with CTCN PAM
cuaucugcucugugcuugaa

SEQ ID NO: 19313 - RNA, 20 nt, Artificial Sequence
  targeting sequence with CTCN PAM
aucugcucugugcuugaagu

SEQ ID NO: 19314 - RNA, 20 nt, Artificial Sequence
  targeting sequence with CTCN PAM
gugcuugaagugaaacguac

SEQ ID NO: 19315 - RNA, 20 nt, Artificial Sequence
  targeting sequence with CTCN PAM
uucuaguucucuguacuucu

SEQ ID NO: 19316 - RNA, 20 nt, Artificial Sequence
  targeting sequence with CTCN PAM
guacuucuaaacuuucuaau

SEQ ID NO: 19317 - RNA, 20 nt, Artificial Sequence
  targeting sequence with CTCN PAM
caaugucaaguaaaaaauau

SEQ ID NO: 19318 - RNA, 20 nt, Artificial Sequence
  targeting sequence with CTCN PAM
gacuuaagcacucacaaugu

SEQ ID NO: 19319 - RNA, 20 nt, Artificial Sequence
  targeting sequence with CTCN PAM
uuacagcacccaccauauua

SEQ ID NO: 19320 - RNA, 20 nt, Artificial Sequence
  targeting sequence with CTCN PAM
auauaaaguaauaugguggg

SEQ ID NO: 19321 - RNA, 20 nt, Artificial Sequence
  targeting sequence with CTCN PAM
acuggcuuuuaucucaucgg

SEQ ID NO: 19322 - RNA, 20 nt, Artificial Sequence
  targeting sequence with CTCN PAM
ucggucuacuaaaaaguuuc

SEQ ID NO: 19323 - RNA, 20 nt, Artificial Sequence
  targeting sequence with CTCN PAM
acagaaacuuuuuaguagac

SEQ ID NO: 19324 - RNA, 20 nt, Artificial Sequence
  targeting sequence with CTCN PAM
aaauuacuaaauccaaagag

SEQ ID NO: 19325 - RNA, 20 nt, Artificial Sequence
  targeting sequence with CTCN PAM
uuggauuuaguaauuuggag

SEQ ID NO: 19326 - RNA, 20 nt, Artificial Sequence
  targeting sequence with CTCN PAM
ucuuauugaccuaucugcag

SEQ ID NO: 19327 - RNA, 20 nt, Artificial Sequence
  targeting sequence with CTCN PAM
uaugaagaauuuccauacuu

SEQ ID NO: 19328 - RNA, 20 nt, Artificial Sequence
  targeting sequence with CTCN PAM
cuagauuuuccucuucucuc

SEQ ID NO: 19329 - RNA, 20 nt, Artificial Sequence
  targeting sequence with CTCN PAM
agauuuuccucuucucucau

SEQ ID NO: 19330 - RNA, 20 nt, Artificial Sequence
  targeting sequence with CTCN PAM
ucucucauaggucaaucuuc

SEQ ID NO: 19331 - RNA, 20 nt, Artificial Sequence
  targeting sequence with CTCN PAM
cauaggucaaucuucuuccu

SEQ ID NO: 19332 - RNA, 20 nt, Artificial Sequence
  targeting sequence with CTCN PAM
uaggucaaucuucuuccuuu

SEQ ID NO: 19333 - RNA, 20 nt, Artificial Sequence
  targeting sequence with CTCN PAM
cuaauuacauuuucugccua

SEQ ID NO: 19334 - RNA, 20 nt, Artificial Sequence
  targeting sequence with CTCN PAM
uuaguauccuaugacucuaa

SEQ ID NO: 19335 - RNA, 20 nt, Artificial Sequence
  targeting sequence with CTCN PAM
aagagucucuagacucaaaa

SEQ ID NO: 19336 - RNA, 20 nt, Artificial Sequence
  targeting sequence with CTCN PAM
uagagucauaggauacuaag

SEQ ID NO: 19337 - RNA, 20 nt, Artificial Sequence
  targeting sequence with CTCN PAM
agacucaaaaaugucacuua

SEQ ID NO: 19338 - RNA, 20 nt, Artificial Sequence
  targeting sequence with CTCN PAM
aaaaugucacuuaccuauuc

SEQ ID NO: 19339 - RNA, 20 nt, Artificial Sequence
  targeting sequence with CTCN PAM
agcacuuucccacaaaaccu

SEQ ID NO: 19340 - RNA, 20 nt, Artificial Sequence
  targeting sequence with CTCN PAM
agcagcauuuacaucucagu

SEQ ID NO: 19341 - RNA, 20 nt, Artificial Sequence
  targeting sequence with CTCN PAM
guuaaugacaaaucuauucu

SEQ ID NO: 19342 - RNA, 20 nt, Artificial Sequence
  targeting sequence with CTCN PAM
uaguuacugauuucuuucau

SEQ ID NO: 19343 - RNA, 20 nt, Artificial Sequence
  targeting sequence with CTCN PAM
gacaauauaugaucaugguu

SEQ ID NO: 19344 - RNA, 20 nt, Artificial Sequence
  targeting sequence with CTCN PAM
gcuuaaaauucuucaaugaa

SEQ ID NO: 19345 - RNA, 20 nt, Artificial Sequence
  targeting sequence with CTCN PAM
aaaauauuuuccaauauauu

SEQ ID NO: 19346 - RNA, 20 nt, Artificial Sequence
  targeting sequence with CTCN PAM
ugacugcaaauggcaccaug

SEQ ID NO: 19347 - RNA, 20 nt, Artificial Sequence
  targeting sequence with CTCN PAM
aguugcuagcagugagugaa

SEQ ID NO: 19348 - RNA, 20 nt, Artificial Sequence
  targeting sequence with CTCN PAM
cugcuagcaacuggaggugg

SEQ ID NO: 19349 - RNA, 20 nt, Artificial Sequence
  targeting sequence with CTCN PAM
ggugauuagugucacaugca

SEQ ID NO: 19350 - RNA, 20 nt, Artificial Sequence
  targeting sequence with CTCN PAM
cuccaguaaacugcauaucu

SEQ ID NO: 19351 - RNA, 20 nt, Artificial Sequence
  targeting sequence with CTCN PAM
ccaguaaacugcauaucuca

SEQ ID NO: 19352 - RNA, 20 nt, Artificial Sequence
  targeting sequence with CTCN PAM
aguaaacugcauaucucagu

SEQ ID NO: 19353 - RNA, 20 nt, Artificial Sequence
  targeting sequence with CTCN PAM
guaaaaagcgaucucuugag

SEQ ID NO: 19354 - RNA, 20 nt, Artificial Sequence
  targeting sequence with CTCN PAM
ugagacuucucuauuauuuu

SEQ ID NO: 19355 - RNA, 20 nt, Artificial Sequence
  targeting sequence with CTCN PAM
agagaucgcuuuuuacugag

SEQ ID NO: 19356 - RNA, 20 nt, Artificial Sequence
  targeting sequence with CTCN PAM
auuauuuuucacuguguuua

SEQ ID NO: 19357 - RNA, 20 nt, Artificial Sequence
  targeting sequence with CTCN PAM
aauaauaccaugagaugcgu

SEQ ID NO: 19358 - RNA, 20 nt, Artificial Sequence
  targeting sequence with CTCN PAM
ugguauuauucgagguuuac

SEQ ID NO: 19359 - RNA, 20 nt, Artificial Sequence
  targeting sequence with CTCN PAM
cuucuuacgcaucucauggu

SEQ ID NO: 19360 - RNA, 20 nt, Artificial Sequence
  targeting sequence with CTCN PAM
caagaagcagagaaaauguc

SEQ ID NO: 19361 - RNA, 20 nt, Artificial Sequence
  targeting sequence with CTCN PAM
gcuucuugggagcacuucag

SEQ ID NO: 19362 - RNA, 20 nt, Artificial Sequence
  targeting sequence with CTCN PAM
uccuuaugauuuuaguaaca

SEQ ID NO: 19363 - RNA, 20 nt, Artificial Sequence
  targeting sequence with CTCN PAM
agcuuacuguauuguaagaa

SEQ ID NO: 19364 - RNA, 20 nt, Artificial Sequence
  targeting sequence with CTCN PAM
auucuuacaauacaguaagc

SEQ ID NO: 19365 - RNA, 20 nt, Artificial Sequence
  targeting sequence with CTCN PAM
ggucagcaauagacuguuag

SEQ ID NO: 19366 - RNA, 20 nt, Artificial Sequence
  targeting sequence with CTCN PAM
cccaaagcuuaacuaacagu

SEQ ID NO: 19367 - RNA, 20 nt, Artificial Sequence
  targeting sequence with CTCN PAM
cacacaaucaaagauccgug

SEQ ID NO: 19368 - RNA, 20 nt, Artificial Sequence
  targeting sequence with CTCN PAM
ugaucaaaguggggauuagg

SEQ ID NO: 19369 - RNA, 20 nt, Artificial Sequence
  targeting sequence with CTCN PAM
uuuuccuggcauacaacuac

SEQ ID NO: 19370 - RNA, 20 nt, Artificial Sequence
  targeting sequence with CTCN PAM
aaagugaugugucuuuuugu

SEQ ID NO: 19371 - RNA, 20 nt, Artificial Sequence
  targeting sequence with CTCN PAM
cccugaagcugccaaccauc

SEQ ID NO: 19372 - RNA, 20 nt, Artificial Sequence
  targeting sequence with CTCN PAM
aauuaugccuuggucuuucu

SEQ ID NO: 19373 - RNA, 20 nt, Artificial Sequence
  targeting sequence with CTCN PAM
gggaggguaaaggaaggaga

SEQ ID NO: 19374 - RNA, 20 nt, Artificial Sequence
  targeting sequence with CTCN PAM
cagagguugggggguggggc

SEQ ID NO: 19375 - RNA, 20 nt, Artificial Sequence
  targeting sequence with CTCN PAM
uuccuuuacccucccagagg

SEQ ID NO: 19376 - RNA, 20 nt, Artificial Sequence
  targeting sequence with CTCN PAM
ccuuccuuuacccucccaga

SEQ ID NO: 19377 - RNA, 20 nt, Artificial Sequence
  targeting sequence with CTCN PAM
cuaacccuguccuuuugggu

SEQ ID NO: 19378 - RNA, 20 nt, Artificial Sequence
  targeting sequence with CTCN PAM
acauguucagcuauccagaa

SEQ ID NO: 19379 - RNA, 20 nt, Artificial Sequence
  targeting sequence with CTCN PAM
aggaaacuccacauguucag

SEQ ID NO: 19380 - RNA, 20 nt, Artificial Sequence
  targeting sequence with CTCN PAM
agcaaauuaacugaauccaa

SEQ ID NO: 19381 - RNA, 20 nt, Artificial Sequence
  targeting sequence with CTCN PAM
uuggauucaguuaauuugcu

SEQ ID NO: 19382 - RNA, 20 nt, Artificial Sequence
  targeting sequence with CTCN PAM
acuaguguaaucuaauacua

SEQ ID NO: 19383 - RNA, 20 nt, Artificial Sequence
  targeting sequence with CTCN PAM
agguagacagagucagaauu

SEQ ID NO: 19384 - RNA, 20 nt, Artificial Sequence
  targeting sequence with CTCN PAM
gucuaccuggagauaguauu

SEQ ID NO: 19385 - RNA, 20 nt, Artificial Sequence
  targeting sequence with CTCN PAM
acagaccuggcaucagaauu

SEQ ID NO: 19386 - RNA, 20 nt, Artificial Sequence
  targeting sequence with CTCN PAM
acaacacaauucugaugcca

SEQ ID NO: 19387 - RNA, 20 nt, Artificial Sequence
  targeting sequence with CTCN PAM
caacaacacaauucugaugc

SEQ ID NO: 19388 - RNA, 20 nt, Artificial Sequence
  targeting sequence with CTCN PAM
cacuauccucucaacaacac

SEQ ID NO: 19389 - RNA, 20 nt, Artificial Sequence
  targeting sequence with CTCN PAM
guuucucccacuauccucuc

SEQ ID NO: 19390 - RNA, 20 nt, Artificial Sequence
  targeting sequence with CTCN PAM
auuuccuuuacacucaaaug

SEQ ID NO: 19391 - RNA, 20 nt, Artificial Sequence
  targeting sequence with CTCN PAM
aauggccuucaaaggcacau

SEQ ID NO: 19392 - RNA, 20 nt, Artificial Sequence
  targeting sequence with CTCN PAM
uauacccuucccuuuauaau

SEQ ID NO: 19393 - RNA, 20 nt, Artificial Sequence
  targeting sequence with CTCN PAM
ugucaagagguggcuucugg

SEQ ID NO: 19394 - RNA, 20 nt, Artificial Sequence
  targeting sequence with CTCN PAM
ugacaggagugggaaaucca

SEQ ID NO: 19395 - RNA, 20 nt, Artificial Sequence
  targeting sequence with CTCN PAM
ugccuguaaucucaacauuu

SEQ ID NO: 19396 - RNA, 20 nt, Artificial Sequence
  targeting sequence with CTCN PAM
acauuuugggaggccaaaag

SEQ ID NO: 19397 - RNA, 20 nt, Artificial Sequence
  targeting sequence with CTCN PAM
caaaauguugagauuacagg

SEQ ID NO: 19398 - RNA, 20 nt, Artificial Sequence
  targeting sequence with CTCN PAM
ugccuuuuggccucccaaaa

SEQ ID NO: 19399 - RNA, 20 nt, Artificial Sequence
  targeting sequence with CTCN PAM
agugauccuccugccuuuug

SEQ ID NO: 19400 - RNA, 20 nt, Artificial Sequence
  targeting sequence with CTCN PAM
ugggcucaagugauccuccu

SEQ ID NO: 19401 - RNA, 20 nt, Artificial Sequence
  targeting sequence with CTCN PAM
aacuccugggcucaagugau

SEQ ID NO: 19402 - RNA, 20 nt, Artificial Sequence
  targeting sequence with CTCN PAM
gcaacauggugagacccuac

SEQ ID NO: 19403 - RNA, 20 nt, Artificial Sequence
  targeting sequence with CTCN PAM
ccauguugcugaggcuuggu

SEQ ID NO: 19404 - RNA, 20 nt, Artificial Sequence
  targeting sequence with CTCN PAM
acaaaaaagaaauaaauuag

SEQ ID NO: 19405 - RNA, 20 nt, Artificial Sequence
  targeting sequence with CTCN PAM
acccacuauuccuuuagggc

SEQ ID NO: 19406 - RNA, 20 nt, Artificial Sequence
  targeting sequence with CTCN PAM
ccuaugaauccuuuccuucu

SEQ ID NO: 19407 - RNA, 20 nt, Artificial Sequence
  targeting sequence with CTCN PAM
uaugaauccuuuccuucuga

SEQ ID NO: 19408 - RNA, 20 nt, Artificial Sequence
  targeting sequence with CTCN PAM
cccugggcuagcauucuuaa

SEQ ID NO: 19409 - RNA, 20 nt, Artificial Sequence
  targeting sequence with CTCN PAM
gaacaaacagagauguguca

SEQ ID NO: 19410 - RNA, 20 nt, Artificial Sequence
  targeting sequence with CTCN PAM
guuuguucugagguuauaaa

SEQ ID NO: 19411 - RNA, 20 nt, Artificial Sequence
  targeting sequence with CTCN PAM
uuuucuguuguuugcuauau

SEQ ID NO: 19412 - RNA, 20 nt, Artificial Sequence
  targeting sequence with CTCN PAM
ggucuguacccucuuuuucu

SEQ ID NO: 19413 - RNA, 20 nt, Artificial Sequence
  targeting sequence with CTCN PAM
uaugccuuaugguugauaau

SEQ ID NO: 19414 - RNA, 20 nt, Artificial Sequence
  targeting sequence with CTCN PAM
auagcaaacaauaugaaugu

SEQ ID NO: 19415 - RNA, 20 nt, Artificial Sequence
  targeting sequence with CTCN PAM
uuugcuuuaguauuuaucuc

SEQ ID NO: 19416 - RNA, 20 nt, Artificial Sequence
  targeting sequence with CTCN PAM
uagaaaauauguaucauuua

SEQ ID NO: 19417 - RNA, 20 nt, Artificial Sequence
  targeting sequence with CTCN PAM
ggacuauggaugaaauguga

SEQ ID NO: 19418 - RNA, 20 nt, Artificial Sequence
  targeting sequence with CTCN PAM
aauccaguuuuaucucagag

SEQ ID NO: 19419 - RNA, 20 nt, Artificial Sequence
  targeting sequence with CTCN PAM
gagauuuguucugcugaucu

SEQ ID NO: 19420 - RNA, 20 nt, Artificial Sequence
  targeting sequence with CTCN PAM
gagauaaaacuggauuggag

SEQ ID NO: 19421 - RNA, 20 nt, Artificial Sequence
  targeting sequence with CTCN PAM
agaucagcagaacaaaucuc

SEQ ID NO: 19422 - RNA, 20 nt, Artificial Sequence
  targeting sequence with CTCN PAM
gugugaaacuuguaucucca

SEQ ID NO: 19423 - RNA, 20 nt, Artificial Sequence
  targeting sequence with CTCN PAM
gcuacuuauuuucaaaguau

SEQ ID NO: 19424 - RNA, 20 nt, Artificial Sequence
  targeting sequence with CTCN PAM
aaaucaaauuccuauuuguu

SEQ ID NO: 19425 - RNA, 20 nt, Artificial Sequence
  targeting sequence with CTCN PAM
uguucauugaaagaaacacu

SEQ ID NO: 19426 - RNA, 20 nt, Artificial Sequence
  targeting sequence with CTCN PAM
agcgaaauaguuacuggaaa

SEQ ID NO: 19427 - RNA, 20 nt, Artificial Sequence
  targeting sequence with CTCN PAM
cuuucucaagcgaaauaguu

SEQ ID NO: 19428 - RNA, 20 nt, Artificial Sequence
  targeting sequence with CTCN PAM
gcaaugaagcagcccauuac

SEQ ID NO: 19429 - RNA, 20 nt, Artificial Sequence
  targeting sequence with CTCN PAM
uguguguaaugggcugcuuc

SEQ ID NO: 19430 - RNA, 20 nt, Artificial Sequence
  targeting sequence with CTCN PAM
aggaugaucugagcaugucc

SEQ ID NO: 19431 - RNA, 20 nt, Artificial Sequence
  targeting sequence with CTCN PAM
gaucauccuggagugucccg

SEQ ID NO: 19432 - RNA, 20 nt, Artificial Sequence
  targeting sequence with CTCN PAM
guagcuguauggacaugcuc

SEQ ID NO: 19433 - RNA, 20 nt, Artificial Sequence
  targeting sequence with CTCN PAM
acauucuguccaaauagcuu

SEQ ID NO: 19434 - RNA, 20 nt, Artificial Sequence
  targeting sequence with CTCN PAM
auuauuacaaccuuacacaa

SEQ ID NO: 19435 - RNA, 20 nt, Artificial Sequence
  targeting sequence with CTCN PAM
gccaggggcauuugcuauuu

SEQ ID NO: 19436 - RNA, 20 nt, Artificial Sequence
  targeting sequence with CTCN PAM
ggcuauuuccuuugucuguc

SEQ ID NO: 19437 - RNA, 20 nt, Artificial Sequence
  targeting sequence with CTCN PAM
uccugaauccuauaguuagu

SEQ ID NO: 19438 - RNA, 20 nt, Artificial Sequence
  targeting sequence with CTCN PAM
gaaaccguauguuguauaug

SEQ ID NO: 19439 - RNA, 20 nt, Artificial Sequence
  targeting sequence with CTCN PAM
ucggaaaccguauguuguau

SEQ ID NO: 19440 - RNA, 20 nt, Artificial Sequence
  targeting sequence with CTCN PAM
ccucggaaaccguauguugu

SEQ ID NO: 19441 - RNA, 20 nt, Artificial Sequence
  targeting sequence with CTCN PAM
cucuccucggaaaccguaug

SEQ ID NO: 19442 - RNA, 20 nt, Artificial Sequence
  targeting sequence with CTCN PAM
augcuugugagagaggagga

SEQ ID NO: 19443 - RNA, 20 nt, Artificial Sequence
  targeting sequence with CTCN PAM
caagcauggagcccucacuc

SEQ ID NO: 19444 - RNA, 20 nt, Artificial Sequence
  targeting sequence with CTCN PAM
cacaagcauggagcccucac

SEQ ID NO: 19445 - RNA, 20 nt, Artificial Sequence
  targeting sequence with CTCN PAM
cucacaagcauggagcccuc

SEQ ID NO: 19446 - RNA, 20 nt, Artificial Sequence
  targeting sequence with CTCN PAM
ucucucacaagcauggagcc

SEQ ID NO: 19447 - RNA, 20 nt, Artificial Sequence
  targeting sequence with CTCN PAM
uccucucucacaagcaugga

SEQ ID NO: 19448 - RNA, 20 nt, Artificial Sequence
  targeting sequence with CTCN PAM
uccuccucucucacaagcau

SEQ ID NO: 19449 - RNA, 20 nt, Artificial Sequence
  targeting sequence with CTCN PAM
gguuucucccagauuugaac

SEQ ID NO: 19450 - RNA, 20 nt, Artificial Sequence
  targeting sequence with CTCN PAM
cagauuugaacauguuguac

SEQ ID NO: 19451 - RNA, 20 nt, Artificial Sequence
  targeting sequence with CTCN PAM
ugccacaguacaacauguuc

SEQ ID NO: 19452 - RNA, 20 nt, Artificial Sequence
  targeting sequence with CTCN PAM
gcugaccucaugccacagua

SEQ ID NO: 19453 - RNA, 20 nt, Artificial Sequence
  targeting sequence with CTCN PAM
agcccugugaggcugaauuc

SEQ ID NO: 19454 - RNA, 20 nt, Artificial Sequence
  targeting sequence with CTCN PAM
cagggcuggaguaagucucu

SEQ ID NO: 19455 - RNA, 20 nt, Artificial Sequence
  targeting sequence with CTCN PAM
ugcuucauauuacagugaua

SEQ ID NO: 19456 - RNA, 20 nt, Artificial Sequence
  targeting sequence with CTCN PAM
uguuuuggaauugccauuac

SEQ ID NO: 19457 - RNA, 20 nt, Artificial Sequence
  targeting sequence with CTCN PAM
ugugacaccauagaucucuu

SEQ ID NO: 19458 - RNA, 20 nt, Artificial Sequence
  targeting sequence with CTCN PAM
aaaguuuaaugguagaaaag

SEQ ID NO: 19459 - RNA, 20 nt, Artificial Sequence
  targeting sequence with CTCN PAM
uugacccuauuuugugucug

SEQ ID NO: 19460 - RNA, 20 nt, Artificial Sequence
  targeting sequence with CTCN PAM
agacacaaaauagggucaag

SEQ ID NO: 19461 - RNA, 20 nt, Artificial Sequence
  targeting sequence with CTCN PAM
gugacuuuacuauggaacag

SEQ ID NO: 19462 - RNA, 20 nt, Artificial Sequence
  targeting sequence with CTCN PAM
cuguuccauaguaaagucac

SEQ ID NO: 19463 - RNA, 20 nt, Artificial Sequence
  targeting sequence with CTCN PAM
uuuuucauaugugcccaaaa

SEQ ID NO: 19464 - RNA, 20 nt, Artificial Sequence
  targeting sequence with CTCN PAM
aaagaagaggggcacuaaaa

SEQ ID NO: 19465 - RNA, 20 nt, Artificial Sequence
  targeting sequence with CTCN PAM
ucuuuggaggaagaauuucu

SEQ ID NO: 19466 - RNA, 20 nt, Artificial Sequence
  targeting sequence with CTCN PAM
uuuuuuagugccccucuucu

SEQ ID NO: 19467 - RNA, 20 nt, Artificial Sequence
  targeting sequence with CTCN PAM
ugguagaaaauucauguucu

SEQ ID NO: 19468 - RNA, 20 nt, Artificial Sequence
  targeting sequence with CTCN PAM
auugucuuguguuuccuggc

SEQ ID NO: 19469 - RNA, 20 nt, Artificial Sequence
  targeting sequence with CTCN PAM
uuaucccacugaacuauuga

SEQ ID NO: 19470 - RNA, 20 nt, Artificial Sequence
  targeting sequence with CTCN PAM
gaaagaguaaucuacuuuga

SEQ ID NO: 19471 - RNA, 20 nt, Artificial Sequence
  targeting sequence with CTCN PAM
uucagagguucuuauaaaau

SEQ ID NO: 19472 - RNA, 20 nt, Artificial Sequence
  targeting sequence with CTCN PAM
gaacuaaaaaauuuaguacg

SEQ ID NO: 19473 - RNA, 20 nt, Artificial Sequence
  targeting sequence with CTCN PAM
auuucuguucuuucuacuaa

SEQ ID NO: 19474 - RNA, 20 nt, Artificial Sequence
  targeting sequence with CTCN PAM
uacaaucuuguuccuacuuc

SEQ ID NO: 19475 - RNA, 20 nt, Artificial Sequence
  targeting sequence with CTCN PAM
ucaauuucugcaauguacuc

SEQ ID NO: 19476 - RNA, 20 nt, Artificial Sequence
  targeting sequence with CTCN PAM
cuuugcagagauguucaugg

SEQ ID NO: 19477 - RNA, 20 nt, Artificial Sequence
  targeting sequence with CTCN PAM
gcaaagugaguacauugcag

SEQ ID NO: 19478 - RNA, 20 nt, Artificial Sequence
  targeting sequence with CTCN PAM
agacuuuccuuugguaacua

SEQ ID NO: 19479 - RNA, 20 nt, Artificial Sequence
  targeting sequence with CTCN PAM
ccagacuuuccuuugguaac

SEQ ID NO: 19480 - RNA, 20 nt, Artificial Sequence
  targeting sequence with CTCN PAM
gcaguucccuccucuccugg

SEQ ID NO: 19481 - RNA, 20 nt, Artificial Sequence
  targeting sequence with CTCN PAM
ucuccugguagacaugcagc

SEQ ID NO: 19482 - RNA, 20 nt, Artificial Sequence
  targeting sequence with CTCN PAM
ccugguagacaugcagcagc

SEQ ID NO: 19483 - RNA, 20 nt, Artificial Sequence
  targeting sequence with CTCN PAM
ugguagacaugcagcagcag

SEQ ID NO: 19484 - RNA, 20 nt, Artificial Sequence
  targeting sequence with CTCN PAM
gcuaugauggaaauagcuug

SEQ ID NO: 19485 - RNA, 20 nt, Artificial Sequence
  targeting sequence with CTCN PAM
ugaccagacuuccuguugau

SEQ ID NO: 19486 - RNA, 20 nt, Artificial Sequence
  targeting sequence with CTCN PAM
ggcuugccccgccuacuaug

SEQ ID NO: 19487 - RNA, 20 nt, Artificial Sequence
  targeting sequence with CTCN PAM
cuucaucuuggguggcacuc

SEQ ID NO: 19488 - RNA, 20 nt, Artificial Sequence
  targeting sequence with CTCN PAM
ucaucuuggguggcacucga

SEQ ID NO: 19489 - RNA, 20 nt, Artificial Sequence
  targeting sequence with CTCN PAM
aaucugcugcaggacacgau

SEQ ID NO: 19490 - RNA, 20 nt, Artificial Sequence
  targeting sequence with CTCN PAM
gaaucguguccugcagcaga

SEQ ID NO: 19491 - RNA, 20 nt, Artificial Sequence
  targeting sequence with CTCN PAM
gcacaugcguucuggcuuuc

SEQ ID NO: 19492 - RNA, 20 nt, Artificial Sequence
  targeting sequence with CTCN PAM
acaugaugugcagcaaauuc

SEQ ID NO: 19493 - RNA, 20 nt, Artificial Sequence
  targeting sequence with CTCN PAM
ugcgcuggugcuggaagaga

SEQ ID NO: 19494 - RNA, 20 nt, Artificial Sequence
  targeting sequence with CTCN PAM
uccagcaccagcgcaggagg

SEQ ID NO: 19495 - RNA, 20 nt, Artificial Sequence
  targeting sequence with CTCN PAM
aaagcauugugggucauuuu

SEQ ID NO: 19496 - RNA, 20 nt, Artificial Sequence
  targeting sequence with CTCN PAM
gcaucuugggauuugccucc

SEQ ID NO: 19497 - RNA, 20 nt, Artificial Sequence
  targeting sequence with CTCN PAM
aggaucaggguccucaaaua

SEQ ID NO: 19498 - RNA, 20 nt, Artificial Sequence
  targeting sequence with CTCN PAM
aauaacuguucacugcccga

SEQ ID NO: 19499 - RNA, 20 nt, Artificial Sequence
  targeting sequence with CTCN PAM
aucaguagacuuaauaugcu

SEQ ID NO: 19500 - RNA, 20 nt, Artificial Sequence
  targeting sequence with CTCN PAM
aaaaaauuuuuuaaacacac

SEQ ID NO: 19501 - RNA, 20 nt, Artificial Sequence
  targeting sequence with CTCN PAM
ugguguguuuaaaaaauuuu

SEQ ID NO: 19502 - RNA, 20 nt, Artificial Sequence
  targeting sequence with CTCN PAM
cagcugcaugcguagucacu

SEQ ID NO: 19503 - RNA, 20 nt, Artificial Sequence
  targeting sequence with CTCN PAM
agcugaggcaauuuaauccc

SEQ ID NO: 19504 - RNA, 20 nt, Artificial Sequence
  targeting sequence with CTCN PAM
gcuagaguaaaccuauugga

SEQ ID NO: 19505 - RNA, 20 nt, Artificial Sequence
  targeting sequence with CTCN PAM
cauucauaaccacaguuaau

SEQ ID NO: 19506 - RNA, 20 nt, Artificial Sequence
  targeting sequence with CTCN PAM
uucauaaccacaguuaauua

SEQ ID NO: 19507 - RNA, 20 nt, Artificial Sequence
  targeting sequence with CTCN PAM
guauaaucaaagaacaacag

SEQ ID NO: 19508 - RNA, 20 nt, Artificial Sequence
  targeting sequence with CTCN PAM
cuguuguucuuugauuauac

SEQ ID NO: 19509 - RNA, 20 nt, Artificial Sequence
  targeting sequence with CTCN PAM
aguuaccagugaacuugaug

SEQ ID NO: 19510 - RNA, 20 nt, Artificial Sequence
  targeting sequence with CTCN PAM
uuugagaagagaauggaaau

SEQ ID NO: 19511 - RNA, 20 nt, Artificial Sequence
  targeting sequence with CTCN PAM
aaagagcaaaccugucaucu

SEQ ID NO: 19512 - RNA, 20 nt, Artificial Sequence
  targeting sequence with CTCN PAM
ucucaaaagagcaaaccugu

SEQ ID NO: 19513 - RNA, 20 nt, Artificial Sequence
  targeting sequence with CTCN PAM
gcugaagcacaaaugaccuu

SEQ ID NO: 19514 - RNA, 20 nt, Artificial Sequence
  targeting sequence with CTCN PAM
uauggugccagaaaggucau

SEQ ID NO: 19515 - RNA, 20 nt, Artificial Sequence
  targeting sequence with CTCN PAM
gauucugauucugucugaac

SEQ ID NO: 19516 - RNA, 20 nt, Artificial Sequence
  targeting sequence with CTCN PAM
agucucugauucugauucug

SEQ ID NO: 19517 - RNA, 20 nt, Artificial Sequence
  targeting sequence with CTCN PAM
guaccagcuaucaagaaagg

SEQ ID NO: 19518 - RNA, 20 nt, Artificial Sequence
  targeting sequence with CTCN PAM
uuucuugauagcugguacug

SEQ ID NO: 19519 - RNA, 20 nt, Artificial Sequence
  targeting sequence with CTCN PAM
auagugucaucccugacaga

SEQ ID NO: 19520 - RNA, 20 nt, Artificial Sequence
  targeting sequence with CTCN PAM
aaagcaaaguaacuggguag

SEQ ID NO: 19521 - RNA, 20 nt, Artificial Sequence
  targeting sequence with CTCN PAM
acuuuucuauccuacccagu

SEQ ID NO: 19522 - RNA, 20 nt, Artificial Sequence
  targeting sequence with CTCN PAM
uaguuucagcuuccuuuuaa

SEQ ID NO: 19523 - RNA, 20 nt, Artificial Sequence
  targeting sequence with CTCN PAM
cuuuuuuuuuuuuuuuuuuu

SEQ ID NO: 19524 - RNA, 20 nt, Artificial Sequence
  targeting sequence with CTCN PAM
caucccccccucccuuuuuu

SEQ ID NO: 19525 - RNA, 20 nt, Artificial Sequence
  targeting sequence with CTCN PAM
ucaucucccaucccccccuc

SEQ ID NO: 19526 - RNA, 20 nt, Artificial Sequence
  targeting sequence with CTCN PAM
uacaucauauuuugcauucu

SEQ ID NO: 19527 - RNA, 20 nt, Artificial Sequence
  targeting sequence with CTCN PAM
cuacacuaccaaguacuuca

SEQ ID NO: 19528 - RNA, 20 nt, Artificial Sequence
  targeting sequence with CTCN PAM
uguucugggaauauguggac

SEQ ID NO: 19529 - RNA, 20 nt, Artificial Sequence
  targeting sequence with CTCN PAM
uuuauucagcuaauuuaugg

SEQ ID NO: 19530 - RNA, 20 nt, Artificial Sequence
  targeting sequence with CTCN PAM
aggcuacuagaguuuagugg

SEQ ID NO: 19531 - RNA, 20 nt, Artificial Sequence
  targeting sequence with CTCN PAM
aguagccuugaguucacagg

SEQ ID NO: 19532 - RNA, 20 nt, Artificial Sequence
  targeting sequence with CTCN PAM
cuaaaguuuuguuccugaug

SEQ ID NO: 19533 - RNA, 20 nt, Artificial Sequence
  targeting sequence with CTCN PAM
cagaagacuuuuuucaaaua

SEQ ID NO: 19534 - RNA, 20 nt, Artificial Sequence
  targeting sequence with CTCN PAM
gaagacuuuuuucaaauauu

SEQ ID NO: 19535 - RNA, 20 nt, Artificial Sequence
  targeting sequence with CTCN PAM
acuguccauauucuuucaug

SEQ ID NO: 19536 - RNA, 20 nt, Artificial Sequence
  targeting sequence with CTCN PAM
ucauaacagaggagcauaaa

SEQ ID NO: 19537 - RNA, 20 nt, Artificial Sequence
  targeting sequence with CTCN PAM
guuaugaagagauuagguaa

SEQ ID NO: 19538 - RNA, 20 nt, Artificial Sequence
  targeting sequence with CTCN PAM
ucuguuaugaagagauuagg

SEQ ID NO: 19539 - RNA, 20 nt, Artificial Sequence
  targeting sequence with CTCN PAM
cuguuuaugcuccucuguua

SEQ ID NO: 19540 - RNA, 20 nt, Artificial Sequence
  targeting sequence with CTCN PAM
cucuaguaccuuccuacuuu

SEQ ID NO: 19541 - RNA, 20 nt, Artificial Sequence
  targeting sequence with CTCN PAM
cuaguaccuuccuacuuucu

SEQ ID NO: 19542 - RNA, 20 nt, Artificial Sequence
  targeting sequence with CTCN PAM
aguaccuuccuacuuucuaa

SEQ ID NO: 19543 - RNA, 20 nt, Artificial Sequence
  targeting sequence with CTCN PAM
ugguuguuauucauuugccu

SEQ ID NO: 19544 - RNA, 20 nt, Artificial Sequence
  targeting sequence with CTCN PAM
acugaaaucuagccauccca

SEQ ID NO: 19545 - RNA, 20 nt, Artificial Sequence
  targeting sequence with CTCN PAM
caaagggaaagauaugaaca

SEQ ID NO: 19546 - RNA, 20 nt, Artificial Sequence
  targeting sequence with CTCN PAM
ggugugguuuucuggugcuc

SEQ ID NO: 19547 - RNA, 20 nt, Artificial Sequence
  targeting sequence with CTCN PAM
uugugggcaaaaauuuugcc

SEQ ID NO: 19548 - RNA, 20 nt, Artificial Sequence
  targeting sequence with CTCN PAM
gauuuuuaaaaaaaauagua

SEQ ID NO: 19549 - RNA, 20 nt, Artificial Sequence
  targeting sequence with CTCN PAM
ccauuccucaugaguuuguc

SEQ ID NO: 19550 - RNA, 20 nt, Artificial Sequence
  targeting sequence with CTCN PAM
ugaguuugucuugcuggcua

SEQ ID NO: 19551 - RNA, 20 nt, Artificial Sequence
  targeting sequence with CTCN PAM
ugaggaauggugagauaauu

SEQ ID NO: 19552 - RNA, 20 nt, Artificial Sequence
  targeting sequence with CTCN PAM
auucuuucaguaacuauuag

SEQ ID NO: 19553 - RNA, 20 nt, Artificial Sequence
  targeting sequence with CTCN PAM
gaggaaaagggcuaauguaa

SEQ ID NO: 19554 - RNA, 20 nt, Artificial Sequence
  targeting sequence with CTCN PAM
gagaaacucaauucuuucag

SEQ ID NO: 19555 - RNA, 20 nt, Artificial Sequence
  targeting sequence with CTCN PAM
ucucuucuugcacugggcua

SEQ ID NO: 19556 - RNA, 20 nt, Artificial Sequence
  targeting sequence with CTCN PAM
ucuugcacugggcuauuuag

SEQ ID NO: 19557 - RNA, 20 nt, Artificial Sequence
  targeting sequence with CTCN PAM
ggaucuaaauagcccagugc

SEQ ID NO: 19558 - RNA, 20 nt, Artificial Sequence
  targeting sequence with CTCN PAM
caucuucucaggaucuaaau

SEQ ID NO: 19559 - RNA, 20 nt, Artificial Sequence
  targeting sequence with CTCN PAM
auuugcacauuauuagcuaa

SEQ ID NO: 19560 - RNA, 20 nt, Artificial Sequence
  targeting sequence with CTCN PAM
ugggauaaacauauuuuaua

SEQ ID NO: 19561 - RNA, 20 nt, Artificial Sequence
  targeting sequence with CTCN PAM
gcuaaccuugacaucauucc

SEQ ID NO: 19562 - RNA, 20 nt, Artificial Sequence
  targeting sequence with CTCN PAM
uaugcaaagguacuaggaau

SEQ ID NO: 19563 - RNA, 20 nt, Artificial Sequence
  targeting sequence with CTCN PAM
gcaaaucuacuuauuugggc

SEQ ID NO: 19564 - RNA, 20 nt, Artificial Sequence
  targeting sequence with CTCN PAM
cuuagcaugcagcccuaaag

SEQ ID NO: 19565 - RNA, 20 nt, Artificial Sequence
  targeting sequence with CTCN PAM
auuuagguuucuuuagggcu

SEQ ID NO: 19566 - RNA, 20 nt, Artificial Sequence
  targeting sequence with CTCN PAM
auaaaauugcugacaguaag

SEQ ID NO: 19567 - RNA, 20 nt, Artificial Sequence
  targeting sequence with CTCN PAM
aaguuguacagggacacccu

SEQ ID NO: 19568 - RNA, 20 nt, Artificial Sequence
  targeting sequence with CTCN PAM
guaagacauacagaagaaaa

SEQ ID NO: 19569 - RNA, 20 nt, Artificial Sequence
  targeting sequence with CTCN PAM
aaugaauaugaacaacuguu

SEQ ID NO: 19570 - RNA, 20 nt, Artificial Sequence
  targeting sequence with CTCN PAM
guuuauaaaauuccccaauu

SEQ ID NO: 19571 - RNA, 20 nt, Artificial Sequence
  targeting sequence with CTCN PAM
aaauaaauaaauaguuaauu

SEQ ID NO: 19572 - RNA, 20 nt, Artificial Sequence
  targeting sequence with CTCN PAM
cccugccacccaggcuggag

SEQ ID NO: 19573 - RNA, 20 nt, Artificial Sequence
  targeting sequence with CTCN PAM
agccuggguggcagggggag

SEQ ID NO: 19574 - RNA, 20 nt, Artificial Sequence
  targeting sequence with CTCN PAM
gcucacugcaaccucugccu

SEQ ID NO: 19575 - RNA, 20 nt, Artificial Sequence
  targeting sequence with CTCN PAM
cugcaaccucugccuucugg

SEQ ID NO: 19576 - RNA, 20 nt, Artificial Sequence
  targeting sequence with CTCN PAM
gccuucuggguucaagcaau

SEQ ID NO: 19577 - RNA, 20 nt, Artificial Sequence
  targeting sequence with CTCN PAM
uaccucugccucucaaguag

SEQ ID NO: 19578 - RNA, 20 nt, Artificial Sequence
  targeting sequence with CTCN PAM
gccucucaaguagcugggau

SEQ ID NO: 19579 - RNA, 20 nt, Artificial Sequence
  targeting sequence with CTCN PAM
caaguagcugggauuacagg

SEQ ID NO: 19580 - RNA, 20 nt, Artificial Sequence
  targeting sequence with CTCN PAM
aguagcugggauuacaggcg

SEQ ID NO: 19581 - RNA, 20 nt, Artificial Sequence
  targeting sequence with CTCN PAM
aacuccugaccucaagugau

SEQ ID NO: 19582 - RNA, 20 nt, Artificial Sequence
  targeting sequence with CTCN PAM
ugaccucaagugauccaccc

SEQ ID NO: 19583 - RNA, 20 nt, Artificial Sequence
  targeting sequence with CTCN PAM
agugauccacccuccucagc

SEQ ID NO: 19584 - RNA, 20 nt, Artificial Sequence
  targeting sequence with CTCN PAM
ucagccucccaaagugcuag

SEQ ID NO: 19585 - RNA, 20 nt, Artificial Sequence
  targeting sequence with CTCN PAM
gccucccaaagugcuaggau

SEQ ID NO: 19586 - RNA, 20 nt, Artificial Sequence
  targeting sequence with CTCN PAM
caaagugcuaggauuauagg

SEQ ID NO: 19587 - RNA, 20 nt, Artificial Sequence
  targeting sequence with CTCN PAM
ugccuauaauccuagcacuu

SEQ ID NO: 19588 - RNA, 20 nt, Artificial Sequence
  targeting sequence with CTCN PAM
uuuguguuaaaccagggauc

SEQ ID NO: 19589 - RNA, 20 nt, Artificial Sequence
  targeting sequence with CTCN PAM
uuuauucacucagcuucucu

SEQ ID NO: 19590 - RNA, 20 nt, Artificial Sequence
  targeting sequence with CTCN PAM
gcuucucugaaaaguaaagu

SEQ ID NO: 19591 - RNA, 20 nt, Artificial Sequence
  targeting sequence with CTCN PAM
gaaaaguaaaguuauuauaa

SEQ ID NO: 19592 - RNA, 20 nt, Artificial Sequence
  targeting sequence with CTCN PAM
gguuuacuuauaauaacuuu

SEQ ID NO: 19593 - RNA, 20 nt, Artificial Sequence
  targeting sequence with CTCN PAM
cucugguuuacuuauaauaa

SEQ ID NO: 19594 - RNA, 20 nt, Artificial Sequence
  targeting sequence with CTCN PAM
uucucccucugguuuacuua

SEQ ID NO: 19595 - RNA, 20 nt, Artificial Sequence
  targeting sequence with CTCN PAM
uuuuucucuuucucccucug

SEQ ID NO: 19596 - RNA, 20 nt, Artificial Sequence
  targeting sequence with CTCN PAM
ccuuuuuccuguguccuuuu

SEQ ID NO: 19597 - RNA, 20 nt, Artificial Sequence
  targeting sequence with CTCN PAM
ccccuuuuuccuguguccuu

SEQ ID NO: 19598 - RNA, 20 nt, Artificial Sequence
  targeting sequence with CTCN PAM
uucgaccucuccccuuuuuc

SEQ ID NO: 19599 - RNA, 20 nt, Artificial Sequence
  targeting sequence with CTCN PAM
ccuuucacuccuucgaccuc

SEQ ID NO: 19600 - RNA, 20 nt, Artificial Sequence
  targeting sequence with CTCN PAM
ccccuuucacuccuucgacc

SEQ ID NO: 19601 - RNA, 20 nt, Artificial Sequence
  targeting sequence with CTCN PAM
uucuaccucuccccuuucac

SEQ ID NO: 19602 - RNA, 20 nt, Artificial Sequence
  targeting sequence with CTCN PAM
ccuuuugcuccuucuaccuc

SEQ ID NO: 19603 - RNA, 20 nt, Artificial Sequence
  targeting sequence with CTCN PAM
gaauuuucaacaauuaacuu

SEQ ID NO: 19604 - RNA, 20 nt, Artificial Sequence
  targeting sequence with CTCN PAM
cacucagaaaacaaguuguu

SEQ ID NO: 19605 - RNA, 20 nt, Artificial Sequence
  targeting sequence with CTCN PAM
gaaaacaaguuguucuaaau

SEQ ID NO: 19606 - RNA, 20 nt, Artificial Sequence
  targeting sequence with CTCN PAM
uaaaugguugauagauuuua

SEQ ID NO: 19607 - RNA, 20 nt, Artificial Sequence
  targeting sequence with CTCN PAM
uuguagucagugaaauuuaa

SEQ ID NO: 19608 - RNA, 20 nt, Artificial Sequence
  targeting sequence with CTCN PAM
uccuuaagcacuucuaaggu

SEQ ID NO: 19609 - RNA, 20 nt, Artificial Sequence
  targeting sequence with CTCN PAM
ccuuguaauucuuaauauuu

SEQ ID NO: 19610 - RNA, 20 nt, Artificial Sequence
  targeting sequence with CTCN PAM
ucucucacugguagaaguag

SEQ ID NO: 19611 - RNA, 20 nt, Artificial Sequence
  targeting sequence with CTCN PAM
cacugguagaaguaggguuu

SEQ ID NO: 19612 - RNA, 20 nt, Artificial Sequence
  targeting sequence with CTCN PAM
cugguagaaguaggguuugu

SEQ ID NO: 19613 - RNA, 20 nt, Artificial Sequence
  targeting sequence with CTCN PAM
auucaaaggcaauucuaaaa

SEQ ID NO: 19614 - RNA, 20 nt, Artificial Sequence
  targeting sequence with CTCN PAM
ugccuguaaucccagcacuc

SEQ ID NO: 19615 - RNA, 20 nt, Artificial Sequence
  targeting sequence with CTCN PAM
gaggcaggaagaucaucuga

SEQ ID NO: 19616 - RNA, 20 nt, Artificial Sequence
  targeting sequence with CTCN PAM
gagugcugggauuacaggca

SEQ ID NO: 19617 - RNA, 20 nt, Artificial Sequence
  targeting sequence with CTCN PAM
gaugaucuuccugccucgga

SEQ ID NO: 19618 - RNA, 20 nt, Artificial Sequence
  targeting sequence with CTCN PAM
aauuccugggcucagaugau

SEQ ID NO: 19619 - RNA, 20 nt, Artificial Sequence
  targeting sequence with CTCN PAM
aaaacaauuuuuaaagauua

SEQ ID NO: 19620 - RNA, 20 nt, Artificial Sequence
  targeting sequence with CTCN PAM
aggaauuaaucuaggacaga

SEQ ID NO: 19621 - RNA, 20 nt, Artificial Sequence
  targeting sequence with CTCN PAM
agggcagggucauaugcuuu

SEQ ID NO: 19622 - RNA, 20 nt, Artificial Sequence
  targeting sequence with CTCN PAM
guaaaagcugcugcuuuuuu

SEQ ID NO: 19623 - RNA, 20 nt, Artificial Sequence
  targeting sequence with CTCN PAM
gaaggaugagacaauggaua

SEQ ID NO: 19624 - RNA, 20 nt, Artificial Sequence
  targeting sequence with CTCN PAM
uccuucagagcucaguaaaa

SEQ ID NO: 19625 - RNA, 20 nt, Artificial Sequence
  targeting sequence with CTCN PAM
ugcaucuuacaugaucauua

SEQ ID NO: 19626 - RNA, 20 nt, Artificial Sequence
  targeting sequence with CTCN PAM
caugcaucuuacaugaucau

SEQ ID NO: 19627 - RNA, 20 nt, Artificial Sequence
  targeting sequence with CTCN PAM
ucucaugcaucuuacaugau

SEQ ID NO: 19628 - RNA, 20 nt, Artificial Sequence
  targeting sequence with CTCN PAM
gauuaucaucuuucccuccu

SEQ ID NO: 19629 - RNA, 20 nt, Artificial Sequence
  targeting sequence with CTCN PAM
uccuugucaucuuuuucuaa

SEQ ID NO: 19630 - RNA, 20 nt, Artificial Sequence
  targeting sequence with CTCN PAM
gcucuuccuugucaucuuuu

SEQ ID NO: 19631 - RNA, 20 nt, Artificial Sequence
  targeting sequence with CTCN PAM
uuccuuuccauuaacuuuuu

SEQ ID NO: 19632 - RNA, 20 nt, Artificial Sequence
  targeting sequence with CTCN PAM
ucaguacuuugugcgcucau

SEQ ID NO: 19633 - RNA, 20 nt, Artificial Sequence
  targeting sequence with CTCN PAM
uaccauugcgacagaugcua

SEQ ID NO: 19634 - RNA, 20 nt, Artificial Sequence
  targeting sequence with CTCN PAM
uuuuaucagaugcuuuuuua

SEQ ID NO: 19635 - RNA, 20 nt, Artificial Sequence
  targeting sequence with CTCN PAM
gcuggaaacguauuacgagu

SEQ ID NO: 19636 - RNA, 20 nt, Artificial Sequence
  targeting sequence with CTCN PAM
uaauacguuuccagcugaga

SEQ ID NO: 19637 - RNA, 20 nt, Artificial Sequence
  targeting sequence with CTCN PAM
ugcaucuuauuucaacaauu

SEQ ID NO: 19638 - RNA, 20 nt, Artificial Sequence
  targeting sequence with CTCN PAM
cucuagacgguugugagagc

SEQ ID NO: 19639 - RNA, 20 nt, Artificial Sequence
  targeting sequence with CTCN PAM
agacgguugugagagcuauu

SEQ ID NO: 19640 - RNA, 20 nt, Artificial Sequence
  targeting sequence with CTCN PAM
caaccgucuagagggagccc

SEQ ID NO: 19641 - RNA, 20 nt, Artificial Sequence
  targeting sequence with CTCN PAM
cacaaccgucuagagggagc

SEQ ID NO: 19642 - RNA, 20 nt, Artificial Sequence
  targeting sequence with CTCN PAM
uauuccuuuagaccugcuua

SEQ ID NO: 19643 - RNA, 20 nt, Artificial Sequence
  targeting sequence with CTCN PAM
uucaagcagaaagagaucau

SEQ ID NO: 19644 - RNA, 20 nt, Artificial Sequence
  targeting sequence with CTCN PAM
uucugcuugaaagaguauau

SEQ ID NO: 19645 - RNA, 20 nt, Artificial Sequence
  targeting sequence with CTCN PAM
caaauuuuaaaaaaacugaa

SEQ ID NO: 19646 - RNA, 20 nt, Artificial Sequence
  targeting sequence with CTCN PAM
gaccacaauguggauuccug

SEQ ID NO: 19647 - RNA, 20 nt, Artificial Sequence
  targeting sequence with CTCN PAM
ggaauccacauuguggucag

SEQ ID NO: 19648 - RNA, 20 nt, Artificial Sequence
  targeting sequence with CTCN PAM
uuuugaaccucaggaaucca

SEQ ID NO: 19649 - RNA, 20 nt, Artificial Sequence
  targeting sequence with CTCN PAM
cagcucuuuuugaaccucag

SEQ ID NO: 19650 - RNA, 20 nt, Artificial Sequence
  targeting sequence with CTCN PAM
aggcaauacaacauuuaugg

SEQ ID NO: 19651 - RNA, 20 nt, Artificial Sequence
  targeting sequence with CTCN PAM
auaaauguuguauugccugg

SEQ ID NO: 19652 - RNA, 20 nt, Artificial Sequence
  targeting sequence with CTCN PAM
gaccaaaggaaacaguccca

SEQ ID NO: 19653 - RNA, 20 nt, Artificial Sequence
  targeting sequence with CTCN PAM
ugggacuguuuccuuugguc

SEQ ID NO: 19654 - RNA, 20 nt, Artificial Sequence
  targeting sequence with CTCN PAM
gauucuaaccuacauucagu

SEQ ID NO: 19655 - RNA, 20 nt, Artificial Sequence
  targeting sequence with CTCN PAM
agggcugcaaucauaggaga

SEQ ID NO: 19656 - RNA, 20 nt, Artificial Sequence
  targeting sequence with CTCN PAM
aggacuucacacucugauuc

SEQ ID NO: 19657 - RNA, 20 nt, Artificial Sequence
  targeting sequence with CTCN PAM
uaugauugcagcccucgagg

SEQ ID NO: 19658 - RNA, 20 nt, Artificial Sequence
  targeting sequence with CTCN PAM
ccuaugauugcagcccucga

SEQ ID NO: 19659 - RNA, 20 nt, Artificial Sequence
  targeting sequence with CTCN PAM
ugugggcuuuuccuccagga

SEQ ID NO: 19660 - RNA, 20 nt, Artificial Sequence
  targeting sequence with CTCN PAM
aggaaccucaaaaggcucuc

SEQ ID NO: 19661 - RNA, 20 nt, Artificial Sequence
  targeting sequence with CTCN PAM
aaaggcucucuaaugcaggg

SEQ ID NO: 19662 - RNA, 20 nt, Artificial Sequence
  targeting sequence with CTCN PAM
cuaaugcagggggaagcaga

SEQ ID NO: 19663 - RNA, 20 nt, Artificial Sequence
  targeting sequence with CTCN PAM
aaugcagggggaagcagaga

SEQ ID NO: 19664 - RNA, 20 nt, Artificial Sequence
  targeting sequence with CTCN PAM
gcuucccccugcauuagaga

SEQ ID NO: 19665 - RNA, 20 nt, Artificial Sequence
  targeting sequence with CTCN PAM
cugcuucccccugcauuaga

SEQ ID NO: 19666 - RNA, 20 nt, Artificial Sequence
  targeting sequence with CTCN PAM
acuuccucucugcuuccccc

SEQ ID NO: 19667 - RNA, 20 nt, Artificial Sequence
  targeting sequence with CTCN PAM
uccaucuccacccccgugga

SEQ ID NO: 19668 - RNA, 20 nt, Artificial Sequence
  targeting sequence with CTCN PAM
aucuccacccccguggagcu

SEQ ID NO: 19669 - RNA, 20 nt, Artificial Sequence
  targeting sequence with CTCN PAM
acccccguggagcuaaugag

SEQ ID NO: 19670 - RNA, 20 nt, Artificial Sequence
  targeting sequence with CTCN PAM
acggggguggagauggagga

SEQ ID NO: 19671 - RNA, 20 nt, Artificial Sequence
  targeting sequence with CTCN PAM
uuagcuccacggggguggag

SEQ ID NO: 19672 - RNA, 20 nt, Artificial Sequence
  targeting sequence with CTCN PAM
ucccucauuagcuccacggg

SEQ ID NO: 19673 - RNA, 20 nt, Artificial Sequence
  targeting sequence with CTCN PAM
cuguggaacaaaaggcuuaa

SEQ ID NO: 19674 - RNA, 20 nt, Artificial Sequence
  targeting sequence with CTCN PAM
uugcugauuaagccuuuugu

SEQ ID NO: 19675 - RNA, 20 nt, Artificial Sequence
  targeting sequence with CTCN PAM
agcuguagugggauuccacc

SEQ ID NO: 19676 - RNA, 20 nt, Artificial Sequence
  targeting sequence with CTCN PAM
aaaacagcaauagccuuaaa

SEQ ID NO: 19677 - RNA, 20 nt, Artificial Sequence
  targeting sequence with CTCN PAM
uuccgccugcauuuaaggcu

SEQ ID NO: 19678 - RNA, 20 nt, Artificial Sequence
  targeting sequence with CTCN PAM
agcuaagguuuuuuucagcu

SEQ ID NO: 19679 - RNA, 20 nt, Artificial Sequence
  targeting sequence with CTCN PAM
gauuuaugcagauaguagaa

SEQ ID NO: 19680 - RNA, 20 nt, Artificial Sequence
  targeting sequence with CTCN PAM
ccucacccuccacuaacuga

SEQ ID NO: 19681 - RNA, 20 nt, Artificial Sequence
  targeting sequence with CTCN PAM
cccuccacuaacugacaggc

SEQ ID NO: 19682 - RNA, 20 nt, Artificial Sequence
  targeting sequence with CTCN PAM
acuaacugacaggcuuugag

SEQ ID NO: 19683 - RNA, 20 nt, Artificial Sequence
  targeting sequence with CTCN PAM
aagccugucaguuaguggag

SEQ ID NO: 19684 - RNA, 20 nt, Artificial Sequence
  targeting sequence with CTCN PAM
gguguauuccauuguuuuua

SEQ ID NO: 19685 - RNA, 20 nt, Artificial Sequence
  targeting sequence with CTCN PAM
gacucucacggagaaacagc

SEQ ID NO: 19686 - RNA, 20 nt, Artificial Sequence
  targeting sequence with CTCN PAM
cacggagaaacagcacaaag

SEQ ID NO: 19687 - RNA, 20 nt, Artificial Sequence
  targeting sequence with CTCN PAM
cggagaaacagcacaaaggg

SEQ ID NO: 19688 - RNA, 20 nt, Artificial Sequence
  targeting sequence with CTCN PAM
gugagagucugagucuugca

SEQ ID NO: 19689 - RNA, 20 nt, Artificial Sequence
  targeting sequence with CTCN PAM
aguucccauggcaacaauaa

SEQ ID NO: 19690 - RNA, 20 nt, Artificial Sequence
  targeting sequence with CTCN PAM
aguaaccauugcaauaauaa

SEQ ID NO: 19691 - RNA, 20 nt, Artificial Sequence
  targeting sequence with CTCN PAM
acccuaaaggacuugcagga

SEQ ID NO: 19692 - RNA, 20 nt, Artificial Sequence
  targeting sequence with CTCN PAM
guaucuccugucauauacag

SEQ ID NO: 19693 - RNA, 20 nt, Artificial Sequence
  targeting sequence with CTCN PAM
ugucauauacagcacauuca

SEQ ID NO: 19694 - RNA, 20 nt, Artificial Sequence
  targeting sequence with CTCN PAM
aagggacaaagcaauuauca

SEQ ID NO: 19695 - RNA, 20 nt, Artificial Sequence
  targeting sequence with CTCN PAM
gauaauugcuuugucccuuu

SEQ ID NO: 19696 - RNA, 20 nt, Artificial Sequence
  targeting sequence with CTCN PAM
aaugaaagagguagacaaca

SEQ ID NO: 19697 - RNA, 20 nt, Artificial Sequence
  targeting sequence with CTCN PAM
uucauuagaguuuuuacugu

SEQ ID NO: 19698 - RNA, 20 nt, Artificial Sequence
  targeting sequence with CTCN PAM
uauguugucuaccucuuuca

SEQ ID NO: 19699 - RNA, 20 nt, Artificial Sequence
  targeting sequence with CTCN PAM
gaaauuaccugucugaucuc

SEQ ID NO: 19700 - RNA, 20 nt, Artificial Sequence
  targeting sequence with CTCN PAM
aaggcauuugucauuacuau

SEQ ID NO: 19701 - RNA, 20 nt, Artificial Sequence
  targeting sequence with CTCN PAM
caaaggcauuugucauuacu

SEQ ID NO: 19702 - RNA, 20 nt, Artificial Sequence
  targeting sequence with CTCN PAM
uuauauuucaguuuggguag

SEQ ID NO: 19703 - RNA, 20 nt, Artificial Sequence
  targeting sequence with CTCN PAM
uuucucuuuauauuucaguu

SEQ ID NO: 19704 - RNA, 20 nt, Artificial Sequence
  targeting sequence with CTCN PAM
aggugggaaaaucucuuuuc

SEQ ID NO: 19705 - RNA, 20 nt, Artificial Sequence
  targeting sequence with CTCN PAM
ucuucuggacuucugccaca

SEQ ID NO: 19706 - RNA, 20 nt, Artificial Sequence
  targeting sequence with CTCN PAM
guugucucuucuucuggacu

SEQ ID NO: 19707 - RNA, 20 nt, Artificial Sequence
  targeting sequence with CTCN PAM
guaguuuagugucuuaucac

SEQ ID NO: 19708 - RNA, 20 nt, Artificial Sequence
  targeting sequence with CTCN PAM
gaaaacaggcugggcauggu

SEQ ID NO: 19709 - RNA, 20 nt, Artificial Sequence
  targeting sequence with CTCN PAM
ugccuauaaucccagcacuu

SEQ ID NO: 19710 - RNA, 20 nt, Artificial Sequence
  targeting sequence with CTCN PAM
gccuuccaaagugcugggau

SEQ ID NO: 19711 - RNA, 20 nt, Artificial Sequence
  targeting sequence with CTCN PAM
cgccucagccuuccaaagug

SEQ ID NO: 19712 - RNA, 20 nt, Artificial Sequence
  targeting sequence with CTCN PAM
agccauccucccgccucagc

SEQ ID NO: 19713 - RNA, 20 nt, Artificial Sequence
  targeting sequence with CTCN PAM
ugggcucaagccauccuccc

SEQ ID NO: 19714 - RNA, 20 nt, Artificial Sequence
  targeting sequence with CTCN PAM
cuaugcugcccaggcugguc

SEQ ID NO: 19715 - RNA, 20 nt, Artificial Sequence
  targeting sequence with CTCN PAM
ucccuaaaaauaaacaaaaa

SEQ ID NO: 19716 - RNA, 20 nt, Artificial Sequence
  targeting sequence with CTCN PAM
aguagcugggaccacaggca

SEQ ID NO: 19717 - RNA, 20 nt, Artificial Sequence
  targeting sequence with CTCN PAM
cagggcccaggcuucucaag

SEQ ID NO: 19718 - RNA, 20 nt, Artificial Sequence
  targeting sequence with CTCN PAM
agggcccaagcaguccuccc

SEQ ID NO: 19719 - RNA, 20 nt, Artificial Sequence
  targeting sequence with CTCN PAM
accuccagggcccaagcagu

SEQ ID NO: 19720 - RNA, 20 nt, Artificial Sequence
  targeting sequence with CTCN PAM
uugcagccucgaccuccagg

SEQ ID NO: 19721 - RNA, 20 nt, Artificial Sequence
  targeting sequence with CTCN PAM
cggcucuuugcagccucgac

SEQ ID NO: 19722 - RNA, 20 nt, Artificial Sequence
  targeting sequence with CTCN PAM
aaaaauaaaagaaaaagaaa

SEQ ID NO: 19723 - RNA, 20 nt, Artificial Sequence
  targeting sequence with CTCN PAM
cugcagccuguaccucucca

SEQ ID NO: 19724 - RNA, 20 nt, Artificial Sequence
  targeting sequence with CTCN PAM
guugcccagguugaagugca

SEQ ID NO: 19725 - RNA, 20 nt, Artificial Sequence
  targeting sequence with CTCN PAM
cucuguugcccagguugaag

SEQ ID NO: 19726 - RNA, 20 nt, Artificial Sequence
  targeting sequence with CTCN PAM
gucucaaaaaaauaaaaaga

SEQ ID NO: 19727 - RNA, 20 nt, Artificial Sequence
  targeting sequence with CTCN PAM
aaaaaauaaaaagaaaaaac

SEQ ID NO: 19728 - RNA, 20 nt, Artificial Sequence
  targeting sequence with CTCN PAM
caaauacuuuaguauuuggc

SEQ ID NO: 19729 - RNA, 20 nt, Artificial Sequence
  targeting sequence with CTCN PAM
uuugggcugggcauggugac

SEQ ID NO: 19730 - RNA, 20 nt, Artificial Sequence
  targeting sequence with CTCN PAM
cuacuguaaucccagcacuu

SEQ ID NO: 19731 - RNA, 20 nt, Artificial Sequence
  targeting sequence with CTCN PAM
caaagugcugggauuacagu

SEQ ID NO: 19732 - RNA, 20 nt, Artificial Sequence
  targeting sequence with CTCN PAM
ggaggcugaggugggaggau

SEQ ID NO: 19733 - RNA, 20 nt, Artificial Sequence
  targeting sequence with CTCN PAM
ugagaagcugggacuauagg

SEQ ID NO: 19734 - RNA, 20 nt, Artificial Sequence
  targeting sequence with CTCN PAM
gccuccugagaagcugggac

SEQ ID NO: 19735 - RNA, 20 nt, Artificial Sequence
  targeting sequence with CTCN PAM
caccucagccuccugagaag

SEQ ID NO: 19736 - RNA, 20 nt, Artificial Sequence
  targeting sequence with CTCN PAM
uggguucaguggauccuccc

SEQ ID NO: 19737 - RNA, 20 nt, Artificial Sequence
  targeting sequence with CTCN PAM
aucucuuggguucaguggau

SEQ ID NO: 19738 - RNA, 20 nt, Artificial Sequence
  targeting sequence with CTCN PAM
cugcagccucuaucucuugg

SEQ ID NO: 19739 - RNA, 20 nt, Artificial Sequence
  targeting sequence with CTCN PAM
cauuuaugcuuucuccuuca

SEQ ID NO: 19740 - RNA, 20 nt, Artificial Sequence
  targeting sequence with CTCN PAM
uucacugcaggucauuugaa

SEQ ID NO: 19741 - RNA, 20 nt, Artificial Sequence
  targeting sequence with CTCN PAM
uuauaaaauagaagcacaag

SEQ ID NO: 19742 - RNA, 20 nt, Artificial Sequence
  targeting sequence with CTCN PAM
aaacaaaucuuucucuugac

SEQ ID NO: 19743 - RNA, 20 nt, Artificial Sequence
  targeting sequence with CTCN PAM
aagauuacgacaucaugauc

SEQ ID NO: 19744 - RNA, 20 nt, Artificial Sequence
  targeting sequence with CTCN PAM
ccuacacgagucucauccuu

SEQ ID NO: 19745 - RNA, 20 nt, Artificial Sequence
  targeting sequence with CTCN PAM
uguaggugaggacaguugga

SEQ ID NO: 19746 - RNA, 20 nt, Artificial Sequence
  targeting sequence with CTCN PAM
uccuuguccaauucauccua

SEQ ID NO: 19747 - RNA, 20 nt, Artificial Sequence
  targeting sequence with CTCN PAM
uagguaggaugaauuggaca

SEQ ID NO: 19748 - RNA, 20 nt, Artificial Sequence
  targeting sequence with CTCN PAM
caaaguccacucuucauauc

SEQ ID NO: 19749 - RNA, 20 nt, Artificial Sequence
  targeting sequence with CTCN PAM
aaguccacucuucauaucuu

SEQ ID NO: 19750 - RNA, 20 nt, Artificial Sequence
  targeting sequence with CTCN PAM
ucauaucuuaaaaugaccuu

SEQ ID NO: 19751 - RNA, 20 nt, Artificial Sequence
  targeting sequence with CTCN PAM
aaacuaagcuugucuccaaa

SEQ ID NO: 19752 - RNA, 20 nt, Artificial Sequence
  targeting sequence with CTCN PAM
aaaaggucagcaaaugggua

SEQ ID NO: 19753 - RNA, 20 nt, Artificial Sequence
  targeting sequence with CTCN PAM
caaacacagaaacacaaaug

SEQ ID NO: 19754 - RNA, 20 nt, Artificial Sequence
  targeting sequence with CTCN PAM
augcuuucauccauguuauu

SEQ ID NO: 19755 - RNA, 20 nt, Artificial Sequence
  targeting sequence with CTCN PAM
auuuguaauguugaagaaga

SEQ ID NO: 19756 - RNA, 20 nt, Artificial Sequence
  targeting sequence with CTCN PAM
uguaaucgcuucaacaguca

SEQ ID NO: 19757 - RNA, 20 nt, Artificial Sequence
  targeting sequence with CTCN PAM
uccuucuuuauauuuccaua

SEQ ID NO: 19758 - RNA, 20 nt, Artificial Sequence
  targeting sequence with CTCN PAM
uuccacacuggcuucuugaa

SEQ ID NO: 19759 - RNA, 20 nt, Artificial Sequence
  targeting sequence with CTCN PAM
aaauuaaaaaauuaucuagu

SEQ ID NO: 19760 - RNA, 20 nt, Artificial Sequence
  targeting sequence with CTCN PAM
accagaguaaagaaagaaca

SEQ ID NO: 19761 - RNA, 20 nt, Artificial Sequence
  targeting sequence with CTCN PAM
gguagaguuacauuagauuu

SEQ ID NO: 19762 - RNA, 20 nt, Artificial Sequence
  targeting sequence with CTCN PAM
guuuauucuggucuuauuuu

SEQ ID NO: 19763 - RNA, 20 nt, Artificial Sequence
  targeting sequence with CTCN PAM
gugacucaguuuauucuggu

SEQ ID NO: 19764 - RNA, 20 nt, Artificial Sequence
  targeting sequence with CTCN PAM
gacucagugacucaguuuau

SEQ ID NO: 19765 - RNA, 20 nt, Artificial Sequence
  targeting sequence with CTCN PAM
aggucacacagauaguuugu

SEQ ID NO: 19766 - RNA, 20 nt, Artificial Sequence
  targeting sequence with CTCN PAM
guucuagcguuuguaugcca

SEQ ID NO: 19767 - RNA, 20 nt, Artificial Sequence
  targeting sequence with CTCN PAM
ucuagaaguuagaagccucu

SEQ ID NO: 19768 - RNA, 20 nt, Artificial Sequence
  targeting sequence with CTCN PAM
gcuaggcacuacguuagacu

SEQ ID NO: 19769 - RNA, 20 nt, Artificial Sequence
  targeting sequence with CTCN PAM
cauucuaaggaaaucccugu

SEQ ID NO: 19770 - RNA, 20 nt, Artificial Sequence
  targeting sequence with CTCN PAM
aacaaauacauuaaaacagg

SEQ ID NO: 19771 - RNA, 20 nt, Artificial Sequence
  targeting sequence with CTCN PAM
gccugccuguuuuaauguau

SEQ ID NO: 19772 - RNA, 20 nt, Artificial Sequence
  targeting sequence with CTCN PAM
uccuuuucuggcuaugaaaa

SEQ ID NO: 19773 - RNA, 20 nt, Artificial Sequence
  targeting sequence with CTCN PAM
uuauugguaaacaauaguau

SEQ ID NO: 19774 - RNA, 20 nt, Artificial Sequence
  targeting sequence with CTCN PAM
gcaugugaugugacaaaaac

SEQ ID NO: 19775 - RNA, 20 nt, Artificial Sequence
  targeting sequence with CTCN PAM
gauggcucugcaugugaugu

SEQ ID NO: 19776 - RNA, 20 nt, Artificial Sequence
  targeting sequence with CTCN PAM
ucaggaauauggcauuuagc

SEQ ID NO: 19777 - RNA, 20 nt, Artificial Sequence
  targeting sequence with CTCN PAM
ggaauauggcauuuagcugu

SEQ ID NO: 19778 - RNA, 20 nt, Artificial Sequence
  targeting sequence with CTCN PAM
gacuccugaccucaagugau

SEQ ID NO: 19779 - RNA, 20 nt, Artificial Sequence
  targeting sequence with CTCN PAM
ugaccucaagugauccaccc

SEQ ID NO: 19780 - RNA, 20 nt, Artificial Sequence
  targeting sequence with CTCN PAM
agugauccacccaccuuggc

SEQ ID NO: 19781 - RNA, 20 nt, Artificial Sequence
  targeting sequence with CTCN PAM
cgccuguaauccuagcacuu

SEQ ID NO: 19782 - RNA, 20 nt, Artificial Sequence
  targeting sequence with CTCN PAM
aaacaaauguuacugacauu

SEQ ID NO: 19783 - RNA, 20 nt, Artificial Sequence
  targeting sequence with CTCN PAM
guucuaaaaacaaaaucuag

SEQ ID NO: 19784 - RNA, 20 nt, Artificial Sequence
  targeting sequence with CTCN PAM
gccaggaaucaaggacaaag

SEQ ID NO: 19785 - RNA, 20 nt, Artificial Sequence
  targeting sequence with CTCN PAM
uaaaacccuuagguuuuccu

SEQ ID NO: 19786 - RNA, 20 nt, Artificial Sequence
  targeting sequence with CTCN PAM
auaacagaagcgcuuuuugu

SEQ ID NO: 19787 - RNA, 20 nt, Artificial Sequence
  targeting sequence with CTCN PAM
ggugugguugaaaggaauac

SEQ ID NO: 19788 - RNA, 20 nt, Artificial Sequence
  targeting sequence with CTCN PAM
uggugggccucuagauagcu

SEQ ID NO: 19789 - RNA, 20 nt, Artificial Sequence
  targeting sequence with CTCN PAM
agauagcuucaggauagggc

SEQ ID NO: 19790 - RNA, 20 nt, Artificial Sequence
  targeting sequence with CTCN PAM
aaucgcuugguugguucccc

SEQ ID NO: 19791 - RNA, 20 nt, Artificial Sequence
  targeting sequence with CTCN PAM
acuccucaaccuuuggggaa

SEQ ID NO: 19792 - RNA, 20 nt, Artificial Sequence
  targeting sequence with CTCN PAM
ucaaccuuuggggaagagag

SEQ ID NO: 19793 - RNA, 20 nt, Artificial Sequence
  targeting sequence with CTCN PAM
accuuuggggaagagagagg

SEQ ID NO: 19794 - RNA, 20 nt, Artificial Sequence
  targeting sequence with CTCN PAM
uccccaaagguugaggagug

SEQ ID NO: 19795 - RNA, 20 nt, Artificial Sequence
  targeting sequence with CTCN PAM
cuuccccaaagguugaggag

SEQ ID NO: 19796 - RNA, 20 nt, Artificial Sequence
  targeting sequence with CTCN PAM
cucuuccccaaagguugagg

SEQ ID NO: 19797 - RNA, 20 nt, Artificial Sequence
  targeting sequence with CTCN PAM
auguauucacuaccugggaa

SEQ ID NO: 19798 - RNA, 20 nt, Artificial Sequence
  targeting sequence with CTCN PAM
cagcaccuccauguauucac

SEQ ID NO: 19799 - RNA, 20 nt, Artificial Sequence
  targeting sequence with CTCN PAM
gggcacaaaacccucccagc

SEQ ID NO: 19800 - RNA, 20 nt, Artificial Sequence
  targeting sequence with CTCN PAM
cugggcacaaaacccuccca

SEQ ID NO: 19801 - RNA, 20 nt, Artificial Sequence
  targeting sequence with CTCN PAM
caccccucccccauagcuug

SEQ ID NO: 19802 - RNA, 20 nt, Artificial Sequence
  targeting sequence with CTCN PAM
cccauagcuugcccuaugua

SEQ ID NO: 19803 - RNA, 20 nt, Artificial Sequence
  targeting sequence with CTCN PAM
ggaacagcuaaaugaaauaa

SEQ ID NO: 19804 - RNA, 20 nt, Artificial Sequence
  targeting sequence with CTCN PAM
ggaaaacacuuauguuuauc

SEQ ID NO: 19805 - RNA, 20 nt, Artificial Sequence
  targeting sequence with CTCN PAM
uagaacucaggaaaacacuu

SEQ ID NO: 19806 - RNA, 20 nt, Artificial Sequence
  targeting sequence with CTCN PAM
gguucguuaauucacuggaa

SEQ ID NO: 19807 - RNA, 20 nt, Artificial Sequence
  targeting sequence with CTCN PAM
ugaccccuuccucagguucg

SEQ ID NO: 19808 - RNA, 20 nt, Artificial Sequence
  targeting sequence with CTCN PAM
agcagcagcagucuuuuggg

SEQ ID NO: 19809 - RNA, 20 nt, Artificial Sequence
  targeting sequence with CTCN PAM
gucccaaaagacugcugcug

SEQ ID NO: 19810 - RNA, 20 nt, Artificial Sequence
  targeting sequence with CTCN PAM
aguuaaagggcucaguccca

SEQ ID NO: 19811 - RNA, 20 nt, Artificial Sequence
  targeting sequence with CTCN PAM
agguagacagugucagaauu

SEQ ID NO: 19812 - RNA, 20 nt, Artificial Sequence
  targeting sequence with CTCN PAM
gugucauagaacugaaggug

SEQ ID NO: 19813 - RNA, 20 nt, Artificial Sequence
  targeting sequence with CTCN PAM
caacuuaccuugaugcacau

SEQ ID NO: 19814 - RNA, 20 nt, Artificial Sequence
  targeting sequence with CTCN PAM
gucucaaaaaaaaaauaaaa

SEQ ID NO: 19815 - RNA, 20 nt, Artificial Sequence
  targeting sequence with CTCN PAM
uuuagcccaggcuggaguau

SEQ ID NO: 19816 - RNA, 20 nt, Artificial Sequence
  targeting sequence with CTCN PAM
agccugggcuaaaagagcga

SEQ ID NO: 19817 - RNA, 20 nt, Artificial Sequence
  targeting sequence with CTCN PAM
gcucacugcaaccucuaccu

SEQ ID NO: 19818 - RNA, 20 nt, Artificial Sequence
  targeting sequence with CTCN PAM
cugcaaccucuaccucccaa

SEQ ID NO: 19819 - RNA, 20 nt, Artificial Sequence
  targeting sequence with CTCN PAM
accucccaaguucaagugau

SEQ ID NO: 19820 - RNA, 20 nt, Artificial Sequence
  targeting sequence with CTCN PAM
caaguucaagugauucuccu

SEQ ID NO: 19821 - RNA, 20 nt, Artificial Sequence
  targeting sequence with CTCN PAM
ugccucagccucccaaguag

SEQ ID NO: 19822 - RNA, 20 nt, Artificial Sequence
  targeting sequence with CTCN PAM
gccucccaaguagcugggau

SEQ ID NO: 19823 - RNA, 20 nt, Artificial Sequence
  targeting sequence with CTCN PAM
caaguagcugggauuacggg

SEQ ID NO: 19824 - RNA, 20 nt, Artificial Sequence
  targeting sequence with CTCN PAM
acuaaaaaaaaaaguaaaaa

SEQ ID NO: 19825 - RNA, 20 nt, Artificial Sequence
  targeting sequence with CTCN PAM
ugaccucaggugaucugccc

SEQ ID NO: 19826 - RNA, 20 nt, Artificial Sequence
  targeting sequence with CTCN PAM
ggugaucugcccgccucggc

SEQ ID NO: 19827 - RNA, 20 nt, Artificial Sequence
  targeting sequence with CTCN PAM
gccucccaaagcacugggau

SEQ ID NO: 19828 - RNA, 20 nt, Artificial Sequence
  targeting sequence with CTCN PAM
caaagcacugggauuacagg

SEQ ID NO: 19829 - RNA, 20 nt, Artificial Sequence
  targeting sequence with CTCN PAM
cgccuguaaucccagugcuu

SEQ ID NO: 19830 - RNA, 20 nt, Artificial Sequence
  targeting sequence with CTCN PAM
aagucuuaauaggcauguuu

SEQ ID NO: 19831 - RNA, 20 nt, Artificial Sequence
  targeting sequence with CTCN PAM
guuuuagacauaaauuaaac

SEQ ID NO: 19832 - RNA, 20 nt, Artificial Sequence
  targeting sequence with CTCN PAM
ugcaaacuuguuucucuuuc

SEQ ID NO: 19833 - RNA, 20 nt, Artificial Sequence
  targeting sequence with CTCN PAM
uucuuucagucuucuccauc

SEQ ID NO: 19834 - RNA, 20 nt, Artificial Sequence
  targeting sequence with CTCN PAM
aucucaauaaaugacaacug

SEQ ID NO: 19835 - RNA, 20 nt, Artificial Sequence
  targeting sequence with CTCN PAM
auaaaugacaacugcauucu

SEQ ID NO: 19836 - RNA, 20 nt, Artificial Sequence
  targeting sequence with CTCN PAM
auacaaaaaccuuaacucuu

SEQ ID NO: 19837 - RNA, 20 nt, Artificial Sequence
  targeting sequence with CTCN PAM
uuccuuucuuucacagcaca

SEQ ID NO: 19838 - RNA, 20 nt, Artificial Sequence
  targeting sequence with CTCN PAM
acuugaaaaauauauccaga

SEQ ID NO: 19839 - RNA, 20 nt, Artificial Sequence
  targeting sequence with CTCN PAM
cuagcacaaaccacauuuuc

SEQ ID NO: 19840 - RNA, 20 nt, Artificial Sequence
  targeting sequence with CTCN PAM
agcacaaaccacauuuucuc

SEQ ID NO: 19841 - RNA, 20 nt, Artificial Sequence
  targeting sequence with CTCN PAM
caccuugauuacaguaauag

SEQ ID NO: 19842 - RNA, 20 nt, Artificial Sequence
  targeting sequence with CTCN PAM
ccuugauuacaguaauaggc

SEQ ID NO: 19843 - RNA, 20 nt, Artificial Sequence
  targeting sequence with CTCN PAM
aaacuaguauuucugcuuuu

SEQ ID NO: 19844 - RNA, 20 nt, Artificial Sequence
  targeting sequence with CTCN PAM
gcagccaaagaaaugaaaau

SEQ ID NO: 19845 - RNA, 20 nt, Artificial Sequence
  targeting sequence with CTCN PAM
aaagacuuccuauuuugcuc

SEQ ID NO: 19846 - RNA, 20 nt, Artificial Sequence
  targeting sequence with CTCN PAM
guguaaaugcugaaguccua

SEQ ID NO: 19847 - RNA, 20 nt, Artificial Sequence
  targeting sequence with CTCN PAM
caggugcugcugcugcugcu

SEQ ID NO: 19848 - RNA, 20 nt, Artificial Sequence
  targeting sequence with CTCN PAM
aauuucauaggucuggggua

SEQ ID NO: 19849 - RNA, 20 nt, Artificial Sequence
  targeting sequence with CTCN PAM
ccauuccucaggcaagcuuc

SEQ ID NO: 19850 - RNA, 20 nt, Artificial Sequence
  targeting sequence with CTCN PAM
ggcaagcuucugucucagga

SEQ ID NO: 19851 - RNA, 20 nt, Artificial Sequence
  targeting sequence with CTCN PAM
ggacauguacacugugauuc

SEQ ID NO: 19852 - RNA, 20 nt, Artificial Sequence
  targeting sequence with CTCN PAM
ucucauauauguguauggcu

SEQ ID NO: 19853 - RNA, 20 nt, Artificial Sequence
  targeting sequence with CTCN PAM
uauauguguauggcucacuc

SEQ ID NO: 19854 - RNA, 20 nt, Artificial Sequence
  targeting sequence with CTCN PAM
cuccuucacuucuuucaagc

SEQ ID NO: 19855 - RNA, 20 nt, Artificial Sequence
  targeting sequence with CTCN PAM
uucacuucuuucaagcccuu

SEQ ID NO: 19856 - RNA, 20 nt, Artificial Sequence
  targeting sequence with CTCN PAM
cuuccccccugcaguccuug

SEQ ID NO: 19857 - RNA, 20 nt, Artificial Sequence
  targeting sequence with CTCN PAM
gaacccauuaagcaauaacg

SEQ ID NO: 19858 - RNA, 20 nt, Artificial Sequence
  targeting sequence with CTCN PAM
auauuuccauaauguuucau

SEQ ID NO: 19859 - RNA, 20 nt, Artificial Sequence
  targeting sequence with CTCN PAM
gcuuugcugggcguuuuguu

SEQ ID NO: 19860 - RNA, 20 nt, Artificial Sequence
  targeting sequence with CTCN PAM
acagcgugggagcggcaaga

SEQ ID NO: 19861 - RNA, 20 nt, Artificial Sequence
  targeting sequence with CTCN PAM
cacgcuguggaguguacuuu

SEQ ID NO: 19862 - RNA, 20 nt, Artificial Sequence
  targeting sequence with CTCN PAM
ugccgcucccacgcugugga

SEQ ID NO: 19863 - RNA, 20 nt, Artificial Sequence
  targeting sequence with CTCN PAM
agggccagccauacagaauc

SEQ ID NO: 19864 - RNA, 20 nt, Artificial Sequence
  targeting sequence with CTCN PAM
agaaguuucccacugggcac

SEQ ID NO: 19865 - RNA, 20 nt, Artificial Sequence
  targeting sequence with CTCN PAM
uguaaaugaagugguagccc

SEQ ID NO: 19866 - RNA, 20 nt, Artificial Sequence
  targeting sequence with CTCN PAM
gauugguugcaaaaaccacc

SEQ ID NO: 19867 - RNA, 20 nt, Artificial Sequence
  targeting sequence with CTCN PAM
gcugcaaucagucugauugg

SEQ ID NO: 19868 - RNA, 20 nt, Artificial Sequence
  targeting sequence with CTCN PAM
gaaugguugcuguccacaac

SEQ ID NO: 19869 - RNA, 20 nt, Artificial Sequence
  targeting sequence with CTCN PAM
agccucugaaugguugcugu

SEQ ID NO: 19870 - RNA, 20 nt, Artificial Sequence
  targeting sequence with CTCN PAM
acaggcaaucagucugauug

SEQ ID NO: 19871 - RNA, 20 nt, Artificial Sequence
  targeting sequence with CTCN PAM
cuuugcaaacccccagccuu

SEQ ID NO: 19872 - RNA, 20 nt, Artificial Sequence
  targeting sequence with CTCN PAM
ggucguuuuuuacuuaggca

SEQ ID NO: 19873 - RNA, 20 nt, Artificial Sequence
  targeting sequence with CTCN PAM
gacuuccuugaacuaacuug

SEQ ID NO: 19874 - RNA, 20 nt, Artificial Sequence
  targeting sequence with CTCN PAM
cuccgacuuccuugaacuaa

SEQ ID NO: 19875 - RNA, 20 nt, Artificial Sequence
  targeting sequence with CTCN PAM
auucuccugccuccuauguu

SEQ ID NO: 19876 - RNA, 20 nt, Artificial Sequence
  targeting sequence with CTCN PAM
ugccuccuauguuuuacugc

SEQ ID NO: 19877 - RNA, 20 nt, Artificial Sequence
  targeting sequence with CTCN PAM
uauguuuuacugcaguuuuu

SEQ ID NO: 19878 - RNA, 20 nt, Artificial Sequence
  targeting sequence with CTCN PAM
aaaaaaaaaaaaaaaaaaag

SEQ ID NO: 19879 - RNA, 20 nt, Artificial Sequence
  targeting sequence with CTCN PAM
ucucaaaaaaaaaaaaaaaa

SEQ ID NO: 19880 - RNA, 20 nt, Artificial Sequence
  targeting sequence with CTCN PAM
aggcuggagugcaguggcac

SEQ ID NO: 19881 - RNA, 20 nt, Artificial Sequence
  targeting sequence with CTCN PAM
agccuggagacagaacaaga

SEQ ID NO: 19882 - RNA, 20 nt, Artificial Sequence
  targeting sequence with CTCN PAM
gcucacugcaaccuccgcuu

SEQ ID NO: 19883 - RNA, 20 nt, Artificial Sequence
  targeting sequence with CTCN PAM
cugcaaccuccgcuucccag

SEQ ID NO: 19884 - RNA, 20 nt, Artificial Sequence
  targeting sequence with CTCN PAM
gcuucccagguucaagugau

SEQ ID NO: 19885 - RNA, 20 nt, Artificial Sequence
  targeting sequence with CTCN PAM
ugccucagccucccgaguag

SEQ ID NO: 19886 - RNA, 20 nt, Artificial Sequence
  targeting sequence with CTCN PAM
gccucccgaguagcugggac

SEQ ID NO: 19887 - RNA, 20 nt, Artificial Sequence
  targeting sequence with CTCN PAM
cgaguagcugggacuacagg

SEQ ID NO: 19888 - RNA, 20 nt, Artificial Sequence
  targeting sequence with CTCN PAM
ggaggcugaggcaggagaau

SEQ ID NO: 19889 - RNA, 20 nt, Artificial Sequence
  targeting sequence with CTCN PAM
cacucccucagaguaaaggc

SEQ ID NO: 19890 - RNA, 20 nt, Artificial Sequence
  targeting sequence with CTCN PAM
cucccucagaguaaaggcca

SEQ ID NO: 19891 - RNA, 20 nt, Artificial Sequence
  targeting sequence with CTCN PAM
cucagaguaaaggccaggua

SEQ ID NO: 19892 - RNA, 20 nt, Artificial Sequence
  targeting sequence with CTCN PAM
gaguaaaggccagguagccc

SEQ ID NO: 19893 - RNA, 20 nt, Artificial Sequence
  targeting sequence with CTCN PAM
gagggagugagagacacagu

SEQ ID NO: 19894 - RNA, 20 nt, Artificial Sequence
  targeting sequence with CTCN PAM
aagccccucaacaccuggcc

SEQ ID NO: 19895 - RNA, 20 nt, Artificial Sequence
  targeting sequence with CTCN PAM
acaccuggcccauguguccu

SEQ ID NO: 19896 - RNA, 20 nt, Artificial Sequence
  targeting sequence with CTCN PAM
caguuucaucugggccucac

SEQ ID NO: 19897 - RNA, 20 nt, Artificial Sequence
  targeting sequence with CTCN PAM
cucaccggacggacgcugcc

SEQ ID NO: 19898 - RNA, 20 nt, Artificial Sequence
  targeting sequence with CTCN PAM
ccggacggacgcugccuccu

SEQ ID NO: 19899 - RNA, 20 nt, Artificial Sequence
  targeting sequence with CTCN PAM
ucgcugccccucugaccggu

SEQ ID NO: 19900 - RNA, 20 nt, Artificial Sequence
  targeting sequence with CTCN PAM
cugccccucugaccggugag

SEQ ID NO: 19901 - RNA, 20 nt, Artificial Sequence
  targeting sequence with CTCN PAM
gaccggugagcgcuugugcc

SEQ ID NO: 19902 - RNA, 20 nt, Artificial Sequence
  targeting sequence with CTCN PAM
ccggucagaggggcagcgag

SEQ ID NO: 19903 - RNA, 20 nt, Artificial Sequence
  targeting sequence with CTCN PAM
cucugcugggaacuuucucc

SEQ ID NO: 19904 - RNA, 20 nt, Artificial Sequence
  targeting sequence with CTCN PAM
gcugggaacuuucuccuccc

SEQ ID NO: 19905 - RNA, 20 nt, Artificial Sequence
  targeting sequence with CTCN PAM
ucccaauauccacacagucc

SEQ ID NO: 19906 - RNA, 20 nt, Artificial Sequence
  targeting sequence with CTCN PAM
caauauccacacaguccgcc

SEQ ID NO: 19907 - RNA, 20 nt, Artificial Sequence
  targeting sequence with CTCN PAM
ccuccuucaggccuuugcuc

SEQ ID NO: 19908 - RNA, 20 nt, Artificial Sequence
  targeting sequence with CTCN PAM
uucaggccuuugcucaaugu

SEQ ID NO: 19909 - RNA, 20 nt, Artificial Sequence
  targeting sequence with CTCN PAM
augucccuauuuggugaggc

SEQ ID NO: 19910 - RNA, 20 nt, Artificial Sequence
  targeting sequence with CTCN PAM
ccaaauagggacauugagca

SEQ ID NO: 19911 - RNA, 20 nt, Artificial Sequence
  targeting sequence with CTCN PAM
ucuccacccuggcaccccag

SEQ ID NO: 19912 - RNA, 20 nt, Artificial Sequence
  targeting sequence with CTCN PAM
acccuggcaccccagccccu

SEQ ID NO: 19913 - RNA, 20 nt, Artificial Sequence
  targeting sequence with CTCN PAM
ccugcuugauuuuucucugg

SEQ ID NO: 19914 - RNA, 20 nt, Artificial Sequence
  targeting sequence with CTCN PAM
ggcugcccucagcuacgugc

SEQ ID NO: 19915 - RNA, 20 nt, Artificial Sequence
  targeting sequence with CTCN PAM
gcuacgugcguauuuuaguu

SEQ ID NO: 19916 - RNA, 20 nt, Artificial Sequence
  targeting sequence with CTCN PAM
uuucacguaauuugagcuuu

SEQ ID NO: 19917 - RNA, 20 nt, Artificial Sequence
  targeting sequence with CTCN PAM
aauuacgugaaaggagacaa

SEQ ID NO: 19918 - RNA, 20 nt, Artificial Sequence
  targeting sequence with TTCN PAM
aguuugcucauuugucucgg

SEQ ID NO: 19919 - RNA, 20 nt, Artificial Sequence
  targeting sequence with TTCN PAM
gaccucauucgaguuugcuc

SEQ ID NO: 19920 - RNA, 20 nt, Artificial Sequence
  targeting sequence with TTCN PAM
uuuccuagcaccauaacugc

SEQ ID NO: 19921 - RNA, 20 nt, Artificial Sequence
  targeting sequence with TTCN PAM
uagcaccauaacugcacggu

SEQ ID NO: 19922 - RNA, 20 nt, Artificial Sequence
  targeting sequence with TTCN PAM
agugcuuuacgaccauuagu

SEQ ID NO: 19923 - RNA, 20 nt, Artificial Sequence
  targeting sequence with TTCN PAM
ggugagugagggaaaccucu

SEQ ID NO: 19924 - RNA, 20 nt, Artificial Sequence
  targeting sequence with TTCN PAM
cucacucaccugaaagccgg

SEQ ID NO: 19925 - RNA, 20 nt, Artificial Sequence
  targeting sequence with TTCN PAM
acaggccugaaguuucugca

SEQ ID NO: 19926 - RNA, 20 nt, Artificial Sequence
  targeting sequence with TTCN PAM
ggccuguagaaaaucugcca

SEQ ID NO: 19927 - RNA, 20 nt, Artificial Sequence
  targeting sequence with TTCN PAM
gcaaaaggagacucaaacau

SEQ ID NO: 19928 - RNA, 20 nt, Artificial Sequence
  targeting sequence with TTCN PAM
uguuugagucuccuuuugca

SEQ ID NO: 19929 - RNA, 20 nt, Artificial Sequence
  targeting sequence with TTCN PAM
uuuucauguuugagucuccu

SEQ ID NO: 19930 - RNA, 20 nt, Artificial Sequence
  targeting sequence with TTCN PAM
cuggcugcacggcgagugcu

SEQ ID NO: 19931 - RNA, 20 nt, Artificial Sequence
  targeting sequence with TTCN PAM
ugagaugcauaagccuccag

SEQ ID NO: 19932 - RNA, 20 nt, Artificial Sequence
  targeting sequence with TTCN PAM
guuccugagaugcauaagcc

SEQ ID NO: 19933 - RNA, 20 nt, Artificial Sequence
  targeting sequence with TTCN PAM
uuucuuuucuuuucuuuuuc

SEQ ID NO: 19934 - RNA, 20 nt, Artificial Sequence
  targeting sequence with TTCN PAM
uuucuuuucuuuuucuuuuu

SEQ ID NO: 19935 - RNA, 20 nt, Artificial Sequence
  targeting sequence with TTCN PAM
uuucuuuuucuuuuuucgag

SEQ ID NO: 19936 - RNA, 20 nt, Artificial Sequence
  targeting sequence with TTCN PAM
uuuucuuuuuucgagacaac

SEQ ID NO: 19937 - RNA, 20 nt, Artificial Sequence
  targeting sequence with TTCN PAM
uuuuucgagacaacggaguc

SEQ ID NO: 19938 - RNA, 20 nt, Artificial Sequence
  targeting sequence with TTCN PAM
agacaacggagucuuguucu

SEQ ID NO: 19939 - RNA, 20 nt, Artificial Sequence
  targeting sequence with TTCN PAM
gucgcccaggcuggagugca

SEQ ID NO: 19940 - RNA, 20 nt, Artificial Sequence
  targeting sequence with TTCN PAM
ggguucacgccauucuccug

SEQ ID NO: 19941 - RNA, 20 nt, Artificial Sequence
  targeting sequence with TTCN PAM
cgccauucuccugccucagc

SEQ ID NO: 19942 - RNA, 20 nt, Artificial Sequence
  targeting sequence with TTCN PAM
ccugccucagccuccugagu

SEQ ID NO: 19943 - RNA, 20 nt, Artificial Sequence
  targeting sequence with TTCN PAM
cacccagcaccccgcacuca

SEQ ID NO: 19944 - RNA, 20 nt, Artificial Sequence
  targeting sequence with TTCN PAM
uuccccuggaggucaacacc

SEQ ID NO: 19945 - RNA, 20 nt, Artificial Sequence
  targeting sequence with TTCN PAM
ccuggaggucaacacccaaa

SEQ ID NO: 19946 - RNA, 20 nt, Artificial Sequence
  targeting sequence with TTCN PAM
caagaggugaaacauaauca

SEQ ID NO: 19947 - RNA, 20 nt, Artificial Sequence
  targeting sequence with TTCN PAM
ccucuugggaaugauacaca

SEQ ID NO: 19948 - RNA, 20 nt, Artificial Sequence
  targeting sequence with TTCN PAM
gagccuuugauuauguuuca

SEQ ID NO: 19949 - RNA, 20 nt, Artificial Sequence
  targeting sequence with TTCN PAM
ugccuuugccacagcaaacu

SEQ ID NO: 19950 - RNA, 20 nt, Artificial Sequence
  targeting sequence with TTCN PAM
caaagcaccagaucuuuccu

SEQ ID NO: 19951 - RNA, 20 nt, Artificial Sequence
  targeting sequence with TTCN PAM
uuuuguauuuuaacggcaua

SEQ ID NO: 19952 - RNA, 20 nt, Artificial Sequence
  targeting sequence with TTCN PAM
gauuucacagcucccuucca

SEQ ID NO: 19953 - RNA, 20 nt, Artificial Sequence
  targeting sequence with TTCN PAM
cagcucccuuccaaggcuuc

SEQ ID NO: 19954 - RNA, 20 nt, Artificial Sequence
  targeting sequence with TTCN PAM
aaggcuucauagccucaagu

SEQ ID NO: 19955 - RNA, 20 nt, Artificial Sequence
  targeting sequence with TTCN PAM
uagccucaaguguaacccuc

SEQ ID NO: 19956 - RNA, 20 nt, Artificial Sequence
  targeting sequence with TTCN PAM
uccucacugcugcgugcacc

SEQ ID NO: 19957 - RNA, 20 nt, Artificial Sequence
  targeting sequence with TTCN PAM
ugcugauguuuguggccccu

SEQ ID NO: 19958 - RNA, 20 nt, Artificial Sequence
  targeting sequence with TTCN PAM
agagagugacucacccaucc

SEQ ID NO: 19959 - RNA, 20 nt, Artificial Sequence
  targeting sequence with TTCN PAM
cuguccucugggcucucuua

SEQ ID NO: 19960 - RNA, 20 nt, Artificial Sequence
  targeting sequence with TTCN PAM
agaccaucaaugaggcguug

SEQ ID NO: 19961 - RNA, 20 nt, Artificial Sequence
  targeting sequence with TTCN PAM
cacuugaugguuuacaauug

SEQ ID NO: 19962 - RNA, 20 nt, Artificial Sequence
  targeting sequence with TTCN PAM
uccucucacuuccccauuuu

SEQ ID NO: 19963 - RNA, 20 nt, Artificial Sequence
  targeting sequence with TTCN PAM
ccauuuuugcugcaauguua

SEQ ID NO: 19964 - RNA, 20 nt, Artificial Sequence
  targeting sequence with TTCN PAM
agguagguaagucuguagcg

SEQ ID NO: 19965 - RNA, 20 nt, Artificial Sequence
  targeting sequence with TTCN PAM
aaccgugauggaaacauugu

SEQ ID NO: 19966 - RNA, 20 nt, Artificial Sequence
  targeting sequence with TTCN PAM
aucacgguuagaauuccagg

SEQ ID NO: 19967 - RNA, 20 nt, Artificial Sequence
  targeting sequence with TTCN PAM
acagaccugggcugggcuca

SEQ ID NO: 19968 - RNA, 20 nt, Artificial Sequence
  targeting sequence with TTCN PAM
gagcccagcccaggucuguu

SEQ ID NO: 19969 - RNA, 20 nt, Artificial Sequence
  targeting sequence with TTCN PAM
gugcagagggaaaugcucuc

SEQ ID NO: 19970 - RNA, 20 nt, Artificial Sequence
  targeting sequence with TTCN PAM
cucugcacagaacacuuggg

SEQ ID NO: 19971 - RNA, 20 nt, Artificial Sequence
  targeting sequence with TTCN PAM
ugugucccuaggaguuauuu

SEQ ID NO: 19972 - RNA, 20 nt, Artificial Sequence
  targeting sequence with TTCN PAM
acagccacauuucauguguc

SEQ ID NO: 19973 - RNA, 20 nt, Artificial Sequence
  targeting sequence with TTCN PAM
ugcacucuaauuaauugaau

SEQ ID NO: 19974 - RNA, 20 nt, Artificial Sequence
  targeting sequence with TTCN PAM
auuaauuagagugcaagaaa

SEQ ID NO: 19975 - RNA, 20 nt, Artificial Sequence
  targeting sequence with TTCN PAM
guguggcagucacuaccggg

SEQ ID NO: 19976 - RNA, 20 nt, Artificial Sequence
  targeting sequence with TTCN PAM
gagauauaaagaugaagaag

SEQ ID NO: 19977 - RNA, 20 nt, Artificial Sequence
  targeting sequence with TTCN PAM
ucuuuauaucucugaagcug

SEQ ID NO: 19978 - RNA, 20 nt, Artificial Sequence
  targeting sequence with TTCN PAM
ucaucuuuauaucucugaag

SEQ ID NO: 19979 - RNA, 20 nt, Artificial Sequence
  targeting sequence with TTCN PAM
ucuacccugguguuuccuug

SEQ ID NO: 19980 - RNA, 20 nt, Artificial Sequence
  targeting sequence with TTCN PAM
acccugguguuuccuugcag

SEQ ID NO: 19981 - RNA, 20 nt, Artificial Sequence
  targeting sequence with TTCN PAM
uugcagaguaggugucugcu

SEQ ID NO: 19982 - RNA, 20 nt, Artificial Sequence
  targeting sequence with TTCN PAM
ugggcacagguacaggggcc

SEQ ID NO: 19983 - RNA, 20 nt, Artificial Sequence
  targeting sequence with TTCN PAM
cagcaggggcugcacuugua

SEQ ID NO: 19984 - RNA, 20 nt, Artificial Sequence
  targeting sequence with TTCN PAM
ccucuguguacaagugcagc

SEQ ID NO: 19985 - RNA, 20 nt, Artificial Sequence
  targeting sequence with TTCN PAM
ggagcccacgcucaucuccu

SEQ ID NO: 19986 - RNA, 20 nt, Artificial Sequence
  targeting sequence with TTCN PAM
cgggcucugauccaggguca

SEQ ID NO: 19987 - RNA, 20 nt, Artificial Sequence
  targeting sequence with TTCN PAM
uccucacccugucuagccug

SEQ ID NO: 19988 - RNA, 20 nt, Artificial Sequence
  targeting sequence with TTCN PAM
augccugagcuagaucucag

SEQ ID NO: 19989 - RNA, 20 nt, Artificial Sequence
  targeting sequence with TTCN PAM
uuuuuagagacaggucucac

SEQ ID NO: 19990 - RNA, 20 nt, Artificial Sequence
  targeting sequence with TTCN PAM
ucuuuuuuagagacaggucu

SEQ ID NO: 19991 - RNA, 20 nt, Artificial Sequence
  targeting sequence with TTCN PAM
uucuucuuuuuuagagacag

SEQ ID NO: 19992 - RNA, 20 nt, Artificial Sequence
  targeting sequence with TTCN PAM
cuaugucuccuccccaggac

SEQ ID NO: 19993 - RNA, 20 nt, Artificial Sequence
  targeting sequence with TTCN PAM
aagcugggcaggaguccugg

SEQ ID NO: 19994 - RNA, 20 nt, Artificial Sequence
  targeting sequence with TTCN PAM
ccugugccuuugugugcuau

SEQ ID NO: 19995 - RNA, 20 nt, Artificial Sequence
  targeting sequence with TTCN PAM
cuguguacccaccaguuccc

SEQ ID NO: 19996 - RNA, 20 nt, Artificial Sequence
  targeting sequence with TTCN PAM
uggccauguggccuuggggg

SEQ ID NO: 19997 - RNA, 20 nt, Artificial Sequence
  targeting sequence with TTCN PAM
guuucuuugaggaccuccca

SEQ ID NO: 19998 - RNA, 20 nt, Artificial Sequence
  targeting sequence with TTCN PAM
uugaggaccucccauucccc

SEQ ID NO: 19999 - RNA, 20 nt, Artificial Sequence
  targeting sequence with TTCN PAM
cccugcugcagauggaagag

SEQ ID NO: 20000 - RNA, 20 nt, Artificial Sequence
  targeting sequence with TTCN PAM
aucugcagcagggggaaugg

SEQ ID NO: 20001 - RNA, 20 nt, Artificial Sequence
  targeting sequence with TTCN PAM
gggcucauguuacagcuuuc

SEQ ID NO: 20002 - RNA, 20 nt, Artificial Sequence
  targeting sequence with TTCN PAM
acuguuaacucacccuccua

SEQ ID NO: 20003 - RNA, 20 nt, Artificial Sequence
  targeting sequence with TTCN PAM
ugggacgauccaaugagauc

SEQ ID NO: 20004 - RNA, 20 nt, Artificial Sequence
  targeting sequence with TTCN PAM
aacuuagaaaugaggacaca

SEQ ID NO: 20005 - RNA, 20 nt, Artificial Sequence
  targeting sequence with TTCN PAM
aaguuagaaaugauaauuuc

SEQ ID NO: 20006 - RNA, 20 nt, Artificial Sequence
  targeting sequence with TTCN PAM
aaguguguccucauuucuaa

SEQ ID NO: 20007 - RNA, 20 nt, Artificial Sequence
  targeting sequence with TTCN PAM
agacuggccuaggcaacaua

SEQ ID NO: 20008 - RNA, 20 nt, Artificial Sequence
  targeting sequence with TTCN PAM
cagaaucacgugggggcugc

SEQ ID NO: 20009 - RNA, 20 nt, Artificial Sequence
  targeting sequence with TTCN PAM
gggaaaacccacacaccaca

SEQ ID NO: 20010 - RNA, 20 nt, Artificial Sequence
  targeting sequence with TTCN PAM
ccaccccaucccagcugcuu

SEQ ID NO: 20011 - RNA, 20 nt, Artificial Sequence
  targeting sequence with TTCN PAM
cucuacuccaggcaaagcca

SEQ ID NO: 20012 - RNA, 20 nt, Artificial Sequence
  targeting sequence with TTCN PAM
guugacucagaugggggcag

SEQ ID NO: 20013 - RNA, 20 nt, Artificial Sequence
  targeting sequence with TTCN PAM
uaagggccgcaggggucacc

SEQ ID NO: 20014 - RNA, 20 nt, Artificial Sequence
  targeting sequence with TTCN PAM
ugccccauggccugggguga

SEQ ID NO: 20015 - RNA, 20 nt, Artificial Sequence
  targeting sequence with TTCN PAM
gguccugugcagcagcuggc

SEQ ID NO: 20016 - RNA, 20 nt, Artificial Sequence
  targeting sequence with TTCN PAM
guguacuuuucagguccugu

SEQ ID NO: 20017 - RNA, 20 nt, Artificial Sequence
  targeting sequence with TTCN PAM
caccggccaaggccaguccu

SEQ ID NO: 20018 - RNA, 20 nt, Artificial Sequence
  targeting sequence with TTCN PAM
uucccaccggccaaggccag

SEQ ID NO: 20019 - RNA, 20 nt, Artificial Sequence
  targeting sequence with TTCN PAM
ccgcagcccagcucugagca

SEQ ID NO: 20020 - RNA, 20 nt, Artificial Sequence
  targeting sequence with TTCN PAM
uuccuuugugucgcccagug

SEQ ID NO: 20021 - RNA, 20 nt, Artificial Sequence
  targeting sequence with TTCN PAM
uuugugucgcccaguggcac

SEQ ID NO: 20022 - RNA, 20 nt, Artificial Sequence
  targeting sequence with TTCN PAM
agagaucuuuucaccucggc

SEQ ID NO: 20023 - RNA, 20 nt, Artificial Sequence
  targeting sequence with TTCN PAM
ccucggccuccugaguagcu

SEQ ID NO: 20024 - RNA, 20 nt, Artificial Sequence
  targeting sequence with TTCN PAM
acuguagcucccagcugcag

SEQ ID NO: 20025 - RNA, 20 nt, Artificial Sequence
  targeting sequence with TTCN PAM
uuguccaaaacacagugauc

SEQ ID NO: 20026 - RNA, 20 nt, Artificial Sequence
  targeting sequence with TTCN PAM
gauauaccauugauggcagu

SEQ ID NO: 20027 - RNA, 20 nt, Artificial Sequence
  targeting sequence with TTCN PAM
acaugauucugauauaccau

SEQ ID NO: 20028 - RNA, 20 nt, Artificial Sequence
  targeting sequence with TTCN PAM
auugcuguuacuggaaggag

SEQ ID NO: 20029 - RNA, 20 nt, Artificial Sequence
  targeting sequence with TTCN PAM
aguaacagcaauagaacacc

SEQ ID NO: 20030 - RNA, 20 nt, Artificial Sequence
  targeting sequence with TTCN PAM
ugguguuuugaacaaaaaac

SEQ ID NO: 20031 - RNA, 20 nt, Artificial Sequence
  targeting sequence with TTCN PAM
aaacaccaagaaccuagaca

SEQ ID NO: 20032 - RNA, 20 nt, Artificial Sequence
  targeting sequence with TTCN PAM
uuuguuacuuagugcauuuu

SEQ ID NO: 20033 - RNA, 20 nt, Artificial Sequence
  targeting sequence with TTCN PAM
uuccuuuguuacuuagugca

SEQ ID NO: 20034 - RNA, 20 nt, Artificial Sequence
  targeting sequence with TTCN PAM
auccuguguuucauuccuuu

SEQ ID NO: 20035 - RNA, 20 nt, Artificial Sequence
  targeting sequence with TTCN PAM
cucuuuuauaaaucccugau

SEQ ID NO: 20036 - RNA, 20 nt, Artificial Sequence
  targeting sequence with TTCN PAM
ggguuucaagcacuccuuuu

SEQ ID NO: 20037 - RNA, 20 nt, Artificial Sequence
  targeting sequence with TTCN PAM
agcacuccuuuugagguucc

SEQ ID NO: 20038 - RNA, 20 nt, Artificial Sequence
  targeting sequence with TTCN PAM
uaucaguuaccccuuauaua

SEQ ID NO: 20039 - RNA, 20 nt, Artificial Sequence
  targeting sequence with TTCN PAM
acuauauaagggguaacuga

SEQ ID NO: 20040 - RNA, 20 nt, Artificial Sequence
  targeting sequence with TTCN PAM
ccucaguguuuacuuagcca

SEQ ID NO: 20041 - RNA, 20 nt, Artificial Sequence
  targeting sequence with TTCN PAM
ucugcauagggugccauuca

SEQ ID NO: 20042 - RNA, 20 nt, Artificial Sequence
  targeting sequence with TTCN PAM
accauggcuuagacaaaaag

SEQ ID NO: 20043 - RNA, 20 nt, Artificial Sequence
  targeting sequence with TTCN PAM
acaacccucccccuuccacc

SEQ ID NO: 20044 - RNA, 20 nt, Artificial Sequence
  targeting sequence with TTCN PAM
uuucgguuuagcuucaggaa

SEQ ID NO: 20045 - RNA, 20 nt, Artificial Sequence
  targeting sequence with TTCN PAM
guuuagcuucaggaaguugg

SEQ ID NO: 20046 - RNA, 20 nt, Artificial Sequence
  targeting sequence with TTCN PAM
ggaaguuggcauuaacuggc

SEQ ID NO: 20047 - RNA, 20 nt, Artificial Sequence
  targeting sequence with TTCN PAM
ugaagcuaaaccgaaaggaa

SEQ ID NO: 20048 - RNA, 20 nt, Artificial Sequence
  targeting sequence with TTCN PAM
cuuuugauccagcuuuggga

SEQ ID NO: 20049 - RNA, 20 nt, Artificial Sequence
  targeting sequence with TTCN PAM
caaagcuggaucaaaaggga

SEQ ID NO: 20050 - RNA, 20 nt, Artificial Sequence
  targeting sequence with TTCN PAM
cugcuuccccccagaccuug

SEQ ID NO: 20051 - RNA, 20 nt, Artificial Sequence
  targeting sequence with TTCN PAM
ccccagaccuugguguuuuu

SEQ ID NO: 20052 - RNA, 20 nt, Artificial Sequence
  targeting sequence with TTCN PAM
uugauucagcaugaauuggc

SEQ ID NO: 20053 - RNA, 20 nt, Artificial Sequence
  targeting sequence with TTCN PAM
gcaugaauuggccuuaaguu

SEQ ID NO: 20054 - RNA, 20 nt, Artificial Sequence
  targeting sequence with TTCN PAM
ugcugaaucaaggaaaaaca

SEQ ID NO: 20055 - RNA, 20 nt, Artificial Sequence
  targeting sequence with TTCN PAM
uugccuccagacuguacuau

SEQ ID NO: 20056 - RNA, 20 nt, Artificial Sequence
  targeting sequence with TTCN PAM
uguuaauacuggucuauugu

SEQ ID NO: 20057 - RNA, 20 nt, Artificial Sequence
  targeting sequence with TTCN PAM
aaccaucaugggcauaaggg

SEQ ID NO: 20058 - RNA, 20 nt, Artificial Sequence
  targeting sequence with TTCN PAM
aaaaaaccccuaaaaaacua

SEQ ID NO: 20059 - RNA, 20 nt, Artificial Sequence
  targeting sequence with TTCN PAM
ccuucuccaaggggaggggu

SEQ ID NO: 20060 - RNA, 20 nt, Artificial Sequence
  targeting sequence with TTCN PAM
ccaaggggagggguucauuc

SEQ ID NO: 20061 - RNA, 20 nt, Artificial Sequence
  targeting sequence with TTCN PAM
uucaauggaggcacagaggg

SEQ ID NO: 20062 - RNA, 20 nt, Artificial Sequence
  targeting sequence with TTCN PAM
auggaggcacagagggcuua

SEQ ID NO: 20063 - RNA, 20 nt, Artificial Sequence
  targeting sequence with TTCN PAM
cuuuaagcuuguguaaacca

SEQ ID NO: 20064 - RNA, 20 nt, Artificial Sequence
  targeting sequence with TTCN PAM
auacuaaaacuaaaagaugg

SEQ ID NO: 20065 - RNA, 20 nt, Artificial Sequence
  targeting sequence with TTCN PAM
agucccaucuuuuaguuuua

SEQ ID NO: 20066 - RNA, 20 nt, Artificial Sequence
  targeting sequence with TTCN PAM
aagauaaagaccccaaacag

SEQ ID NO: 20067 - RNA, 20 nt, Artificial Sequence
  targeting sequence with TTCN PAM
cuguuuggggucuuuaucuu

SEQ ID NO: 20068 - RNA, 20 nt, Artificial Sequence
  targeting sequence with TTCN PAM
acauccacauuugggaacca

SEQ ID NO: 20069 - RNA, 20 nt, Artificial Sequence
  targeting sequence with TTCN PAM
caaauguggauguggaagug

SEQ ID NO: 20070 - RNA, 20 nt, Artificial Sequence
  targeting sequence with TTCN PAM
ugcccaggaagccaggagag

SEQ ID NO: 20071 - RNA, 20 nt, Artificial Sequence
  targeting sequence with TTCN PAM
ugggcaggaaagagcaguca

SEQ ID NO: 20072 - RNA, 20 nt, Artificial Sequence
  targeting sequence with TTCN PAM
ggggccugcaucucuccugg

SEQ ID NO: 20073 - RNA, 20 nt, Artificial Sequence
  targeting sequence with TTCN PAM
uuguugaagaugucccggcc

SEQ ID NO: 20074 - RNA, 20 nt, Artificial Sequence
  targeting sequence with TTCN PAM
acaaggaaaggccuugcccu

SEQ ID NO: 20075 - RNA, 20 nt, Artificial Sequence
  targeting sequence with TTCN PAM
uguucccgcaugacgcagga

SEQ ID NO: 20076 - RNA, 20 nt, Artificial Sequence
  targeting sequence with TTCN PAM
cgcaugacgcaggagaauag

SEQ ID NO: 20077 - RNA, 20 nt, Artificial Sequence
  targeting sequence with TTCN PAM
ccugcgucaugcgggaacaa

SEQ ID NO: 20078 - RNA, 20 nt, Artificial Sequence
  targeting sequence with TTCN PAM
cucccuccagacccuauucu

SEQ ID NO: 20079 - RNA, 20 nt, Artificial Sequence
  targeting sequence with TTCN PAM
ugcugacuuccuagaacuga

SEQ ID NO: 20080 - RNA, 20 nt, Artificial Sequence
  targeting sequence with TTCN PAM
uagaacugaaucaaaaggaa

SEQ ID NO: 20081 - RNA, 20 nt, Artificial Sequence
  targeting sequence with TTCN PAM
aggaagucagcaugaaucgg

SEQ ID NO: 20082 - RNA, 20 nt, Artificial Sequence
  targeting sequence with TTCN PAM
guucuaggaagucagcauga

SEQ ID NO: 20083 - RNA, 20 nt, Artificial Sequence
  targeting sequence with TTCN PAM
uuuugauucaguucuaggaa

SEQ ID NO: 20084 - RNA, 20 nt, Artificial Sequence
  targeting sequence with TTCN PAM
cacccaaguaacaaaaggau

SEQ ID NO: 20085 - RNA, 20 nt, Artificial Sequence
  targeting sequence with TTCN PAM
uucauuuacguaggguauaa

SEQ ID NO: 20086 - RNA, 20 nt, Artificial Sequence
  targeting sequence with TTCN PAM
uuuacguaggguauaacaaa

SEQ ID NO: 20087 - RNA, 20 nt, Artificial Sequence
  targeting sequence with TTCN PAM
cauugguuacuuuguuauac

SEQ ID NO: 20088 - RNA, 20 nt, Artificial Sequence
  targeting sequence with TTCN PAM
agagguuucccauugguuac

SEQ ID NO: 20089 - RNA, 20 nt, Artificial Sequence
  targeting sequence with TTCN PAM
aggguuugaguaccuuccag

SEQ ID NO: 20090 - RNA, 20 nt, Artificial Sequence
  targeting sequence with TTCN PAM
ucaagccugcugucacucug

SEQ ID NO: 20091 - RNA, 20 nt, Artificial Sequence
  targeting sequence with TTCN PAM
auaaaucugugcuuuuguug

SEQ ID NO: 20092 - RNA, 20 nt, Artificial Sequence
  targeting sequence with TTCN PAM
uuccauggcccugaaaacag

SEQ ID NO: 20093 - RNA, 20 nt, Artificial Sequence
  targeting sequence with TTCN PAM
auggcccugaaaacagucuu

SEQ ID NO: 20094 - RNA, 20 nt, Artificial Sequence
  targeting sequence with TTCN PAM
gggccauggaaagaaccaga

SEQ ID NO: 20095 - RNA, 20 nt, Artificial Sequence
  targeting sequence with TTCN PAM
cuugaugaaauccugcaguc

SEQ ID NO: 20096 - RNA, 20 nt, Artificial Sequence
  targeting sequence with TTCN PAM
ucaagggaaaaaaagacugu

SEQ ID NO: 20097 - RNA, 20 nt, Artificial Sequence
  targeting sequence with TTCN PAM
uauccagguacugguacaug

SEQ ID NO: 20098 - RNA, 20 nt, Artificial Sequence
  targeting sequence with TTCN PAM
aggaagccuaccagauugcu

SEQ ID NO: 20099 - RNA, 20 nt, Artificial Sequence
  targeting sequence with TTCN PAM
uugaacaguuuccuauccag

SEQ ID NO: 20100 - RNA, 20 nt, Artificial Sequence
  targeting sequence with TTCN PAM
auggccagugcacgccaauc

SEQ ID NO: 20101 - RNA, 20 nt, Artificial Sequence
  targeting sequence with TTCN PAM
aaaucuaaaccuagcgcuuc

SEQ ID NO: 20102 - RNA, 20 nt, Artificial Sequence
  targeting sequence with TTCN PAM
uugcuguuucaaaaucuaaa

SEQ ID NO: 20103 - RNA, 20 nt, Artificial Sequence
  targeting sequence with TTCN PAM
uaagggaccccacaaggacc

SEQ ID NO: 20104 - RNA, 20 nt, Artificial Sequence
  targeting sequence with TTCN PAM
ucacugugggccuggguagg

SEQ ID NO: 20105 - RNA, 20 nt, Artificial Sequence
  targeting sequence with TTCN PAM
aagauugcuucucuauagac

SEQ ID NO: 20106 - RNA, 20 nt, Artificial Sequence
  targeting sequence with TTCN PAM
cuauagacguagggugauga

SEQ ID NO: 20107 - RNA, 20 nt, Artificial Sequence
  targeting sequence with TTCN PAM
ggcugucacucuuauuagcu

SEQ ID NO: 20108 - RNA, 20 nt, Artificial Sequence
  targeting sequence with TTCN PAM
cuaugggaagcaccugacua

SEQ ID NO: 20109 - RNA, 20 nt, Artificial Sequence
  targeting sequence with TTCN PAM
cauagagaacagcuaauaag

SEQ ID NO: 20110 - RNA, 20 nt, Artificial Sequence
  targeting sequence with TTCN PAM
uagcaucugccaacuaaggu

SEQ ID NO: 20111 - RNA, 20 nt, Artificial Sequence
  targeting sequence with TTCN PAM
gacagcaaugugggcacuuc

SEQ ID NO: 20112 - RNA, 20 nt, Artificial Sequence
  targeting sequence with TTCN PAM
cacguaccuucauggcggga

SEQ ID NO: 20113 - RNA, 20 nt, Artificial Sequence
  targeting sequence with TTCN PAM
uggcgggauucauggacuug

SEQ ID NO: 20114 - RNA, 20 nt, Artificial Sequence
  targeting sequence with TTCN PAM
uggacuugauucguuguguc

SEQ ID NO: 20115 - RNA, 20 nt, Artificial Sequence
  targeting sequence with TTCN PAM
uuguguccuuuccuggccua

SEQ ID NO: 20116 - RNA, 20 nt, Artificial Sequence
  targeting sequence with TTCN PAM
uggccuagucuaugaaagcu

SEQ ID NO: 20117 - RNA, 20 nt, Artificial Sequence
  targeting sequence with TTCN PAM
uagacuaggccaggaaagga

SEQ ID NO: 20118 - RNA, 20 nt, Artificial Sequence
  targeting sequence with TTCN PAM
gccaucucucuagcuuucau

SEQ ID NO: 20119 - RNA, 20 nt, Artificial Sequence
  targeting sequence with TTCN PAM
uuaugugcagagagggguca

SEQ ID NO: 20120 - RNA, 20 nt, Artificial Sequence
  targeting sequence with TTCN PAM
ugagcuguguuuccaucuag

SEQ ID NO: 20121 - RNA, 20 nt, Artificial Sequence
  targeting sequence with TTCN PAM
aucuagaaccucagauggag

SEQ ID NO: 20122 - RNA, 20 nt, Artificial Sequence
  targeting sequence with TTCN PAM
agauggaaacacagcucagg

SEQ ID NO: 20123 - RNA, 20 nt, Artificial Sequence
  targeting sequence with TTCN PAM
uccaucugagguucuagaug

SEQ ID NO: 20124 - RNA, 20 nt, Artificial Sequence
  targeting sequence with TTCN PAM
uuccuccaucugagguucua

SEQ ID NO: 20125 - RNA, 20 nt, Artificial Sequence
  targeting sequence with TTCN PAM
aaccuccacuccccuacccc

SEQ ID NO: 20126 - RNA, 20 nt, Artificial Sequence
  targeting sequence with TTCN PAM
cucuuuaucuccccacaguc

SEQ ID NO: 20127 - RNA, 20 nt, Artificial Sequence
  targeting sequence with TTCN PAM
ugggcugacauugaaggagu

SEQ ID NO: 20128 - RNA, 20 nt, Artificial Sequence
  targeting sequence with TTCN PAM
augucagcccaggaauaugg

SEQ ID NO: 20129 - RNA, 20 nt, Artificial Sequence
  targeting sequence with TTCN PAM
ugccuacaagucuugaucua

SEQ ID NO: 20130 - RNA, 20 nt, Artificial Sequence
  targeting sequence with TTCN PAM
gaguccuggucugguccagu

SEQ ID NO: 20131 - RNA, 20 nt, Artificial Sequence
  targeting sequence with TTCN PAM
cucagagccccgguccuccc

SEQ ID NO: 20132 - RNA, 20 nt, Artificial Sequence
  targeting sequence with TTCN PAM
gaaauggggguagugagaau

SEQ ID NO: 20133 - RNA, 20 nt, Artificial Sequence
  targeting sequence with TTCN PAM
gaacugggaggaccggggcu

SEQ ID NO: 20134 - RNA, 20 nt, Artificial Sequence
  targeting sequence with TTCN PAM
cacuacccccauuucagaac

SEQ ID NO: 20135 - RNA, 20 nt, Artificial Sequence
  targeting sequence with TTCN PAM
ccuuuacaacaucucaguua

SEQ ID NO: 20136 - RNA, 20 nt, Artificial Sequence
  targeting sequence with TTCN PAM
aguaauggcuagcaucugca

SEQ ID NO: 20137 - RNA, 20 nt, Artificial Sequence
  targeting sequence with TTCN PAM
uacacuggggacaucuaaaa

SEQ ID NO: 20138 - RNA, 20 nt, Artificial Sequence
  targeting sequence with TTCN PAM
uccaucuccacuuuccuaca

SEQ ID NO: 20139 - RNA, 20 nt, Artificial Sequence
  targeting sequence with TTCN PAM
gaggagggaggaggcauccc

SEQ ID NO: 20140 - RNA, 20 nt, Artificial Sequence
  targeting sequence with TTCN PAM
cucuccugccccacccagaa

SEQ ID NO: 20141 - RNA, 20 nt, Artificial Sequence
  targeting sequence with TTCN PAM
ggguggggcaggagagggaa

SEQ ID NO: 20142 - RNA, 20 nt, Artificial Sequence
  targeting sequence with TTCN PAM
ucccugcuggcauuucuggg

SEQ ID NO: 20143 - RNA, 20 nt, Artificial Sequence
  targeting sequence with TTCN PAM
ggggauuugucaucuuccuc

SEQ ID NO: 20144 - RNA, 20 nt, Artificial Sequence
  targeting sequence with TTCN PAM
gugcccaaaacaacaccuau

SEQ ID NO: 20145 - RNA, 20 nt, Artificial Sequence
  targeting sequence with TTCN PAM
uucugugcccaaaacaacac

SEQ ID NO: 20146 - RNA, 20 nt, Artificial Sequence
  targeting sequence with TTCN PAM
uaauuucauucugugcccaa

SEQ ID NO: 20147 - RNA, 20 nt, Artificial Sequence
  targeting sequence with TTCN PAM
cucuagauugucaccuccuu

SEQ ID NO: 20148 - RNA, 20 nt, Artificial Sequence
  targeting sequence with TTCN PAM
uggguguaaggaggugacaa

SEQ ID NO: 20149 - RNA, 20 nt, Artificial Sequence
  targeting sequence with TTCN PAM
aauauuuguugagcaccaac

SEQ ID NO: 20150 - RNA, 20 nt, Artificial Sequence
  targeting sequence with TTCN PAM
uucauuuauuuaacucccca

SEQ ID NO: 20151 - RNA, 20 nt, Artificial Sequence
  targeting sequence with TTCN PAM
uuuauuuaacuccccagccu

SEQ ID NO: 20152 - RNA, 20 nt, Artificial Sequence
  targeting sequence with TTCN PAM
cagggaguguuuuggugaua

SEQ ID NO: 20153 - RNA, 20 nt, Artificial Sequence
  targeting sequence with TTCN PAM
auucucagggaguguuuugg

SEQ ID NO: 20154 - RNA, 20 nt, Artificial Sequence
  targeting sequence with TTCN PAM
uugauuuauuuaaauuaaaa

SEQ ID NO: 20155 - RNA, 20 nt, Artificial Sequence
  targeting sequence with TTCN PAM
uugggaggccgagacaggca

SEQ ID NO: 20156 - RNA, 20 nt, Artificial Sequence
  targeting sequence with TTCN PAM
gccccagccucccaaguagc

SEQ ID NO: 20157 - RNA, 20 nt, Artificial Sequence
  targeting sequence with TTCN PAM
agcaauucugccccagccuc

SEQ ID NO: 20158 - RNA, 20 nt, Artificial Sequence
  targeting sequence with TTCN PAM
agccuuggugacacagcaag

SEQ ID NO: 20159 - RNA, 20 nt, Artificial Sequence
  targeting sequence with TTCN PAM
aaacaucauauuguacugau

SEQ ID NO: 20160 - RNA, 20 nt, Artificial Sequence
  targeting sequence with TTCN PAM
ucuaaauccuguaucccccc

SEQ ID NO: 20161 - RNA, 20 nt, Artificial Sequence
  targeting sequence with TTCN PAM
uucccucugugacaggcacu

SEQ ID NO: 20162 - RNA, 20 nt, Artificial Sequence
  targeting sequence with TTCN PAM
cucugugacaggcacucagg

SEQ ID NO: 20163 - RNA, 20 nt, Artificial Sequence
  targeting sequence with TTCN PAM
cugccaucuaguggggaugg

SEQ ID NO: 20164 - RNA, 20 nt, Artificial Sequence
  targeting sequence with TTCN PAM
caggcuucccucuacugagc

SEQ ID NO: 20165 - RNA, 20 nt, Artificial Sequence
  targeting sequence with TTCN PAM
cucuacugagcucauucagg

SEQ ID NO: 20166 - RNA, 20 nt, Artificial Sequence
  targeting sequence with TTCN PAM
ggggccuucugaccacucug

SEQ ID NO: 20167 - RNA, 20 nt, Artificial Sequence
  targeting sequence with TTCN PAM
gaccacucugaacagcugcc

SEQ ID NO: 20168 - RNA, 20 nt, Artificial Sequence
  targeting sequence with TTCN PAM
gaguggucagaaggccccug

SEQ ID NO: 20169 - RNA, 20 nt, Artificial Sequence
  targeting sequence with TTCN PAM
accugaugcauccugcagca

SEQ ID NO: 20170 - RNA, 20 nt, Artificial Sequence
  targeting sequence with TTCN PAM
uucaaccugaugcauccugc

SEQ ID NO: 20171 - RNA, 20 nt, Artificial Sequence
  targeting sequence with TTCN PAM
aaguuccuucaaccugaugc

SEQ ID NO: 20172 - RNA, 20 nt, Artificial Sequence
  targeting sequence with TTCN PAM
cagugggcaaauccuagacu

SEQ ID NO: 20173 - RNA, 20 nt, Artificial Sequence
  targeting sequence with TTCN PAM
agcucuaggucggcugugcu

SEQ ID NO: 20174 - RNA, 20 nt, Artificial Sequence
  targeting sequence with TTCN PAM
acaaagauggcuggagccca

SEQ ID NO: 20175 - RNA, 20 nt, Artificial Sequence
  targeting sequence with TTCN PAM
gggcuccagccaucuuugug

SEQ ID NO: 20176 - RNA, 20 nt, Artificial Sequence
  targeting sequence with TTCN PAM
cugcuucugggcuccagcca

SEQ ID NO: 20177 - RNA, 20 nt, Artificial Sequence
  targeting sequence with TTCN PAM
aggucucaguccucgcucug

SEQ ID NO: 20178 - RNA, 20 nt, Artificial Sequence
  targeting sequence with TTCN PAM
cucucggccacugugccgug

SEQ ID NO: 20179 - RNA, 20 nt, Artificial Sequence
  targeting sequence with TTCN PAM
uuaaaacaccuugagaggac

SEQ ID NO: 20180 - RNA, 20 nt, Artificial Sequence
  targeting sequence with TTCN PAM
uuagcccaugugaugcccgc

SEQ ID NO: 20181 - RNA, 20 nt, Artificial Sequence
  targeting sequence with TTCN PAM
augaauucuucuucacaaac

SEQ ID NO: 20182 - RNA, 20 nt, Artificial Sequence
  targeting sequence with TTCN PAM
uagaaaagggcaaugcgggc

SEQ ID NO: 20183 - RNA, 20 nt, Artificial Sequence
  targeting sequence with TTCN PAM
ucuucacaaacacuuguuug

SEQ ID NO: 20184 - RNA, 20 nt, Artificial Sequence
  targeting sequence with TTCN PAM
ucacaaacacuuguuugcua

SEQ ID NO: 20185 - RNA, 20 nt, Artificial Sequence
  targeting sequence with TTCN PAM
caaacacuuguuugcuaggu

SEQ ID NO: 20186 - RNA, 20 nt, Artificial Sequence
  targeting sequence with TTCN PAM
gacucugaugccucccuuaa

SEQ ID NO: 20187 - RNA, 20 nt, Artificial Sequence
  targeting sequence with TTCN PAM
uccguguucuccaggcaucu

SEQ ID NO: 20188 - RNA, 20 nt, Artificial Sequence
  targeting sequence with TTCN PAM
ccaggcaucugguucauagu

SEQ ID NO: 20189 - RNA, 20 nt, Artificial Sequence
  targeting sequence with TTCN PAM
uagucggagagcucuuagcu

SEQ ID NO: 20190 - RNA, 20 nt, Artificial Sequence
  targeting sequence with TTCN PAM
aacaggggaggcugaccaau

SEQ ID NO: 20191 - RNA, 20 nt, Artificial Sequence
  targeting sequence with TTCN PAM
gaggccacauucuaacaggg

SEQ ID NO: 20192 - RNA, 20 nt, Artificial Sequence
  targeting sequence with TTCN PAM
uccuggguccucagucucug

SEQ ID NO: 20193 - RNA, 20 nt, Artificial Sequence
  targeting sequence with TTCN PAM
uggguccucagucucugaca

SEQ ID NO: 20194 - RNA, 20 nt, Artificial Sequence
  targeting sequence with TTCN PAM
ugucagagacugaggaccca

SEQ ID NO: 20195 - RNA, 20 nt, Artificial Sequence
  targeting sequence with TTCN PAM
ucccacaggaccaggcuucc

SEQ ID NO: 20196 - RNA, 20 nt, Artificial Sequence
  targeting sequence with TTCN PAM
ucuuuucaucccacaggacc

SEQ ID NO: 20197 - RNA, 20 nt, Artificial Sequence
  targeting sequence with TTCN PAM
ggagggaggaugccaugcug

SEQ ID NO: 20198 - RNA, 20 nt, Artificial Sequence
  targeting sequence with TTCN PAM
guucaaagggcucuggagcu

SEQ ID NO: 20199 - RNA, 20 nt, Artificial Sequence
  targeting sequence with TTCN PAM
aagggcucuggagcugcugc

SEQ ID NO: 20200 - RNA, 20 nt, Artificial Sequence
  targeting sequence with TTCN PAM
aaaugggcugaccugugccu

SEQ ID NO: 20201 - RNA, 20 nt, Artificial Sequence
  targeting sequence with TTCN PAM
gguggcuuugcugucaccau

SEQ ID NO: 20202 - RNA, 20 nt, Artificial Sequence
  targeting sequence with TTCN PAM
gcccaggguuuggaggagca

SEQ ID NO: 20203 - RNA, 20 nt, Artificial Sequence
  targeting sequence with TTCN PAM
gauucugcccaggguuugga

SEQ ID NO: 20204 - RNA, 20 nt, Artificial Sequence
  targeting sequence with TTCN PAM
ucagaaacuucuagaggucc

SEQ ID NO: 20205 - RNA, 20 nt, Artificial Sequence
  targeting sequence with TTCN PAM
gaggaacaagcagacuggug

SEQ ID NO: 20206 - RNA, 20 nt, Artificial Sequence
  targeting sequence with TTCN PAM
agagguccaugaguuaaagu

SEQ ID NO: 20207 - RNA, 20 nt, Artificial Sequence
  targeting sequence with TTCN PAM
aggcaagggcugcaauuuua

SEQ ID NO: 20208 - RNA, 20 nt, Artificial Sequence
  targeting sequence with TTCN PAM
acagacuuggcgggauucau

SEQ ID NO: 20209 - RNA, 20 nt, Artificial Sequence
  targeting sequence with TTCN PAM
uucccuaccccuccaccuuc

SEQ ID NO: 20210 - RNA, 20 nt, Artificial Sequence
  targeting sequence with TTCN PAM
cuaccccuccaccuucucca

SEQ ID NO: 20211 - RNA, 20 nt, Artificial Sequence
  targeting sequence with TTCN PAM
ccaagaaucuguguuuaugc

SEQ ID NO: 20212 - RNA, 20 nt, Artificial Sequence
  targeting sequence with TTCN PAM
uggagaagguggagggguag

SEQ ID NO: 20213 - RNA, 20 nt, Artificial Sequence
  targeting sequence with TTCN PAM
ccuccuccacgcccucugca

SEQ ID NO: 20214 - RNA, 20 nt, Artificial Sequence
  targeting sequence with TTCN PAM
acccaugucgccaagaugua

SEQ ID NO: 20215 - RNA, 20 nt, Artificial Sequence
  targeting sequence with TTCN PAM
ucuuuggcucgagagucucc

SEQ ID NO: 20216 - RNA, 20 nt, Artificial Sequence
  targeting sequence with TTCN PAM
uuggcucgagagucucccaa

(The sequence listing continues in the following parts.)

The invention claimed is:

1. A composition comprising a CasX variant protein comprising the sequence of SEQ ID NO: 138, or a sequence having at least 90% sequence identity thereto, and a first guide ribonucleic acid (gRNA), wherein the CasX variant protein is a chimeric CasX protein comprising protein domains from two or more different CasX proteins and wherein the gRNA comprises a targeting sequence complementary to a rhodopsin (RHO) gene target nucleic acid sequence comprising one or more mutations.

2. The composition of claim 1, wherein the one or more mutations are in a region selected from the group consisting of:
   a) a RHO intron;
   b) a RHO exon;
   c) a RHO intron-exon junction;
   d) a RHO regulatory element; and
   e) an intergenic region.

3. The composition of claim 1, wherein the one or more mutations comprise an insertion, deletion, substitution, duplication, or inversion of one or more nucleotides as compared to a wild-type RHO gene sequence.

4. The composition of claim 3, wherein the one or more mutations comprise a gain of function mutation.

5. The composition of claim 1, wherein the one or more mutations in the RHO gene target nucleic acid sequence encode a mutation selected from the group consisting of: T4K, P12R, N15S, T17M, V20G, R21C, P23A/H/L, Q28H, M39R, L40R, M44T, L46R, L47R, G51R/V, F52Y, P53R, N55K, F56Y, L57R, T58R/M, Y60ter, Q64ter, R69H, N78I, L79P, V87L, V87D, L88P, G89D, G90V, G90D, T92I, T94I, T97I, V104F, G106R/W, G109R, C110F/R/S/Y, E113K, G114D/V, E122G, L125R, W126L/ter, S127F, L131P, R135G/UP/W, Y136ter, V137M, C140S, T160T, W161R, M163T, A164E/V, C167R/W, A169P, P170H/R, P171Q/US, S176F, Y178N/D/C, P180A/S, E181K, G182S/V, Q184P, C185R, S186P/W, C187G/Y, G188R/E, D190N/G/Y, Y191C, T193M, M207R/K, V210F, H211R/P, I214N, P215L/T, M216L/K, C222R, R252P, P267R/L, S270R, T289P, A292E, A295V, K296N/E/M, S297R, A298D, K311E, N315ter, L328P, E341K, S343C, T342M, Q344R/P/ter, V345L/M, A346P, P347A/R/Q/L/S/T, and Ter349/Q/E relative to the wild-type rhodopsin protein sequence of SEQ ID NO: 33.

6. The composition of claim 1, wherein the RHO gene encodes a protein comprising a P23H substitution compared to the wild-type rhodopsin protein sequence of SEQ ID NO: 33.

7. The composition of claim 1, wherein the RHO gene encodes a non-functional rhodopsin protein.

8. The composition of claim 1, wherein the gRNA is a single-molecule gRNA (sgRNA).

9. The composition of claim 1, wherein the targeting sequence of the gRNA comprises a ribonucleic acid (RNA) sequence encoded by a sequence selected from the group consisting of the sequences of SEQ ID NOS: 328-344, 367, and 368, or a sequence having at least 90% identity thereto.

10. The composition of claim 1, wherein the targeting sequence of the gRNA comprises a ribonucleic acid (RNA) sequence encoded by a sequence selected from the group consisting of the sequences of SEQ ID NOS: 328-344 367, and 368.

11. The composition of claim 1, wherein the targeting sequence of the gRNA is complementary to a sequence of a RHO exon, to a sequence of a RHO intron, to a sequence of a RHO intron-exon junction, to a sequence of a RHO regulatory element, to a sequence of an intergenic region of the RHO gene or to a sequence comprising one or more single nucleotide polymorphisms (SNPs) of the RHO gene.

12. The composition of claim 1, wherein the targeting sequence of the gRNA is complementary to a sequence of RHO exon 1 or complementary to a target nucleic acid sequence encoding a P23H substitution compared to the wild-type rhodopsin protein sequence of SEQ ID NO: 33.

13. The composition of claim 1, further comprising a second gRNA, wherein the second gRNA has a targeting sequence complementary to a different or overlapping portion of the RHO target nucleic acid compared to the targeting sequence of the first gRNA.

14. The composition of claim 13, wherein the first or second gRNA has a scaffold comprising the sequence of SEQ ID NO: 2238, or a sequence having at least 70% identity thereto.

15. The composition of claim 1, wherein the CasX variant protein further comprises one or more nuclear localization signals (NLS).

16. The composition of claim 10, further comprising a donor template nucleic acid.

17. The composition of claim 1, wherein the chimeric CasX protein comprising protein domains from two or more different CasX proteins, comprises proteins domains from two or more different reference CasX proteins.

18. The composition of claim 1, wherein the chimeric CasX protein comprising protein domains from two or more different CasX proteins, comprises proteins domains from two or more different CasX variant proteins.

19. A composition comprising a CasX variant protein and a first guide ribonucleic acid (gRNA), wherein the CasX variant protein comprises the sequence of SEQ ID NO: 138, or a sequence having at least 90% sequence identity thereto, wherein the gRNA has a scaffold comprising a sequence having at least 70% sequence identity to the sequence of SEQ ID NO: 2238, and wherein the gRNA comprises a targeting sequence complementary to a rhodopsin (RHO) gene target nucleic acid sequence comprising one or more mutations.

20. The composition of claim 19, wherein the one or more mutations are in a region selected from the group consisting of:
  a) a RHO intron;
  b) a RHO exon;
  c) a RHO intron-exon junction;
  d) a RHO regulatory element; and
  e) an intergenic region.

21. The composition of claim 19, wherein the RHO gene comprising a mutation encodes a protein comprising a P23H substitution compared to the wild-type rhodopsin protein sequence of SEQ ID NO: 33.

22. The composition of claim 19, wherein the targeting sequence of the gRNA comprises a ribonucleic acid (RNA) sequence encoded by a sequence selected from the group consisting of the sequences of SEQ ID NOS: 328-344, 367, and 368 or a sequence having at least 90% identity thereto.

23. A nucleic acid vector:
  (a) encoding a CasX variant protein, the CasX variant protein comprising the sequence of SEQ ID NO: 138 or a sequence having at least 90% sequence identity thereto; and
  (b) encoding a guide ribonucleic acid (gRNA), wherein the gRNA has a scaffold comprising a sequence having at least 70% sequence identity to the sequence of SEQ ID NO: 2238 and wherein the gRNA comprises a targeting sequence complementary to a rhodopsin (RHO) gene target nucleic acid sequence comprising one or more mutations.

24. The nucleic acid vector of claim 23, wherein the targeting sequence of the gRNA comprises a ribonucleic acid (RNA) sequence encoded by a sequence selected from the group consisting of the sequences of SEQ ID NOs: 328-344, 367, and 368 or a sequence having at least 90% identity thereto.

25. The nucleic acid vector of claim 23, wherein the nucleic acid vector is as an adeno-associated viral (AAV) vector.

26. A method of treating autosomal dominant retinitis pigmentosa in a subject in need thereof with a P23H mutation relative to the wild-type rhodopsin protein sequence of SEQ ID NO: 33, comprising modifying a RHO gene encoding the mutation in eye cells of the subject, the modifying comprising contacting said cells in one or both eyes with a therapeutically effective dose of the nucleic acid vector of claim 25, wherein the contacting is by intravitreal or subretinal injection, and wherein the targeting sequence complementary to the RHO gene target nucleic acid sequence is encoded by the sequence of SEQ ID NO: 368.

* * * * *

UNITED STATES PATENT AND TRADEMARK OFFICE
CERTIFICATE OF CORRECTION

PATENT NO. : 11,535,835 B1
APPLICATION NO. : 17/483681
DATED : December 27, 2022
INVENTOR(S) : Oakes et al.

It is certified that error appears in the above-identified patent and that said Letters Patent is hereby corrected as shown below:

In the Claims

At Claim 1, Column 287, Line 37, please replace "proteins and" with --proteins, and--.

At Claim 5, Column 287, Line 64, please replace "R135G/UP/W" with --R135G/L/P/W--.

At Claim 5, Column 287, Line 65, please replace "P171Q/US" with --P171Q/L/S--.

At Claim 5, Column 288, Line 32, please replace "M216L/K" with --M216R/L/K--.

Signed and Sealed this
Sixth Day of June, 2023

Katherine Kelly Vidal
*Director of the United States Patent and Trademark Office*